(12) United States Patent
Panik et al.

(10) Patent No.: US 10,457,954 B2
(45) Date of Patent: Oct. 29, 2019

(54) ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE

(75) Inventors: David Panik, Bat-Yam (IL); Basia Judith Vinocur, Rechovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 318 days.

(21) Appl. No.: 13/819,777

(22) PCT Filed: Aug. 23, 2011

(86) PCT No.: PCT/IB2011/053697
§ 371 (c)(1),
(2), (4) Date: Feb. 28, 2013

(87) PCT Pub. No.: WO2012/028993
PCT Pub. Date: Mar. 8, 2012

(65) Prior Publication Data
US 2013/0167265 A1   Jun. 27, 2013

Related U.S. Application Data

(63) Continuation-in-part of application No. PCT/IB2011/051843, filed on Apr. 27, 2011.

(60) Provisional application No. 61/437,715, filed on Jan. 31, 2011, provisional application No. 61/405,260, filed on Oct. 21, 2010, provisional application No. 61/378,003, filed on Aug. 30, 2010.

(51) Int. Cl.
*C12N 15/29* (2006.01)
*C12N 15/82* (2006.01)
*C07K 14/415* (2006.01)

(52) U.S. Cl.
CPC ........ *C12N 15/8271* (2013.01); *C07K 14/415* (2013.01); *C12N 15/8247* (2013.01); *C12N 15/8261* (2013.01); *Y02A 40/146* (2018.01)

(58) Field of Classification Search
None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,296,467 A | 3/1994 | Thomashow |
| 5,316,931 A | 5/1994 | Donson et al. |
| 5,356,816 A | 11/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Maier et al. J. Mol. Biol. 251 (5), 614-628 (1995).*

(Continued)

*Primary Examiner* — Charles Logsdon

(57) ABSTRACT

Provided are isolated polynucleotides and nucleic acid constructs which comprise a nucleic acid sequence at least 80% identical to a nucleic acid sequence selected form the group consisting of SEQ ID NOs: 277, 1-276, 278-469 and 785-2397; and isolated polypeptides which comprise an amino acid sequence at least 80% homologous to an amino acid sequence selected from the group consisting of SEQ ID NOs: 482, 470-481, 483-784 and 2398-3818. Also provided are transgenic cells and plants expressing same and methods of using same for increasing nitrogen use efficiency, yield, biomass, growth rate, vigor, oil content, fiber yield, fiber quality, and/or abiotic stress tolerance of a plant.

21 Claims, 8 Drawing Sheets
Specification includes a Sequence Listing.

(56) References Cited

U.S. PATENT DOCUMENTS

| | | |
|---|---|---|
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |
| 6,084,153 A | 7/2000 | Good et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,472,588 B1 | 10/2002 | Haigler et al. |
| 6,670,528 B1 | 12/2003 | Shinozaki et al. |
| 6,720,477 B2 | 4/2004 | Da Costa e Silva et al. |
| 7,214,786 B2 | 5/2007 | Kovalic et al. |
| 7,554,007 B2 * | 6/2009 | Ronen .................. C07K 14/415 435/430 |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2003/0236208 A1 * | 12/2003 | Kmiec .................. C12N 15/102 514/44 R |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1 | 6/2004 | La Rosa et al. |
| 2004/0172684 A1 | 9/2004 | Kovalic et al. |
| 2004/0181830 A1 | 9/2004 | Kovalic et al. |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalic et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0197120 A1 | 8/2008 | Wu et al. |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 * | 4/2009 | Troukhan .............. C07K 14/415 800/290 |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0125258 A1 | 5/2013 | Emmanuel et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |

(56) References Cited

FOREIGN PATENT DOCUMENTS

| WO | WO 2009/083958 | 7/2009 |
|---|---|---|
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/128448 | 9/2013 |
| WO | WO 2013/179211 | 12/2013 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Roose et al. (Photosynth Res (2007) 92:369-387).*
Guo et al. (2004, Proc. Natl. Acad. Sci. USA 101: 9205-9210).*
Paterson et al. (Nature 457 (7229), 551-556 (2009)).*
GenBank Accession (XM_002459295) Submitted (Sep. 27, 2008).*
Gorantla et al., Journal of Experimental Botany, vol. 58, No. 2, pp. 253-265, 2007. (Year: 2007).*
GenBank Accession (XM_002459295, Submitted (Sep. 27, 2008). (Year: 2008).*
Applicant-Initiated Interview Summary dated Nov. 20, 2013 From the US Patent and Trademark Office Re. U.S. Appl. No. 13/125,047.
Requisition by the Examiner dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
International Search Report and the Written Opinion dated Apr. 10, 2013 From the International Searching Authority Re. Application No. PCT/IL2012/050327.
Invitation to Pay Additional Fees dated Apr. 8, 2013 From the International Searching Authority Re. Application No. PCT/IL2013/050172.
Requisition by the Examiner dated Apr. 11, 2013 From the Canadian Intellectual Property Office Re. Application No. 2,626,592.
Translation of Office Action dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Communication Pursuant to Article 94(3) EPC dated May 29, 2013 From the European Patent Office Re. Application No. 09823171.5.
Official Action dated Jun. 24, 2013 From the US Patent and Trademark Office Re. U.S. Appl. No. 12/992,902.
Patent Examination Report dated Jun. 21, 2013 From the Australian Government, IP Australia Re. Application No. 2012241091.
Arabidopsis Genome Initiative "Analysis of the Genome Sequence of the Flowering Plant Arabicopsis thaliana" Nature, 408: 796-815, Dec. 14, 2000.
Ciddi et al. "Elicitation of Taxus SP. Cell Cultures for Production of Taxol", Biotechnology Letters, 17(12): 1343-1346, Dec. 1995.
Kikuchi et al. "Oryza sativa Japonica Group cDNA Clone:J023131O04, Full Insert Sequence", GenBank Database Accession No. AK072531, Jul. 2, 2013.

Lurin et al. "Genome-Wide Analysis of Arabidopsis Pentatricopeptide Repeat Proteins Reveals Their Essential Role in Organelle Biogenesis", The plant Cell, 16: 2089-2103, Aug. 2004.
Terminology "Frequently Asked Questions", Bioinformatics Website, Frequently Asked Questions, 2001.
Theologis et al. "Sequence and Analysis off Chromosome 1 of the Plant Arabidopsis thaliana", Nature, 408: 816-820, Dec. 14, 2000.
Communication Pursuant to Article 94(3) EPC dated Nov. 7, 2013 From the European Patent Office Re. Application No. 10748403.2.
Communication Pursuant to Rules 70(2) and 70a(2) EPC dated Nov. 4, 2013 From the European Patent Office Re. Application No. 10840687.7.
Examination Report dated Aug. 22, 2013 From the Instituto Mexicano de la Propiedad Industrial Re. Application No. MX/a/2011/009044 and Its Translation Into English.
Official Action dated Oct. 29, 2013 From the US Patent and Trademark Office Re. U.S. Appl. No. 13/059,231.
Seki et al. "Monitoring the Expression Profiles of 7000 Arabidopsis Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Requisition by the Examiner dated Aug. 27, 2013 From the Canadian Intellectual Property Office Re. Application No. 2,526,440.
Examination Report dated Oct. 1, 2013 From the Instituto Mexicano de la Propiedad Industrial Re. Application No. MX/a/2010/000975 and Its Translation Into English.
International Preliminary Report on Patentability dated Nov. 14, 2013 From the International Bureau of WIPO Re. Application No. PCT/IL2012/050154.
Examination Report dated Dec. 16, 2013 From the Government of India, Patent Office, Intellectual Property Building Re. Application No. 2570/CHENP/2008.
Li et al. "Dehydration-Induced Protein RD22-Like Protein [Gossypium hirsutum]", NCBI Database [Online], GenBank: AAL67991. 1, GenBank Accession No. AAL67991, Dec. 4, 2002.
Official Action dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TIG, 14(6): 248-250, Jun. 1998.
Smith et al. "The Challenges of Genome Sequence Annotation or 'The Devil Is in the Details'", Nature Biotechnology, 15: 1222-1223, Nov. 1997.
Communication Pursuant to Rule 58 EPC or Rule 159 EPC, Invitation to Remedy Deficiencies in the Application Documents dated Dec. 6, 2013 From the European Patent Office Re. Application No. 11190921.4.
Patent Examination Report dated Jan. 3, 2014 From the Australian Government, IP Australia Re. Application No. 2008278654.
Examination Report dated May 23, 2013 From the Instituto Mexicano de la Propiedad Industrial Re. Application No. MX/a/2011/001741 and Its Translation Into English.
Invitation to Pay Additional Fees dated Jul. 17, 2013 From the International Searching Authority Re. Application No. PCT/IB2013/054374.
Official Action dated Jul. 26, 2013 From the US Patent and Trademark Office Re. U.S. Appl. No. 13/254,183.
Matsumoto et al. "Os11g0162200 [Oryza sativa Japonica Group]", Direct GenBank Sequence Submission, GenBank: BAF27672.1, GenBank Accession No. BAF27672, Aug. 11, 2012.
Examination Report dated Jun. 7, 2013 From the Instituto Mexicano de la Propiedad Industrial Re. Application No. MX/a/2011/003575 and Its Translation Into English.
Examination Report dated Jun. 20, 2013 From the Instituto Mexicano de la Propiedad Industrial Re. Application No. MX/a/2011/007294 and Its Translation Into English.
International Search Report and the Written Opinion dated Sep. 1, 2013 From the International Searching Authority Re. Application No. PCT/IB2013/054374.

(56) References Cited

OTHER PUBLICATIONS

Bennetzen et al. "Setaria Italica Strain Yugu1 SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
NCBI "PREDICTED: Nudix Hydrolase 16, Mitochondrial-Like [Setaria Italica]", Database NCBI [Online], NCBI Reference Sequence: XP_004955808, Jun. 26, 2013.
Communication Pursuant to Article 94(3) EPC dated Aug. 20, 2013 From the European Patent Office Re. Application No. 11172514.9.
Official Action dated Sep. 16, 2013 From the US Patent and Trademark Office Re. U.S. Appl. No. 13/125,047.
Translation of Office Action dated Aug. 28, 2013 From the State Intellectual Property Office of the People's Republic of China Re. Application No. 200880109464.9.
Clontech "Genome Walker™ Universal Kit User Manual", Clontech Laboratories Inc., Cat. No. 638904, PT3042-1 (PR742239), p. 1-30, Apr. 25, 2007.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Examination Report dated Jul. 29, 2013 From the Instituto Mexicano de la Propiedad Industrial Re. Application No. MX/a/2010/012697 and Its Translation Into English.
Official Action dated Sep. 20, 2013 From the US Patent and Trademark Office Re. U.S. Appl. No. 12/669,975.
Communication Pursuant to Article 94(3) EPC dated Oct. 9, 2013 From the European Patent Office Re. Application No. 08869158.9.
Invitation to Pay Additional Fees dated Oct. 16, 2013 From the International Searching Authority Re. Application No. PCT/IL2013/050725.
Office Action dated Sep. 9, 2013 From the State Intellectual Property Office of the People's Republic of China Re. Application No. 200910217137.1 and Its Translation Into English.
Supplementary European Search Report and the European Search Opinion dated Oct. 15, 2013 From the European Patent Office Re. Application No. 10840687.7.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide has 96.4% Identity to SEQ ID No:653 and Is Used for the Same Purpose, Abstract, Sequence.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No:166, 653, Abstract, Sequence.
Office Action dated Oct. 28, 2013 From the State Intellectual Property Office of the People's Republic of China Re. Application No. 201110104274.1 and Its Translation Into English.
Advisory Action Before the Filing of an Appeal Brief dated Nov. 19, 2013 From the US Patent and Trademark Office Re. U.S. Appl. No. 12/834,106.
International Search Report and the Written Opinion dated Nov. 19, 2013 From the International Searching Authority Re. Application No. PCT/IL2013/050725.
Yu et al. "Cell Cycle Checkpoint Protein MAD2 Homolog [Zea mays]", Database NCBI [Online], GenBank: AAD30555.1, GenBank Accession No. AAD30555, May 17, 1999.
Advisory Action Before the Filing of an Appeal Brief dated Dec. 20, 2013 From the US Patent and Trademark Office Re. U.S. Appl. No. 12/834,106.
Applicant-Initiated Interview Summary dated Dec. 18, 2013 From the US Patent and Trademark Office Re. U.S. Appl. No. 12/834,106.
Communication Pursuant to Article 94(3) EPC dated Dec. 8, 2008 From the European Patent Office Re.: Application No. 04734072.4.
International Preliminary Report on Patentability dated Dec. 8, 2005 From the International Bureau of WIPO Re.: Application No. PCT/IL2004/000431.
International Preliminary Report on Patentability dated Jan. 22, 2009 From the International Bureau of WIPO Re.: Application No. PCT/IL2006/001223.
Invitation to Pay Additional Fees dated Feb. 7, 2008 From the International Searching Authority Re.: Application No. PCT/IL06/001223.
Invitation to Pay Additional Fees dated Dec. 18, 2008 From the International Searching Authority Re.: Application No. PCT/IL08/01024.
Advisory Action Before the Filing of an Appeal Brief dated Aug. 5, 2011 From the US Patent and Trademark Office Re. U.S. Appl. No. 12/083,978.
Advisory Action Before the Filing of an Appeal Brief dated Aug. 29, 2012 From the US Patent and Trademark Office Re. U.S. Appl. No. 12/457,199.
Applicant-Initiated Interview Summary dated Aug. 6, 2012 From the US Patent and Trademark Office Re. U.S. Appl. No. 12/669,975.
Communication Pursuant to Article 94(3) EPC dated Apr. 3, 2012 From the European Patent Office Re.: Application No. 06766224.7.
Communication Pursuant to Article 94(3) EPC dated Jan. 3, 2013 From the European Patent Office Re. Application No. 09807983.3.
Communication Pursuant to Article 94(3) EPC dated Jul. 4, 2012 From the European Patent Office Re. Application No. 10194223.3.
Communication Pursuant to Article 94(3) EPC dated Mar. 8, 2011 From the European Patent Office Re.: Application No. 06809784.9.
Communication Pursuant to Article 94(3) EPC dated Nov. 8, 2010 From the European Patent Office Re.: Application No. 04734072.4.
Communication Pursuant to Article 94(3) EPC dated Sep. 9, 2009 From the European Patent Office Re.: Application No. 04734072.4.
Communication Pursuant to Article 94(3) EPC dated May 12, 2010 From the European Patent Office Re.: Application No. 06766224.7.
Communication Pursuant to Article 94(3) EPC dated Feb. 13, 2009 From the European Patent Office Re.: Application No. 05750089.4.
Communication Pursuant to Article 94(3) EPC dated Jul. 13, 2012 From the European Patent Office Re. Application No. 11172514.9.
Communication Pursuant to Article 94(3) EPC dated Feb. 14, 2012 From the European Patent Office Re.: Application No. 04734072.4.
Communication Pursuant to Article 94(3) EPC dated Mar. 14, 2011 From the European Patent Office Re. Application No. 07849616.3.
Communication Pursuant to Article 94(3) EPC dated Jun. 15, 2012 From the European Patent Office Re. Application No. 11154193.4.
Communication Pursuant to Article 94(3) EPC dated Dec. 19, 2012 From the European Patent Office Re.: Application No. 04734072.4.
Communication Pursuant to Article 94(3) EPC dated Nov. 19, 2010 From the European Patent Office Re.: Application No. 06809784.9.
Communication Pursuant to Article 94(3) EPC dated Jun. 21, 2012 From the European Patent Office Re. Application No. 11154213.0.
Communication Pursuant to Article 94(3) EPC dated Oct. 23, 2012 From the European Patent Office Re. Application No. 11154193.4.
Communication Pursuant to Article 94(3) EPC dated Oct. 23, 2012 From the European Patent Office Re. Application No. 11154213.0.
Communication Pursuant to Article 94(3) EPC dated Nov. 27, 2009 From the European Patent Office Re.: Application No. 06809784.9.
Communication Pursuant to Article 94(3) EPC dated Jun. 29, 2011 From the European Patent Office Re. Application No. 08738191.9.
Communication Pursuant to Rule 55 EPC dated Mar. 16, 2012 From the European Patent Office Re. Application No. 11190921.4.
Communication Pursuant to Rule 58 EPC or Rule 159 EPC, Invitation to Remedy Deficiencies in the Application Documents dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC dated Jul. 18, 2011 From the European Patent Office Re. Application No. 11154193.4.

(56) References Cited

OTHER PUBLICATIONS

Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC dated Jul. 25, 2011 From the European Patent Office Re. Application No. 11154213.0.
Communication Pursuant to Rule 70(2) EPC and Reference to Rule 39(1) EPC dated Sep. 13, 2010 From the European Patent Office Re.: Application No. 09163033.5.
Communication Pursuant to Rules 70(2) and 70a(2) EPC and Reference to Rule 39(1) EPC dated Dec. 5, 2011 From the European Patent Office Re. Application No. 10194223.3.
Communication Pursuant to Rules 70(2) and 70a(2) EPC and Reference to Rule 39(1) EPC dated Nov. 7, 2011 From the European Patent Office Re. Application No. 11172514.9.
Communication Pursuant to Rules 70(2) and 70a(2) EPC dated Mar. 5, 2013 From the European Patent Office Re. Application No. 10785834.2.
Communication Pursuant to Rules 70(2) and 70a(2) EPC dated May 7, 2012 From the European Patent Office Re. Application No. 09823171.5.
Communication Pursuant to Rules 70(2) and 70a(2) EPC dated Jan. 19, 2012 From the European Patent Office Re. Application No. 09807983.3.
Communication Pursuant to Rules 70(2) and 70a(2) EPC dated Jul. 24, 2012 From the European Patent Office Re. Application No. 10748403.2.
Communication Pursuant to Rules 70(2) and 70a(2) EPC dated May 24, 2011 From the European Patent Office Re. Application No. 09750276.9.
Communication Pursuant to Rules 70(2) and 70a(2) EPC dated Aug. 30, 2010 From the European Patent Office Re. Application No. 08738191.9.
Communication Relating to the Results of the Partial International Search dated Jul. 8, 2009 From the International Searching Authority Re.: Application No. PCT/IL2008/001657.
Communication Under Rule 71(3) EPC dated Jun. 5, 2012 From the European Patent Office Re.: Application No. 06809784.9.
Communication Under Rule 71(3) EPC dated Nov. 19, 2012 From the European Patent Office Re. Application No. 08738191.9.
Decision on Granting a Patent for Invention dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
English Summary of Examination Results dated Dec. 28, 2012 From the National Office of Intellectual Property (NOIP) of Vietnam Re. Application No. 1-2009-02358.
European Search Report and the European Search Opinion dated Nov. 2, 2011 From the European Patent Office Re. Application No. 10194223.3.
European Search Report and the European Search Opinion dated Oct. 6, 2011 From the European Patent Office Re. Application No. 11172514.9.
European Search Report and the European Search Opinion dated Aug. 9, 2010 From the European Patent Office Re.: Application No. 09163033.5.
European Search Report and the European Search Opinion dated Jun. 14, 2011 From the European Patent Office Re. Application No. 11154193.4.
European Search Report and the European Search Opinion dated Jun. 21, 2011 From the European Patent Office Re. Application No. 11154213.0.
Examination Report dated Aug. 1, 2011 From the Government of India, Patent Office Re.: Application No. 158/CHENP/2007.
Examination Report dated Nov. 3, 2010 From the Government of India, Patent Office Re.: Application No. 158/CHENP/2007.
Examination Report dated Jun. 6, 2012 From the Federal Service of Intellectual Property, Federal State Budget Institute, Federal Institute of Industrial Property of the Russian Federation Re. Application No. 2011113420 and Its Translation Into English.
Examination Report dated Dec. 7, 2012 From the Instituto Mexicano de la Propiedad Industrial Re. Application No. MX/a/2011/003575 and its Translation Into English.
Examination Report dated Jun. 11, 2012 From the Instituto Mexicano de la Propiedad Industrial Re. Application No. MX/a/2011/007294 and its Translation Into English.
Examination Report dated Jun. 11, 2012 From the Instituto Mexicano de la Propiedad Industrial Re. Application No. MX/a/2011/007294 and Summary in English.
Examination Report dated Nov. 13, 2007 From the Government of India, Patent Office Re.: Application No. 3482/CHENP/2005.
Examination Report dated Sep. 14, 2012 From the Australian Government IP Australia Re. Application No. 2007335706.
Examination Report dated Oct. 15, 2012 From the Instituto Mexicano de la Propiedad Industrial Re. Application No. MX/a/2009/006660 and its Translation Into English.
Examination Report dated Aug. 16, 2012 From the Instituto Mexicano de la Propiedad Industrial Re. Application No. MX/a/2010/014097 and its Translation Into English.
Examination Report dated Feb. 17, 2010 From the Instituto Mexicano de la Propriedad Industrial Re. Application No. PA/a/2005/012565 and its Summary in English.
Examination Report dated Apr. 19, 2011 From the Instituto Mexicano de la Propriedad Industrial Re. Application No. MX/a/2008/002262 and its Summary Into English.
Examination Report dated Dec. 19, 2011 From the Federal Service of Intellectual Property, Federal State Budget Institute, Federal Institute of Industrial Property of the Russian Federation Re. Application No. 2011113420 and its Translation Into English.
Examination Report dated Sep. 22, 2010 From the Instituto Mexicano de la Propiedad Industrial Re. Application No. MX/a/2008/005280 and its Summary Into English.
Examination Report dated Jun. 25, 2012 From the Instituto Mexicano de la Propiedad Industrial Re. Application No. MX/a/2011/003575 and its Translation Into English.
Examination Report dated May 25, 2011 From the Government of India, Patent Office Re.: Application No. 158/CHENP/2007.
Examiner's Report dated Aug. 1, 2011 From the Australian Government, IP Australia Re. Application No. 2005234725.
Examiner's Report dated Jan. 10, 2012 From the Australian Government, IP Australia Re. Application No. 2005234725.
Examiner's Report dated Jan. 13, 2011 From the Australian Government, IP Australia Re.: Application No. 2005252469.
Examiner's Report dated Jan. 13, 2012 From the Australian Government, IP Australia Re. Application No. 2011239323.
Examiner's Report dated Mar. 15, 2012 From the Australian Government, IP Australia Re. Application No. 2011239323.
Examiner's Report dated Dec. 17, 2009 From the Australian Government, IP Australia Re.: Application No. 2005252469.
Examiner's Report dated Oct. 19, 2011 From the Australian Government, IP Australia Re. Application No. 2006281018.
Examiner's Report dated Dec. 20, 2010 From the Australian Government, IP Australia Re. Application No. 2005234725.
Examiner's Report dated Jul. 21, 2011 From the Australian Government, IP Australia Re. Application No. 2005234725.
Examiner's Report dated Jun. 24, 2011 From the Australian Government, IP Australia Re. Application No. 2006281018.
Examiner's Report dated Oct. 28, 2011 From the Australian Government, IP Australia Re. Application No. 2006307457.
Examiner's Report dated Jun. 30, 2011 From the Australian Government, IP Australia Re. Application No. 2006307457.
Examiner's Report dated Jan. 31, 2012 From the Australian Government, IP Australia Re. Application No. 2006281018.
Examiner's Report dated Mar. 31, 2011 From the Australian Government, IP Australia Re.: Application No. 2005252469.
International Preliminary Report on Patentability dated Dec. 1, 2011 From the International Bureau of WIPO Re. Application No. PCT/IL2008/000489.
International Preliminary Report on Patentability dated Dec. 2, 2010 From the International Bureau of WIPO Re. Application No. PCT/IL2009/000508.

(56) References Cited

OTHER PUBLICATIONS

International Preliminary Report on Patentability dated Mar. 3, 2011 From the International Bureau of WIPO Re.: Application No. PCT/IB2009/053633.
International Preliminary Report on Patentability dated Feb. 4, 2010 From the International Bureau of WIPO Re.: Application No. PCT/IL2008/001024.
International Preliminary Report on Patentability dated Jul. 8, 2010 From the International Bureau of WIPO Re.: Application No. PCT/IL2008/001657.
International Preliminary Report on Patentability dated Apr. 12, 2012 From the Interantional Bureau of WIPO Re. Application No. PCT/IB2010/052545.
International Preliminary Report on Patentability dated Jul. 12, 2012 From the International Bureau of WIPO Re. Application No. PCT/IB2010/056023.
International Preliminary Report on Patentability dated May 12, 2011 From the International Bureau of WIPO Re. Application No. PCT/IB2009/054774.
International Preliminary Report on Patentability dated Jan. 14, 2010 From the International Bureau of WIPO Re.: Application No. PCT/IL2008/000489.
International Preliminary Report on Patentability dated Mar. 14, 2013 From the International Bureau of WIPO Re. Application No. PCT/IB2011/053697.
International Preliminary Report on Patentability dated Sep. 15, 2011 From the International Bureau of WIPO Re. Application No. PCT/IB2010/050871.
International Preliminary Report on Patentability dated Feb. 21, 2013 From the International Bureau of WIPO Re. Application No. PCT/IB2011/051843.
International Preliminary Report on Patentability dated Jan. 21, 2010 From the International Bureau of WIPO Re.: Application No. PCT/IL2007/001590.
International Preliminary Report on Patentability dated Jan. 22, 2009 From the International Bureau of WIPO Re.: Application No. PCT/IL2006/000947.
International Preliminary Report on Patentability dated Mar. 29, 2007 From the International Bureau of WIPO Re.: Application No. PCT/IL2005/000627.
International Preliminary Report on Patentability dated Jan. 30, 2007 From the International Bureau of WIPO Re.: Application No. PCT/IL05/00627.
International Search Report and the Written Opinion dated Jun. 2, 2010 From the International Searching Authority Re. Application No. PCT/IB09/53633.
International Search Report and the Written Opinion dated Jun. 2, 2010 From the International Searching Authority Re.: Application No. PCT/IB09/54774.
International Search Report and the Written Opinion dated Aug. 6, 2012 From the International Searching Authority Re. Application No. PCT/IB2011/053697.
International Search Report and the Written Opinion dated Dec. 6, 2011 From the International Searching Authority Re. Application No. PCT/IB2011/051843.
International Search Report and the Written Opinion dated Sep. 6, 2012 From the International Searching Authority Re. Application No. PCT/IB2011/055854.
International Search Report and the Written Opinion dated Jan. 7, 2013 From the International Searching Authority Re. Application No. PCT/IL2012/050154.
International Search Report and the Written Opinion dated Sep. 7, 2010 From the International Searching Authority Re. Application No. PCT/IB10/50871.
International Search Report and the Written Opinion dated Mar. 16, 2012 From the International Searching Authority Re. Application No. PCT/IB2010/052545.
International Search Report and the Written Opinion dated Feb. 17, 2010 From the International Searching Authority Re.: Application No. PCT/IL09/00508.

International Search Report and the Written Opinion dated Aug. 22, 2011 From the International Searching Authority Re. Application No. PCT/IB2010/056023.
International Search Report and the Written Opinion dated Nov. 24, 2008 From the International Searching Authority Re.: Application No. PCT/IL08/00489.
International Search Report and the Written Opinion dated Jul. 29, 2008 From the International Searching Authority Re.: Application No. PCT/IL06/001223.
International Search Report and the Written Opinion dated Oct. 30, 2009 From the International Searching Authority Re.: Application No. PCT/IL2008/001657.
International Search Report and the Written Opinion dated Oct. 31, 2011 From the International Searching Authority Re.: Application No. PCT/IL08/00489.
International Search Report dated Jul. 2, 2009 From the International Searching Authority Re.: Application No. PCT/IL07/01590.
International Search Report dated Jan. 3, 2007 From the International Searching Authority Re.: Application No. PCT/IL2005/000627.
International Search Report dated Mar. 4, 2009 From the International Searching Authority Re.: Application No. PCT/IL08/01024.
International Search Report dated Nov. 4, 2005 From the International Searching Authority Re.: Application No. PCT/IL04/00431.
International Search Report dated Aug. 27, 2008 From the International Searching Authority Re.: Application No. PCT/IL06/00947.
Invitation to Pay Additional Fees dated Mar. 2, 2010 From the International Searching Authority Re.: Application No. PCT/IB09/53633.
Invitation to Pay Additional Fees dated May 8, 2012 From the International Searching Authority Re. Application No. PCT/IB2011/053697.
Invitation to Pay Additional Fees dated Sep. 8, 2006 From the International Searching Authority Re.: Application No. PCT/IL05/00627.
Invitation to Pay Additional Fees dated Jun. 9, 2011 From the International Searching Authority Re. Application No. PCT/IB2010/056023.
Invitation to Pay Additional Fees dated Jun. 15, 2012 From the International Searching Authority Re. Application No. PCT/IB2011/055854.
Invitation to Pay Additional Fees dated Oct. 17, 2012 From the International Searching Authority Re. Application No. PCT/IL2012/050154.
Invitation to Pay Additional Fees dated Aug. 18, 2011 From the International Searching Authority Re.: Application No. PCT/IL08/00489.
Invitation to Pay Additional Fees dated Nov. 19, 2009 From the International Searching Authority Re.: Application No. PCT/IL09/00508.
Invitation to Pay Additional Fees dated Aug. 23, 2005 From the International Search Authority Re. Application No. PCT/IL2004/000431.
Invitation to Pay Additional Fees dated Dec. 27, 2011 From the International Searching Authority Re. Application No. PCT/IB2010/052545.
Invitation to Pay Additional Fees dated Dec. 31, 2012 From the International Searching Authority Re. Application No. PCT/IL2012/050327.
Notice of Allowance dated Dec. 5, 2011 From the US Patent and Trademark Office Re. U.S. Appl. No. 12/448,359.
Notice of Allowance dated Jan. 7, 2013 From the US Patent and Trademark Office Re. U.S. Appl. No. 12/457,199.
Notice of Allowance dated Aug. 11, 2010 From the Instituto Mexicano de la Propriedad Industrial Re. Application No. PA/a/2005/012565.
Notice of Allowance dated Apr. 16, 2010 From the US Patent and Trademark Office Re.: U.S. Appl. No. 11/629,411.
Notice of Allowance dated Oct. 18, 2010 From the US Patent and Trademark Office Re.: U.S. Appl. No. 11/990,386.
Notice of Allowance dated Nov. 19, 2012 From the US Patent and Trademark Office Re. U.S. Appl. No. 13/450,547.

(56) References Cited

OTHER PUBLICATIONS

Notice of Grant dated Jan. 14, 2011 From the Instituto Mexican de la Propriedad Industrial Re. Application No. MX/a/2008/005280.
Office Action dated Jan. 2, 2012 From the Israel Patent Office Re. Application No. 206118 and its Translation Into English.
Office Action dated Feb. 3, 2011 From the Israel Patent Office Re.: Application No. 172135 and its Translation Into English.
Office Action dated Aug. 4, 2010 From the Israel Patent Office Re.: Application No. 172135 and its Translation Into English.
Office Action dated Jan. 9, 2009 From the State Intellectual Property Office of the People's Republic of China Re.: Application No. 200480020597.0.
Office Action dated Nov. 11, 2010 From the Israel Patent Office Re. Application No. 206118 and its Translation Into English.
Office Action dated May 13, 2010 From the Israel Patent Office Re. Application No. 180022 and its Translation Into English.
Office Action dated Jun. 17, 2010 From the Israel Patent Office Re. Application No. 190918 and its Translation Into English.
Office Action dated Oct. 18, 2010 From the Israel Patent Office Re. Application No. 180022 and its Translation Into English.
Office Action dated Jun. 19, 2011 From the Israel Patent Office Re. Application No. 199391 and its Translation Into English.
Office Action dated Jun. 20, 2011 From the Israel Patent Office Re. Application No. 190918 and its Translation Into English.
Office Action dated Jan. 22, 2010 From the State Intellectual Property Office of the People's Republic of China Re.: Application No. 200580027481.4 and its Translation Into English.
Office Action dated Sep. 22, 2011 From the Israeli Patent Office Re. Application No. 201242 and its Translation Into English.
Office Action dated Jun. 25, 2012 From the State Intellectual Property Office of the People's Republic of China Re.: Application No. 200880109464.9 and its Translation Into English.
Office Action dated Apr. 27, 2009 From the Israeli Patent Office Re.: Application No. 172135 and its Translation Into English.
Office Action dated Jan. 31, 2010 From the Israel Patent Office Re.: Application No. 172135 and its Translation Into English.
Office Letter dated Jul. 7, 2008 From the Government of India, Patent Office Re.: Application No. 3482/CHENP/2005.
Official Action dated May 1, 2009 From the US Patent and Trademark Office Re.: U.S. Appl. No. 11/629,411.
Official Action dated Sep. 2, 2009 From the US Patent and Trademark Office Re.: U.S. Appl. No. 11/629,411.
Official Action dated Feb. 8, 2013 From the US Patent and Trademark Office Re. U.S. Appl. No. 12/594,853.
Official Action dated Jul. 8, 2011 From the US Patent and Trademark Office Re. U.S. Appl. No. 12/083,978.
Official Action dated Jun. 8, 2010 From the US Patent and Trademark Office Re.: U.S. Appl. No. 11/629,411.
Official Action dated Apr. 10, 2012 From the US Patent and Trademark Office Re. U.S. Appl. No. 12/669,975.
Official Action dated May 10, 2011 From the US Patent and Trademark Office Re. U.S. Appl. No. 12/457,199.
Official Action dated Jun. 13, 2012 From the US Patent and Trademark Office Re. U.S. Appl. No. 12/594,853.
Official Action dated May 14, 2012 From the US Patent and Trademark Office Re. U.S. Appl. No. 12/457,199.
Official Action dated Feb. 15, 2011 From the US Patent and Trademark Office Re. U.S. Appl. No. 12/448,359.
Official Action dated May 15, 2009 From the US Patent and Trademark Office Re.: U.S. Appl. No. 11/990,386.
Official Action dated Jul. 17, 2012 From the US Patent and Trademark Office Re. U.S. Appl. No. 12/834,106.
Official Action dated Aug. 18, 2010 From the US Patent and Trademark Office Re. U.S. Appl. No. 12/083,978.
Official Action dated Dec. 18, 2012 From the US Patent and Trademark Office Re. U.S. Appl. No. 12/834,106.
Official Action dated Jan. 18, 2013 From the US Patent and Trademark Office Re. U.S. Appl. No. 12/669,975.
Official Action dated Oct. 18, 2007 From the US Patent and Trademark Office Re.: U.S. Appl. No. 11/284,236.
Official Action dated Jun. 19, 2012 From the US Patent and Trademark Office Re. U.S. Appl. No. 13/450,547.
Official Action dated Sep. 19, 2011 From the US Patent and Trademark Office Re. U.S. Appl. No. 12/810,855.
Official Action dated Dec. 21, 2011 From the US Patent and Trademark Office Re. U.S. Appl. No. 12/810,855.
Official Action dated Aug. 22, 2011 From the US Patent and Trademark Office Re. U.S. Appl. No. 12/457,199.
Official Action dated Oct. 22, 2009 From the US Patent and Trademark Office Re.: U.S. Appl. No. 11/990,386.
Official Action dated Nov. 23, 2010 From the US Patent and Trademark Office Re. U.S. Appl. No. 12/083,978.
Official Action dated Jul. 28, 2008 From the US Patent and Trademark Office Re.: U.S. Appl. No. 11/284,236.
Official Action dated Apr. 29, 2011 From the US Patent and Trademark Office Re. U.S. Appl. No. 12/448,359.
Partial European Search Report dated Jul. 12, 2011 From the European Patent Office Re. Application No. 10194223.3.
Partial European Search Report dated Apr. 19, 2010 From the European Patent Office Re.: Application No. 09163033.5.
Patent Examination Report dated Jan. 4, 2013 From the Australian Government, IP Australia Re. Application No. 2008344935.
Patent Examination Report dated Dec. 12, 2012 From the Australian Government, IP Australia Re. Application No. 2008236316.
Requisition by the Examiner dated Feb. 2, 2012 From the Canadian Intellectual Property Office Re. Application No. 2,570,195.
Requisition by the Examiner dated Oct. 3, 2012 From the Canadian Intellectual Property Office Re. Application No. 2,526,440.
Requisition by the Examiner dated Feb. 12, 2013 From the Canadian Intellectual Property Office Re. Application No. 2,570,195.
Requisition by the Examiner dated Jun. 15, 2011 From the Canadian Intellectual Property Office Re. Application No. 2,526,440.
Response dated Jun. 2, 2011 to Office Action dated Feb. 3, 2011 From the Israel Patent Office Re.: Application No. 172135.
Response dated Jul. 3, 2011 to Examination Report dated Apr. 19, 2011 From the Instituto Mexicano de la Propriedad Industrial Re. Application No. MX/a/2008/002262 and its Summary Into English.
Response dated Oct. 3, 2011 to Examiner's Report dated Jun. 24, 2011 From the Australian Government, IP Australia Re. Application No. 2006281018.
Response dated Jan. 4, 2010 to Official Action dated Sep. 2, 2009 From the US Patent and Trademark Office Re.: U.S. Appl. No. 11/629,411.
Response dated Oct. 4, 2011 to Official Action dated Jul. 8, 2011 From the US Patent and Trademark Office Re. U.S. Appl. No. 12/083,978.
Response dated Dec. 5, 2010 to Office Action dated Aug. 4, 2010 From the Israel Patent Office Re.: Application No. 172135.
Response dated Jul. 6, 2011 to Examiner's Report dated Dec. 20, 2010 From the Australian Government, IP Australia Re. Application No. 2005234725.
Response dated Jun. 6, 2011 to Official Action dated May 10, 2011 From the US Patent and Trademark Office Re. U.S. Appl. No. 12/457,199.
Response dated Jan. 7, 2010 to Communication Pursuant to Article 94(3) EPC of Sep. 9, 2009 From the European Patent Office Re.: Application No. 04734072.4.
Response dated Mar. 8, 2011 to Examiner's Report dated Jan. 13, 2011 From the Australian Government, IP Australia Re.: Application No. 2005252469.
Response dated Feb. 9, 2011 to Communication Pursuant to Article 94(3) EPC dated Nov. 19, 2010 From the European Patent Office Re.: Application No. 06809784.9.
Response dated Jun. 9, 2011 to Examiner's Report dated Dec. 20, 2011 From the Australian Government, IP Australia Re. Application No. 2005234725.
Response dated Mar. 9, 2011 to Office Action dated Nov. 11, 2010 From the Israel Patent Office Re. Application No. 206118.
Response dated Jan. 10, 2012 to European Search Report and the European Search Opinion dated Jun. 14, 2011 From the European Patent Office Re. Application No. 11154193.4.

(56) References Cited

OTHER PUBLICATIONS

Response dated Aug. 11, 2011 to Examination Report dated Aug. 1, 2011 From the Government of India, Patent Office Re.: Application No. 158/CHENP/2007.
Response dated Dec. 12, 2010 to Examiner's Report dated Dec. 17, 2009 From the Australian Government, IP Australia Re.: Application No. 2005252469.
Response dated Oct. 12, 2010 to Communication Pursuant to Article 94(3) EPC dated May 12, 2010 From the European Patent Office Re.: Application No. 06766224.7.
Response dated Sep. 13, 2010 to Office Action dated May 13, 2010 From the Israel Patent Office Re. Application No. 180022.
Response dated Dec. 14, 2010 to Examination Report dated Sep. 22, 2010 From the Instituto Mexicano de la Propriedad Industrial Re. Application No. MX/a/2008/005280.
Response dated Feb. 14, 2011 to Supplementary European Search Report and the European Search Opinion dated Jul. 29, 2010 From the European Patent Office Re. Application No. 08776651.5.
Response dated Mar. 14, 2011 to Official Action dated Feb. 15, 2011 From the US Patent and Trademark Office Re. U.S. Appl. No. 12/448,359.
Response dated Oct. 14, 2010 to Office Action dated Jun. 17, 2010 From the Israel Patent Office Re. Application No. 190918.
Response dated Sep. 14, 2010 to Official Action dated Aug. 18, 2010 From the US Patent and Trademark Office Re. U.S. Appl. No. 12/083,978.
Response dated Dec. 15, 2011 to Examiner's Report dated Aug. 1, 2011 From the Australian Government, IP Australia Re. Application No. 2005234725.
Response dated Jun. 15, 2011 to Examiner's Report dated Mar. 31, 2011 From the Australian Government, IP Australia Re.: Application No. 2005252469.
Response dated Jun. 17, 2011 to Examiner's Report dated Mar. 31, 2011 From the Australian Government, IP Australia Re.: Application No. 2005252469.
Response dated May 17, 2010 to Office Action dated Jan. 22, 2010 From the State Intellectual Property Office of the People's Republic of China Re.: Application No. 200580027481.4.
Response dated Oct. 17, 2011 to Requisition by the Examiner dated Jun. 15, 2011 From the Canadian Intellectual Property Office Re. Application No. 2,526,440.
Response dated Oct. 18, 2011 to Official Action dated Sep. 19, 2011 From the US Patent and Trademark Office Re. U.S. Appl. No. 12/810,855.
Response dated Dec. 19, 2011 to Examiner's Report dated Oct. 19, 2011 From the Australian Government, IP Australia Re. Application No. 2006281018.
Response dated Jan. 19, 2011 to Supplementary European Search Report and the European Search Opinion dated Jul. 1, 2010 From the European Patent Office Re. Application No. 07849616.3.
Response dated Oct. 19, 2011 to Official Action dated Apr. 29, 2011 From the US Patent and Trademark Office Re. U.S. Appl. No. 12/448,359.
Response dated Jul. 20, 2011 to Examination Report dated May 25, 2011 From the Government of India, Patent Office Re.: Application No. 158/CHENP/2007.
Response dated Apr. 21, 2011 to Communication Pursuant to Article 94(3) EPC dated Nov. 8, 2010 From the European Patent Office Re.: Application No. 04734072.4.
Response dated Sep. 21, 2010 to Notice of Allowance dated Apr. 16, 2010 From the US Patent and Trademark Office Re.: U.S. Appl. No. 11/629,411.
Response dated Dec. 22, 2011 to Official Action dated Aug. 22, 2011 From the US Patent and Trademark Office Re. U.S. Appl. No. 12/457,199.
Response dated Feb. 22, 2010 to Official Action dated Oct. 22, 2009 From the US Patent and Trademark Office Re.: U.S. Appl. No. 11/990,386.
Response dated Feb. 23, 2011 to Communication Pursuant to Rule 70(2) EPC and Reference to Rule 39(1) EPC dated Sep. 13, 2010 From the European Patent Office Re.: Application No. 09163033.5.
Response dated Mar. 23, 2011 to Official Action dated Nov. 23, 2010 From the US Patent and Trademark Office Re. U.S. Appl. No. 12/083,978.
Response dated Feb. 24, 2011 to Communciation Pursuant to Rules 70(2) and 70a(2) EPC dated Aug. 30, 2010 From the European Patent Office Re. Application No. 08738191.9.
Response dated Mar. 24, 2011 to Examination Report dated Nov. 3, 2010 From the Government of India, Patent Office Re.: Application No. 158/CHENP/2007.
Response dated Oct. 24, 2010 to Office Action dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Response dated Jul. 25, 2011 to Examiner's Report dated Jul. 21, 2011 From the Australian Government, IP Australia Re. Application No. 2005234725.
Response dated Sep. 25, 2011 to Examiner's Report dated Jun. 30, 2011 From the Australian Government, IP Australia Re. Application No. 2006307457.
Response dated Oct. 27, 2011 to Communication Pursuant to Article 94(3) EPC dated Jun. 29, 2011 From the European Patent Office Re. Application No. 08738191.9.
Response dated Oct. 27, 2011 to Office Action dated Jul. 1, 2011 From the State Intellectual Property Office of the People's Republic of China Re. Application No. 200880017707.6.
Response dated Oct. 27, 2011 to Supplementary European Search Report and the European Search Opinion of May 6, 2011 From the European Patent Office Re. Application No. 09750276.9.
Response dated Jun. 29, 2010 to Examination Report dated Feb. 17, 2010 From the Instituto Mexicano de la Propriedad Industrial Re. Application No. PA/a/2005/012565.
Response dated Jun. 29, 2011 to Communication Pursuant to Article 94(3) EPC dated Mar. 8, 2011 From the European Patent Office Re.: Application No. 06809784.9.
Response dated May 31, 2010 to Office Action dated Jan. 31, 2010 From the Israel Patent Office Re.: Application No. 172135.
Response dated Oct. 31, 2011 to Notification of the First Office Action dated Jun. 30, 2011 From the State Intellectual Property Office of the People's Republic of China Re. Application No. 200680047610.0.
Restriction Official Action dated Feb. 1, 2012 From the US Patent and Trademark Office Re. U.S. Appl. No. 12/669,975.
Restriction Official Action dated Mar. 1, 2013 From the US Patent and Trademark Office Re. U.S. Appl. No. 13/254,183.
Restriction Official Action dated Apr. 11, 2012 From the US Patent and Trademark Office Re. U.S. Appl. No. 12/834,106.
Restriction Official Action dated Feb. 13, 2012 From the US Patent and Trademark Office Re. U.S. Appl. No. 12/594,853.
Restriction Official Action dated Nov. 13, 2012 From the US Patent and Trademark Office Re. U.S. Appl. No. 12/992,902.
Summary of Office Action dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion dated Feb. 1, 2010 From the European Patent Office Re.: Application No. 06766224.7.
Supplementary European Search Report and the European Search Opinion dated Jul. 1, 2010 From the European Patent Office Re. Application No. 07849616.3.
Supplementary European Search Report and the European Search Opinion dated Jan. 2, 2012 From the European Patent Office Re. Application No. 09807983.3.
Supplementary European Search Report and the European Search Opinion dated Jul. 6, 2012 From the European Patent Office Re. Application No. 10748403.2.
Supplementary European Search Report and the European Search Opinion dated May 6, 2011 From the European Patent Office Re. Application No. 09750276.9.

(56) References Cited

OTHER PUBLICATIONS

Supplementary European Search Report and the European Search Opinion dated Aug. 11, 2010 From the European Patent Office Re. Application No. 08738191.9.
Supplementary European Search Report and the European Search Opinion dated Feb. 14, 2013 From the European Patent Office Re. Application No. 10785834.2.
Supplementary European Search Report and the European Search Opinion dated Sep. 14, 2009 From the European Patent Office Re.: Application No. 06809784.9.
Supplementary European Search Report and the European Search Opinion dated Apr. 18, 2012 From the European Patent Office Re. Application No. 09823171.5.
Supplementary European Search Report and the European Search Opinion dated Jul. 29, 2010 From the European Patent Office Re. Application No. 08776651.5.
Supplementary European Search Report dated Apr. 23, 2008 From the European Patent Office Re.: Application No. 05750089.4.
Supplementary European Search Report dated Oct. 31, 2007 From the European Patent Office Re.: Application No. 04734072.4.
Supplementary Partial European Search Report dated Aug. 30, 2007 From the European Patent Office Re.: Application No. 04734072.4.
Translation of Decision of Rejection dated Dec. 9, 2011 From the State Intellectual Property Office of the People's Republic of China Re.: Application No. 200580027481.4.
Translation of Examination Report dated Sep. 6, 2010 From the Government of the People's Republic of Bangladesh, Department of Patents, Designs and Trademarks, Ministry of Industries Re. Application No. 275/2009.
Translation of Notice of Paying Restoration Fee for Unity of Invention dated Oct. 29, 2012 From the State Intellectual Property Office of the People's Republic of China Re. Application No. 200880127757.X.
Translation of Notice of Payment of the Restoration Fee for Unity of Invention dated Mar. 20, 2009 From the State Intellectual Property Office of the People's Republic of China Re.: Application No. 200580027481.4.
Translation of Notice to Amendment dated Aug. 31, 2012 From the Thai Patent Office, Department of Intellectual Property Office Re. Application No. 0901000235.
Translation of Notification of the Office Action dated Dec. 1, 2011 From the State Intellectual Property Office of the People's Republic of China Re. Application No. 200680047610.0.
Translation of Notification of the Office Action dated Jun. 30, 2011 From the State Intellectual Property Office of the People's Republic of China Re. Application No. 200680047610.0.
Translation of Office Action dated Jul. 1, 2011 From the State Intellectual Property Office of the People's Republic of China Re. Application No. 200880017707.6.
Translation of Office Action dated Jan. 4, 2012 From the State Intellectual Property Office of the People's Republic of China Re. Application No. 200880109464.9.
Translation of Office Action dated Apr. 9, 2012 From the State Intellectual Property Office of the People's Republic of China Re. Application No. 200880017707.6.
Translation of Office Action dated Sep. 13, 2012 From the State Intellectual Property Office of the People's Republic of China Re. Application No. 200910217137.1.
Translation of Office Action dated Jan. 17, 2012 From the State Intellectual Property Office of the People's Republic of China Re. Application No. 201110104274.1.
Translation of Office Action dated Jan. 17, 2013 From the State Intellectual Property Office of the People's Republic of China Re. Application No. 201110104274.1.
Translation of Office Action dated Oct. 19, 2010 From the State Intellectual Property Office of the People's Republic of China Re. Application No. 200680038391.X.
Translation of Office Action dated Jun. 22, 2011 From the State Intellectual Property Office of the People's Republic of China Re. Application No. 200880127685.9.
Translation of Office Action dated Feb. 25, 2013 From the State Intellectual Property Office of the People's Republic of China Re. Application No. 200910217137.1.
Translation of Office Action dated Dec. 31, 2011 From the State Intellectual Property Office of the People's Republic of China Re. Application No. 200910217137.1.
Translation of Search Report dated Jan. 17, 2013 From the State Intellectual Property Office of the People's Republic of China Re. Application No. 201110104274.1.
Translation of the Office Action dated Jan. 9, 2009 From the State Intellectual Property Office Re.: Application No. 2004800200597.0.
Written Opinion dated Jul. 2, 2009 From the International Searching Authority Re.: Application No. PCT/IL07/01590.
Written Opinion dated Jan. 3, 2007 From the International Searching Authority Re.: Application No. PCT/IL2005/000627.
Written Opinion dated Mar. 4, 2009 From the International Searching Authority Re.: Application No. PCT/IL08/01024.
Written Opinion dated Nov. 4, 2005 From the International Searching Authority Re.: Application No. PCT/II04/00431.
Written Opinion dated Aug. 27, 2008 From the International Searching Authority Re.: Application No. PCT/IL06/00947.
Adachi et al. "*Oryza sativa* Japonica Group cDNA Clone:1023021L.06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Alcala et al. "EST543159 Tomato *Callus solanum* Lycopersicum cDNA Clone cLEC80A19 5-end, mRNA Sequence", GenBank: BI923254.1, GenBank Accession No. BI923254, Oct. 17, 2001.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Apse et al. "Engineering Salt Tolerance in Plants", Current Opinion in Biotechnology, XP003018468, 13(2): 146-150, Apr. 1, 2002.
Backhaus et al. "Nucleotide Sequence of A cDNA for A P2 60S Acidic Ribosomal Protein From Parthenium Argentatum", Plant Physiology, 106: 395, 1994.
Bautista et al. "*Arabidopsis thaliana* At5g06690 mRNA, Complete Cds", Unpublished, The Salk Institute for Biological Studies, La Jolla, CA, USA, GenBank: BT029447, Nov. 15, 2006.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Blast "BLAST Results", 1 P.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.

(56) References Cited

OTHER PUBLICATIONS

Blewitt et al. "Gossypium Hirsutum Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM_PL: BT022032.1, Database Accession No. BT022032, May 4, 2005.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Daniell et al. "Solanum Bulbocastanum Chloroplast, Complete Genome", GenBank NCBI, Accession No. NC_007943, Mar. 26, 2010. p. 1, Source, p. 10-11, Nucleotides 46590-47195, Gene 'RPS4'.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Del Pozo et al. "F-Box Proteins and Protein Degradation: An Emerging Theme in Cellular Regulation", Plant Molecular Biology, 44(2): 123-128, Sep. 2000.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Gowik et al. "cis-Regulatory Elements for Mesophyll-Specific Gene Expression in the C4 Plant Flaveria Trinervia, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.

Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.
Harwood "Plant Fatty Acid Synthesis", The AOCS Lipid Library, 11 P., Apr. 12, 2010.
Hattori et al. "An Acetohydroxy Acid Synthase Mutant Reveals a Single Site Involved in Multiple Herbicide Resistance", Molecular and General Genetics, 246: 419-425, 1995. Abstract!
Hill et al. "Functional Analysis of Conserved Histidines in ADP-Glucose Pyrophosphorylase From *Escherichia coli*", Biochemical and Biophysical Research Communications, 244(2): 573-577, 1998.
Holmstroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ishikawa et al. JP 2005-185101: Full Length cDNA of Plant and the Use Thereof, Database EMBL [Online], XP002678022, Retrieved From EBI Accession No. EM_PAT:HV067703, Database Accession No. HV067703, Jul. 15, 2011. Sequence.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Kano-Murakami et al. "A Rice Homeotic Gene, OSH1, Causes Unusual Phenotypes in Transgenic Tobacco", FEBS Letters, 334(3): 365-368, Nov. 1993.
Katavic et al. "Utility of the *Arabidopsis* FAE1 and Yeast SLC1-1 Genes for Improvement in Erucic Acid and Oil Content in Rapeseed", Biochemical Society Transactions, 28(6): 935-937, Dec. 2000.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Keskin et al. "A New, Structurally Nonredundant, Diverse Data Set of Protein-Protein Interfaces and Its Implications", Protein Science, 13: 1043-1055, 2004.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.

(56) References Cited

OTHER PUBLICATIONS

Kirubakaran et al. "Characterization of a New Antifungal Lipid Transfer Protein From Wheat", Plant Physiology and Biochemistry, 46: 918-927, 2008.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99,6% Identity to Present SEQ ID No. 7 Over 488 Nucleotides. Abstract, Sequence.
La Rosa et al. "*Oryza sativa* Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "*Arabidopsis thaliana* Chromosome III BAC F7O18 Genomic Sequence, Complete Sequence", GenBank Accession No. AC011437, Oct. 30, 2002.
Liu et al. "Root-Specific Expression of a Western White Pine PR10 Gene Is Mediated by Different Promoter Regions in Transgenic Tobacco", Plant Molecular Biology, 52: 103-120, 2003.
Matsumoto et al. "*Hordeum vulgare* Subsp. *vulgare*, Full-Length cDNA", UniProtKB/TrEMBL, ID: F2DLE8-HORVD, UniProt Accession No. F2DLE8, May 31, 2011.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig. 1.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig. 1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Payne et al. "GL3 Encodes a bHLH Protein That Regulates Trichome Development in *Arabidopsis* Through Interaction With GL1 and TTG1", Genetics, 156: 1349-1362, Nov. 2000.
Payne et al. "Heterologous MYB Genes Distinct From GL1 Enhance Trichome Production When Overexpressed in Nicotiana Tabacum", Development, 126: 671-682, 1999.
Pilon-Smits et al. "Improved Performance of Transgenic Fructan-Accumulating Tobacco under Drought Stress", Plant Physiology, 107: 125-130, 1995.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaCl Tolerance in *Arabidopsis*", Plant Physiology, 130: 951-963, 2002. Abstract!
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Saez-Vasquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Smart et al. "MIP Genes are Down-Regulated Under Drought Stress in Nicotiana Glauca", Plant and Cell Physiology, XP002455682, 42(7): 686-693, 2001. p. 686, Reference to Database Entry AF290618, p. 692, 1-h col., § 2.
Smart et al. "Nicotiana Glauca Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Sunkar et al. "Small RNAs as Big Players in Plant Abiotic Stress Responses and Nutrient Deprivation", Trends in Plant Science, XP022148764, 12(7): 301-309, Jul. 1, 2007.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig. S6, p. 1844-1845.
Taliercio et al. "GH_TMIRS_129_G10_F Cooton Normalized Library dT Primed Gossypium Hirsutum cDNA, mRNA Sequence", EMBL-Bank, XP002659970, Retrieved From EBI Accession No. EM_EST:DW508992, Database Accession No. DW508992.
Taliercio et al. "GH_TMIRS_129_G10_R Cotton Normalized Library dT Primed Gossypium Hirsutum cDNA, mRNA Sequence", EMBL-Bank, XP002659971, Retrieved From EBI Accession No. EM_EST:DW508993, Database Accession No. DW508993.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Tarczynski et al. "Stress Protection of Transgenic Tobacco by Production of the Osmolyte Mannitol", Science, 259: 508-510, 1993. Abstract!
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 1999. Abstract.
Van der Hoeven et al. "EST312975 Tomato Root During/After Fruit Set, Cornell University Solanum Lycopersicum cDNA Clone cLEX14O20 5-, mRNA Sequence", GenBank, GenBank Accession No. AW622177.1.
Van der Hoeven et al. "EST428934 Tomato Nutrient Deficient Roots Lycopersicon Esculentum cDNA Clone cLEW26B2 5' Sequence,

(56) References Cited

OTHER PUBLICATIONS mRNA Sequence", Database EMBL, Retrieved From EBI Accession No. EMBL, Database Accession No. BF098413, 2000.
Van Haaren et al. "A Functional Map of the Fruit-Specific Promoter of the Tomato 2A11 Gene", Plant Molecular Biology, 21: 625-640, 1993. Abstract!
Vigeolas et al. "Increasing Seed Oil Content in Oil-Seed Rape (Brassica napus L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004.
Wang et al. "Control of Plant Trichome Development by a Cotton Fiber MYB Gene", The Plant Cell, 16: 2323-2334, Sep. 2004. GenEmbl Database, Accession No. AY641990.
Wang et al. "The Soybean Dof-Type Transcription Factor Genes, GmDof4 and GmDof11, Enhance Lipid Content in the Seeds of Transgenic Arabidopsis Plants", The Plant Journal, 52: 716-729, 2007. Abstract!
Wells "Additivity of Mutational Effects in Proteins", Biochemistry, 29 (37): 8509-8517, 1990.
Whisstock et al. "Prediction of Protein Function from Protein Sequence and Structure," Quarterly Reviews of Biophysics 36 (3): 307-340, Aug. 2003.
Wing et al. "An Integrated Analysis of the Genetics, Devlopment, and Evolution of Cotton Fiber", NBCI GenBank Accession No. BE052336, 2000.
Wing et al. "GA_Eb0023E09f Gossypium Arboreum 7-10 Dpa Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.
Wing et al. "GA_Eb0026P18f Gossypium Arboreum 7-10 Dpa Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yamada et al. "Arabidopsis thaliana Clone RAFL14-87-A16 (R20399) Unknown Protein (At1g60770) mRNA Complete Cds", GenBank Accession No. BT002876, Retrieved From the Internet, Jan. 21, 2010.
Yamada et al. "Arabidopsis thaliana Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Yanagisawa et al. "Diversity and Similarity Among Recognition Sequences of Dof Transcription Factors", The Plant Journal, 17(2): 209-214, 1999.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Zabrouskov et al. "Oxidative Metabolism and the Physiological Age of Seed Potatoes are Affected by Increased Alpha-Linolenate Content", Physiologia Plantarum, 116: 172-185, 2002.
Restriction Official Action dated Apr. 4, 2013 From the US Patent and Trademark Office Re. U.S. Appl. No. 13/125,047.

Notice of Allowance dated Apr. 8, 2013 From the US Patent and Trademark Office Re. U.S. Appl. No. 12/594,853.
Requisition by the Examiner dated Mar. 25, 2013 From the Canadian Intellectual Property Office Re. Application No. 2,619,114.
Examination Report dated Mar. 23, 2013 From the Government of India, Patent Office, Intellectual Property Building Re. Application No. 2570/CHENP/2008.
Office Action dated Apr. 1, 2013 From the State Intellectual Property Office of the People's Republic of China Re. Application No. 200880127757.X and Its Translation Into English.
Communication Pursuant to Article 94(3) EPC dated May 8, 2013 From the European Patent Office Re. Application No. 08776651.5.
International Search Report and the Written Opinion dated May 12, 2013 From the International Searching Authority Re. Application No. PCT/IL2013/050172.
Official Action dated May 8, 2013 From the US Patent and Trademark Office Re. U.S. Appl. No. 13/125,047.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [Medicago Truncatula]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in Arabidopsis", The Plant Cell, 24: 4555-4576, Nov. 2012.
Official Action dated May 20, 2013 From the US Patent and Trademark Office Re. U.S. Appl. No. 13/059,231.
Patent Examination Report dated May 31, 2013 From the Australian Government, IP Australia Re. Application No. 2008278654.
Hirner et al. "Arabidopsis LHT1 Is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From Arabidopsis", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Examination Report dated Mar. 13, 2013 From the Instituto Mexican de la Propiedad Industrial Re. Application No. PA/a/2005/009380 and Its Summary in English.
Requisition—Sequence Listing Dated May 8, 2013 From the Canadian Intellectual Property Office Re. Application No. 2,753,616.
International Preliminary Report on Patentability dated Jul. 4, 2013 From the International Bureau of WIPO Re. Application No. PCT/IB2011/055854.
Notice of Allowance dated Nov. 15, 2013 From the US Patent and Trademark Office Re. U.S. Appl. No. 12/669,975.
Communication Pursuant to Article 94(3) EPC dated Aug. 2, 2013 From the European Patent Office Re. Application No. 10194223.3.
Examination Report dated Jul. 9, 2013 From the Instituto Mexicano de la Propiedad Industrial Re. Application No. MX/a/2010/007169 and Its Translation Into English.
Examination Report dated Jun. 26, 2013 From the Instituto Mexicano de la Propiedad Industrial Re. Application No. MX/a/2010/000975 and Its Translation Into English.
Official Action dated Aug. 12, 2013 From the US Patent and Trademark Office Re. U.S. Appl. No. 12/834,106.
Substantive Examination Report dated Jul. 31, 2013 From the Intellectual Property Office of the Philippines, Bureau of Patents Re. Application No. 1/2009/501930.

(56) References Cited

OTHER PUBLICATIONS

Patent Examination Report dated Jun. 27, 2013 From the Australian Government, IP Australia Re. Application No. 2012216482.
Matz et al. "Gossypium Hirsutum GHDEL65 (ghdel65) mRNA, Complete CDS", GenBank Nucleotide, GenBank Accession No. AF336280, Mar. 15, 2001.
Applicant-Initiated Interview Summary dated Dec. 20, 2013 From the US Patent and Trademark Office Re. U.S. Appl. No. 13/125,047.
Patent Examination Report dated Jan. 21, 2016 From the Australian Government, IP Australia Re. Application No. 2011298034.
Paterson et al. "Sorghum Bicolor Hypthetical Protein, mRNA", Database NCBI [Online], NCBI Reference Sequence: XM_002459295.1, GenBank Accession No. XM_002459295, Jul. 13, 2009.
Examination Report dated Apr. 5, 2017 From the Australian Government, IP Australia Re. Application No. 2016219624. (3 Pages).
Requisition by the Examiner dated Nov. 2, 2017 From the Canadian Intellectual Property Office, Innovation, Science and Economic Development Canada Re. Application No. 2,809,384.
Examination Report dated Oct. 30, 2017 From the Australian Government, IP Australia Re. Application No. 2016219624. (6 Pages).
Examination Report dated Oct. 25, 2017 From the Instituto Mexicano of de la Propiedad Industrial, IMPI, Direccion Divisional de Patentes Re. Application No. MX/a/2013/002441 and Its Translation Into English. (13 Pages).
Liu et al. "Characterization and Complementation of a psbR Mutant in *Arabidopsis thaliana*," Archives of Biochemistry and Biophysics 489: 34-40, Published Online Jul. 28, 2009.
Requisition by the Examiner dated Jul. 13, 2018 From the Canadian Intellectual Property Office, Innovation, Science and Economic Development Canada Re. Application No. 2,809,384. (6 pages).
Examination Report dated Apr. 2, 2018 From the Instituto Mexicano de la Propiedad Industrial, IMPI, Direccion Divisional de Patentes Re. Application No. MX/a/2013/002441. (4 Pages).
Patent Examination Report dated Jun. 11, 2015 From the Australian Government, IP Australia Re. Application No. 2011298034.
Examination Report dated Oct. 17, 2018 From the Instituto Mexicano de la Propiedad Industrial, IMPI, Direccion Divisional de Patentes Re. Application No. MX/a/2013/002441. (4 Pages).

\* cited by examiner

Normal conditions

Osmotic stress (15 % PEG)

Nitrogen limiting conditions

ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE

RELATED APPLICATIONS

This application is a National Phase of PCT Patent Application No. PCT/IB2011/053697 having International filing date of Aug. 23, 2011, which claims the benefit of priority under 35 USC § 119(e) of U.S. Provisional Patent Application Nos. 61/437,715 filed on Jan. 31, 2011, 61/405,260 filed on Oct. 21, 2010 and 61/378,003 filed on Aug. 30, 2010. This PCT Patent Application No. PCT/IB2011/053697 is also a Continuation-In-Part (CIP) of PCT Patent Application No. PCT/IB2011/051843 having International filing date of Apr. 27, 2011. The contents of the above applications are all incorporated by reference as if fully set forth herein in their entirety.

SEQUENCE LISTING STATEMENT

The ASCII file, entitled 55668SequenceListing.txt, created on Jan. 30, 2013, comprising 9,648,108 bytes, submitted concurrently with the filing of this application is incorporated herein by reference.

FIELD AND BACKGROUND OF THE INVENTION

The present invention, in some embodiments thereof, relates to novel polynucleotides and polypeptides which can increase nitrogen use efficiency, fertilizer use efficiency, yield (e.g., seed/grain yield, oil yield), growth rate, vigor, biomass, oil content, fiber yield, fiber quality and/or length, abiotic stress tolerance and/or water use efficiency of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen usually needs to be replenished every year, particularly for cereals, which comprise more than half of the cultivated areas worldwide. For example, inorganic nitrogenous fertilizers such as ammonium nitrate, potassium nitrate, or urea, typically accounts for about 40% of the costs associated with crops such as corn and wheat.

Nitrogen is an essential macronutrient for the plant, responsible for biosynthesis of amino and nucleic acids, prosthetic groups, plant hormones, plant chemical defenses, and the like. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared with control plants.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

WO publication No. 2009/083958 discloses methods of increasing water use efficiency, fertilizer use efficiency, biotic/abiotic stress tolerance, yield and biomass in plant and plants generated thereby.

WO publication No. 2010/020941 discloses methods of increasing nitrogen use efficiency, abiotic stress tolerance, yield and biomass in plants and plants generated thereby.

WO publication No. 2009/141824 discloses isolated polynucleotides and methods using same for increasing plant utility.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO publication No. 2004/081173 discloses novel plant derived regulatory sequences and constructs and methods of using such sequences for directing expression of exogenous polynucleotide sequences in plants.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO publication No. 2004/111183 discloses nucleotide sequences for regulating gene expression in plant trichomes and constructs and methods utilizing same.

SUMMARY OF THE INVENTION

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide at least 80% identical to SEQ ID NO: 482, 470-481, 483-784, 2398-3817 or 3818, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide selected from the group consisting of SEQ ID NOs: 482, 470-481, 483-784 and 2398-3818, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence at least 80% identical to SEQ ID NO: 277, 1-276, 278-469, 785-2396 or 2397, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising the nucleic acid sequence selected from the group consisting of SEQ ID NOs: 277, 1-276, 278-469 and 785-2397, thereby increasing the nitrogen use efficiency, yield, biomass, growth rate, vigor, oil content, fiber yield, fiber quality, and/or abiotic stress tolerance of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 482, 470-481, 483-784, 2398-3817 or 3818, wherein the amino acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 482, 470-481, 483-784 and 2398-3818.

According to an aspect of some embodiments of the present invention there is provided an isolated polynucleotide comprising a nucleic acid sequence at least 80% identical to SEQ ID NO: 277, 1-276, 278-469, 785-2396 or 2397, wherein the nucleic acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polynucleotide comprising the nucleic acid sequence selected from the group consisting of SEQ ID NOs: 277, 1-276, 278-469 and 785-2397.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided a method of generating a transgenic plant comprising transforming within the plant the nucleic acid construct of some embodiments of the invention, thereby generating the transgenic plant.

According to an aspect of some embodiments of the present invention there is provided a method of generating a transgenic plant comprising expressing within the plant an exogenous polynucleotide comprising a nucleic acid sequence encoding a polypeptide at least 80% identical to SEQ ID NO: 482, 470-481, 483-784, 2398-3817 or 3818, thereby generating the transgenic plant.

According to an aspect of some embodiments of the present invention there is provided a method of generating a transgenic plant comprising expressing within the plant an exogenous polynucleotide comprising a nucleic acid sequence encoding a polypeptide selected from the group consisting of SEQ ID NOs: 482, 470-481, 483-784, and 2398-3818, thereby generating the transgenic plant.

According to an aspect of some embodiments of the present invention there is provided a method of generating a transgenic plant comprising expressing within the plant an exogenous polynucleotide comprising a nucleic acid sequence at least 80% identical to SEQ ID NO: 277, 1-276, 278-469, 785-2396 or 2397, thereby generating the transgenic plant.

According to an aspect of some embodiments of the present invention there is provided a method of generating a transgenic plant comprising expressing within the plant an exogenous polynucleotide selected from the group consisting of SEQ ID NOs: 277, 1-276, 278-469 and 785-2397, thereby generating the transgenic plant.

According to an aspect of some embodiments of the present invention there is provided an isolated polypeptide comprising an amino acid sequence at least 80% homologous to SEQ ID NO: 482, 470-481, 483-784, 2398-3817 or 3818, wherein the amino acid sequence is capable of increasing nitrogen use efficiency, yield, biomass, growth rate, vigor, oil content, fiber yield, fiber quality, and/or abiotic stress tolerance of a plant.

According to an aspect of some embodiments of the present invention there is provided an isolated polypeptide comprising the amino acid sequence selected from the group consisting of SEQ ID NOs: 482, 470-481, 483-784 and 2398-3818.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention.

According to an aspect of some embodiments of the present invention there is provided a transgenic plant exogenously expressing the polynucleotide of some embodiments of the invention, the nucleic acid construct of some embodiments of the invention and/or the polypeptide of some embodiments of the invention.

According to some embodiments of the invention, the nucleic acid sequence encodes an amino acid sequence selected from the group consisting of SEQ ID NOs: 482, 470-481, 483-784 and 2398-3818.

According to some embodiments of the invention, the nucleic acid sequence is selected from the group consisting of SEQ ID NOs: 277, 1-276, 278-469 and 785-2397.

According to some embodiments of the invention, the polynucleotide consists of the nucleic acid sequence selected from the group consisting of SEQ ID NOs: 277, 1-276, 278-469 and 785-2397.

According to some embodiments of the invention, the nucleic acid sequence encodes the amino acid sequence selected from the group consisting of SEQ ID NOs: 482, 470-481, 483-784 and 2398-3818.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
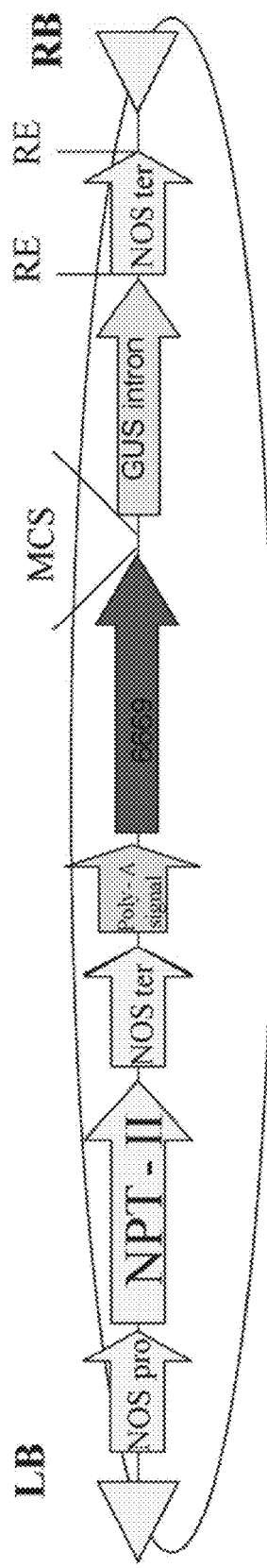
FIG. 1 is a schematic illustration of the modified pGI binary plasmid containing the new At6669 promoter (SEQ ID NO:3829) and the GUSintron (pQYN_6669) used for expressing the isolated polynucleotide sequences of some embodiments of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUSintron reporter gene.

The present invention, in some embodiments thereof, relates to novel polynucleotides and polypeptides, nucleic acid constructs comprising same, host cells expressing same, transgenic plants exogenously expressing same and, more particularly, but not exclusively, to methods of using same for increasing nitrogen use efficiency, fertilizer use efficiency, yield, growth rate, vigor, biomass, oil content, fiber yield, fiber quality, fiber length, abiotic stress tolerance and/or water use efficiency of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase nitrogen use efficiency, fertilizer use efficiency, yield, growth rate, vigor, biomass, oil content, fiber yield, fiber quality, fiber length, abiotic stress tolerance and/or water use efficiency of a plant.

Thus, as shown in the Examples section which follows, the present inventors have utilized bioinformatics tools to identify polynucleotides which enhance fertilizer use efficiency (e.g., nitrogen use efficiency), yield (e.g., seed yield, oil yield, oil content), growth rate, biomass, vigor and/or abiotic stress tolerance of a plant. Genes, which affect the trait-of-interest, were identified based on expression profiles of genes of several *Arabidopsis*, rice, barley, sorghum, maize and tomato ecotypes/accessions and tissues, homology with genes known to affect the trait-of-interest and using digital expression profile in specific tissues and conditions (Tables 1, 6, 12, 18, 26, 33, 38-39, 48, 54, 61, 66-67, Examples 1, and 3-12 of the Examples section which follows). Homologous polypeptides and polynucleotides having the same function were also identified (Table 2, Example 2 of the Examples section which follows). Transgenic plants over-expressing the identified polynucleotides (Table 68, Example 13 of the Examples section which follows) were found to exhibit increased plant performance under nitrogen-deficient or limiting conditions (Tables 69-74; Example 16 of the Examples section which follows) or under standard conditions (Tables 75-80; Example 16 of the Examples section which follows). In addition, greenhouse seed maturation (GH-SM) assays revealed that the identified genes increase nitrogen use efficiency (NUE), yield and growth rate of plants under low or normal nitrogen conditions as determined by the increase in biomass (e.g., dry weight, flowering inflorescence emergence, leaf blade area, leaf number, plot coverage, rosette area and diameter); harvest index; growth rate of leaf number, plot coverage and rosette diameter; and yield (e.g., seed yield, 1000 seed weight) (Tables 81-90; Example 17 of the Examples section which follows). Further greenhouse assays performed until bolting stage revealed that the identified genes increase nitrogen use efficiency at limited and optimal nitrogen concentration as determined by the increase in plant biomass (dry weight, fresh weight, leaf number, plot coverage, rosette area and diameter); and relative growth rate of leaf number, plot coverage and rosette diameter (Tables 91-96; Example 18 of the Examples section which follows). Altogether, these results suggest the use of the novel polynucleotides and polypeptides of the invention for increasing nitrogen use efficiency, yield (e.g., seed yield), growth rate, biomass, vigor and/or abiotic stress tolerance of a plant.

Thus, according to an aspect of some embodiments of the invention, there is provided method of increasing fertilizer (e.g., nitrogen) use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-784 and 2398-3818, thereby increasing the nitrogen use efficiency, yield, biomass, growth rate, vigor, oil content, fiber yield, fiber quality, and/or abiotic stress tolerance of the plant.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field.

Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related.

Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in nitrogen use efficiency, yield, seed yield, biomass, growth rate, vigor, oil content, fiber yield, fiber quality, and/or abiotic stress tolerance of a plant as compared to a native plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-784 and 2398-3818.

Homology (e.g., percent homology, identity+similarity) can be determined using any homology comparison software, including for example, the BlastP™ (protein Basic Local Alignment Search Toot) or TBLASTN™ (translated nucleotide databases using a protein query) software of the National Center of Biotechnology Information (NCBI) such as by using default parameters, when starting from a polypeptide sequence; or the tBLASTX™ (translated nucleotide databases using a translated nucleotide query) algorithm (available via the NCBI) such as by using default parameters, which compares the six-frame conceptual translation products of a nucleotide query sequence (both strands) against a protein sequence database.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal BLAST™ search. This may be done by a first BLAST™ involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The BLAST™ results may be filtered. The full-length sequences of either the filtered results or the non-filtered results are then blasted back (second BLAST™) against the sequences of the organism from which the sequence-of-interest is derived. The results of the first and second BLAST™s are then compared. An orthologue is identified when the sequence resulting in the highest score (best hit) in the first BLAST™ identifies in the second BLAST™ the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:470-784 and 2398-3818.

According to some embodiments of the invention, the method of increasing nitrogen use efficiency, yield, biomass, growth rate, vigor, oil content, fiber yield, fiber quality, and/or abiotic stress tolerance of a plant is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:470-784 and 2398-3818, thereby increasing the nitrogen use efficiency, yield, biomass, growth rate, vigor, oil content, fiber yield, fiber quality, and/or abiotic stress tolerance of the plant.

According to some embodiments of the invention, the exogenous polynucleotide encodes a polypeptide consisting of the amino acid sequence set forth by SEQ ID NO:470-784, 2398-3817 or 3818.

According to an aspect of some embodiments of the invention, the method of increasing nitrogen use efficiency, yield, biomass, growth rate, vigor, oil content, fiber yield, fiber quality, and/or abiotic stress tolerance of a plant is effected by expressing within the plant an exogenous polynucleotide comprising a nucleic acid sequence encoding a polypeptide comprising an amino acid sequence selected from the group consisting of SEQ ID NOs:470-784 and 2398-3818, thereby increasing the nitrogen use efficiency, yield, biomass, growth rate, vigor, oil content, fiber yield, fiber quality, and/or abiotic stress tolerance of the plant.

According to an aspect of some embodiments of the invention, there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence encoding a polypeptide selected from the group consisting of SEQ ID NOs: 470-784 and 2398-3818, thereby increasing the nitrogen use efficiency, yield, biomass, growth rate, vigor, oil content, fiber yield, fiber quality, and/or abiotic stress tolerance of the plant.

According to some embodiments of the invention, the exogenous polynucleotide encodes a polypeptide consisting of the amino acid sequence set forth by SEQ ID NO: 470-784, 2398-3817 or 3818.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-469 and 785-2397.

According to an aspect of some embodiments of the invention, there is provided a method of increasing nitrogen use efficiency, yield, biomass, growth rate, vigor, oil content, fiber yield, fiber quality, and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-469 and 785-2397, thereby increasing the nitrogen use efficiency, yield, biomass, growth rate, vigor, oil content, fiber yield, fiber quality, and/or abiotic stress tolerance of the plant.

According to some embodiments of the invention, the homology is a global homology, i.e., an homology over the entire amino acid or nucleic acid sequences of the invention and not over portions thereof.

According to some embodiments of the invention, the identity is a global identity, i.e., an identity over the entire amino acid or nucleic acid sequences of the invention and not over portions thereof.

Identity (e.g., percent homology) can be determined using any homology comparison software, including for example, the BlastN™ software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-469 and 785-2397.

According to some embodiments of the invention the exogenous polynucleotide is set forth by SEQ ID NO:1-469, 785-2396 or 2397.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase "non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 211-216, 264, 265, 466-469, 797, 927, 933, 939, 944 and 948.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-469 and 785-2397.

According to some embodiments of the invention the nucleic acid sequence is capable of increasing nitrogen use efficiency, fertilizer use efficiency, yield, seed yield, growth rate, vigor, biomass, oil content, fiber yield, fiber quality, abiotic stress tolerance and/or water use efficiency of a plant.

According to some embodiments of the invention the isolated polynucleotide comprising the nucleic acid sequence selected from the group consisting of SEQ ID NOs:1-469 and 785-2397.

According to some embodiments of the invention the isolated polynucleotide is set forth by SEQ ID NO:1-469, 785-2396 or 2397.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 470-784 and 2398-3818.

According to some embodiments of the invention the amino acid sequence is capable of increasing nitrogen use efficiency, fertilizer use efficiency, yield, seed yield, growth rate, vigor, biomass, oil content, fiber yield, fiber quality, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs:470-784 and 2398-3818.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 470-784 and 2398-3818.

According to some embodiments of the invention, the polypeptide comprising an amino acid sequence selected from the group consisting of SEQ ID NOs:470-784 and 2398-3818.

According to some embodiments of the invention, the polypeptide is set forth by SEQ ID NO: 470-784, 2398-3817 or 3818.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO:3827 (pQFNC); SEQ ID NO:3833 (PJJ 35S from Brachypodium); SEQ ID NO:3834 (Odell et al., Nature 313:810-812, 1985)], *Arabidopsis* At6669 promoter (SEQ ID NO:3826; see PCT Publication No. WO04081173A2 or the new At6669 promoter (SEQ ID NO:3829); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Ubi 1 promoter (SEQ ID NO:3832); RBCS promoter (SEQ ID NO:3831); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10 (1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604, 121; 5,569,597; 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:3828), from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39 (8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorghum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217:240-245; 1989), apetala-3], and root promoters such as the ROOTP promoter [SEQ ID NO: 3830].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase nitrogen use efficiency, yield, biomass, growth rate, vigor, oil content, fiber yield, fiber quality, and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, yield, biomass, growth rate, vigor, oil content, fiber yield, fiber quality, and/or abiotic stress tolerance of the plant.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—

Heat stress tolerance is achieved by exposing the plants to temperatures above 34° C. for a certain period. Plant tolerance is examined after transferring the plants back to 22° C.

for recovery and evaluation after 5 days relative to internal controls (non-transgenic plants) or plants not exposed to neither cold or heat stress.

Water Use Efficiency—

Can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer Use Efficiency—

To analyze whether the transgenic plants are more responsive to fertilizers, plants are grown in agar plates or pots with a limited amount of fertilizer, as described, for example, in Examples 16-18, hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—

To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—

The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—

The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—

The plant vigor can be calculated by the increase in growth parameters such as leaf area, fiber length, rosette diameter, plant fresh weight and the like per time.

Growth Rate—

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative Growth Area

Can be calculated using Formula II.

Relative growth rate area=Regression coefficient of area along time course    Formula II Thus, the relative growth area rate is in units of 1/day and length growth rate is in units of 1/day.

Seed Yield—

Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula II:

1000 Seed Weight=number of seed in sample/sample weight×1000    Formula III

The Harvest Index can be calculated using Formula IV

Harvest Index=Average seed yield per plant/Average dry weight    Formula IV

Grain Protein Concentration—

Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content—

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA Extraction—

Tissues growing at various growth conditions (as described below) were sampled and RNA was extracted using TRIzol Reagent from Invitrogen [Hypertext Transfer Protocol://World Wide Web (dot) invitrogen (dot) com/ content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation Analysis—

Was performed for selected genes according to some embodiments of the invention, in which the characterized parameters (measured parameters according to the correlation IDs) were used as "x axis" for correlation with the tissue transcriptom, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Identifying Genes which Increase Nitrogen Use Efficiency (NUE), Fertilizer Use Efficiency (FUE), Yield, Growth Rate, Vigor, Biomass, Oil Content, Abiotic Stress Tolerance (ABST) and/or Water Use Efficiency (WUE) in Plants The present inventors have identified polynucleotides which upregulation of expression thereof in plants increases nitrogen use efficiency (NUE), fertilizer use efficiency (FUE), yield (e.g., seed yield, oil yield, biomass, grain quantity and/or quality), growth rate, vigor, biomass, oil content, fiber yield, fiber quality, fiber length, abiotic stress tolerance (ABST) and/or water use efficiency (WUE) of a plant.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes

Arabidopsis genome [TAIR genome version 6 (Hypertext Transfer Protocol://World Wide Web (dot) Arabidopsis (dot) org/)]

Rice genome [IRGSP build 4.0 (Hypertext Transfer Protocol://rgp (dot) dna (dot) affrc (dot) go (dot) jp/IRGSP/)].

Poplar [Populus trichocarpa release 1.1 from JGI (assembly release v1.0) (Hypertext Transfer Protocol://World Wide Web (dot) genome (dot) jgi-psf (dot) org/)]

Brachypodium [JGI 4× assembly, Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [French-Italian Public Consortium for Grapevine Genome Characterization grapevine genome (Hypertext Transfer Protocol://World Wide Web (dot) genoscope (dot) cns (dot) fr/)]

Castobean [TIGR/J Craig Venter Institute 4× assembly [(Hypertext Transfer Protocol://msc (dot) jcvi (dot) org/ r_communis]

Sorghum [DOE-JGI SCP, version Sbi1 [Hypertext Transfer Protocol://World Wide Web (dot) phytozome (dot) net/)].

Maize [Hypertext Transfer Protocol://maizesequence (dot) org/]

Cucumber [Hypertext Transfer Protocol://cucumber (dot) genomics (dot) org (dot) cn/page/cucumber/index (dot) jsp]

Tomato [Hypertext Transfer Protocol://solgenomics (dot) net/tomato/]

Cassava [Hypertext Transfer Protocol://www (dot) phytozome (dot) net/cassava (dot) php]

Expressed EST and mRNA Sequences were Extracted from the Following Databases:

GenBank (Hypertext Transfer Protocol://World Wide Web (dot) ncbi (dot) nlm (dot) nih (dot) gov/Genbank/).

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) Arabidopsis (dot) org/).

Protein and Pathway Databases

Uniprot [Hypertext Transfer Protocol://World Wide Web (dot) uniprot (dot) org/].

AraCyc [Hypertext Transfer Protocol://World Wide Web (dot) Arabidopsis (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih.gov/geo/)

TAIR (Hypertext Transfer Protocol://World Wide Web.arabidopsis.org/).

Proprietary micro-array data (See WO2008/122980 and Examples 3-10 below).

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Soybean QTL: [Hypertext Transfer Protocol://World Wide Web (dot) soybeanbreederstoolbox(dot) com/].

Database Assembly—

Was performed to build a wide, rich, reliable annotated and easy to analyze database comprised of publicly available genomic mRNA, ESTs DNA sequences, data from various crops as well as gene expression, protein annotation and pathway, QTLs data, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly—

For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene Annotation—

Predicted genes and proteins were annotated as follows:

Sequences BLAST™ search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

BLAST™ against proteins from AraCyc and ENZYME databases was used to map the predicted transcripts to AraCyc pathways.

Predicted proteins from different species were compared using BLAST™ algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene Expression Profiling—

Several data sources were exploited for gene expression profiling, namely microarray data and digital expression profile (see below). According to gene expression profile, a correlation analysis was performed to identify genes, which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

The accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags (ESTs) that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Overall, 216 genes were identified to have a major impact on nitrogen use efficiency, fertilizer use efficiency, yield (e.g., seed yield, oil yield, grain quantity and/or quality), growth rate, vigor, biomass, oil content, fiber yield, fiber quality, fiber length, abiotic stress tolerance and/or water use efficiency when expression thereof is increased in plants. The identified genes, their curated polynucleotide and polypeptide sequences, as well as their updated sequences according to GenBank database are summarized in Table 1, hereinbelow.

TABLE 1

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU290 | wheat\|gb164\|BE586041 | wheat | 1 | 470 |
| LNU291 | sorghum\|09v1\|BM323576 | sorghum | 2 | 471 |
| LNU292 | sorghum\|09v1\|SB09G025040 | sorghum | 3 | 472 |
| LNU293 | rice\|gb170\|OS02G57600 | rice | 4 | 473 |
| LNU294 | soybean\|gb168\|BM526182 | soybean | 5 | 474 |
| LNU295 | tomato\|09v1\|AA824887 | tomato | 6 | 475 |
| LNU296 | rice\|gb170\|OS05G43380 | rice | 7 | 476 |
| LNU297 | barley\|10v1\|AV835353 | barley | 8 | 477 |
| LNU298 | wheat\|gb164\|BE446740 | wheat | 9 | 478 |
| LNU299 | maize\|gb170\|AI622290 | maize | 10 | 479 |
| LNU300 | maize\|gb170\|AI861194 | maize | 11 | 480 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU301 | maize\|gb170\|BM073140 | maize | 12 | 481 |
| LNU302 | tomato\|09v1\|BT013543 | tomato | 13 | 482 |
| LNU303 | sorghum\|09v1\|SB01G004420 | sorghum | 14 | 483 |
| LNU304 | rice\|gb170\|AU162343 | rice | 15 | 484 |
| LNU305 | barley\|10v1\|AV833418 | barley | 16 | 485 |
| LNU306 | arabidopsis\|gb165\|AT3G03860 | arabidopsis | 17 | 486 |
| LNU307 | maize\|gb170\|AI941897 | maize | 18 | 487 |
| LNU308 | arabidopsis\|gb165\|AT2G14110 | arabidopsis | 19 | 488 |
| LNU309 | millet\|09v1\|EVO454PM042396 | millet | 20 | 489 |
| LNU310 | tomato\|09v1\|BG133786 | tomato | 21 | 490 |
| LNU311 | maize\|gb170\|CO519241 | maize | 22 | 491 |
| LNU312 | rice\|gb170\|OS04G53730 | rice | 23 | 492 |
| LNU314 | sorghum\|09v1\|SB10G001680 | sorghum | 24 | 493 |
| LNU315 | wheat\|gb164\|BE497367 | wheat | 25 | 494 |
| LNU316 | sorghum\|09v1\|SB10G021140 | sorghum | 26 | 495 |
| LNU317 | maize\|gb170\|CF624079 | maize | 27 | 496 |
| LNU318 | wheat\|gb164\|BE443997 | wheat | 28 | 497 |
| LNU319 | sorghum\|09v1\|SB01G008770 | sorghum | 29 | 498 |
| LNU322 | barley\|10v1\|BE421151XX1 | barley | 30 | 499 |
| LNU323 | tomato\|09v1\|BG123422 | tomato | 31 | 500 |
| LNU324 | sorghum\|09v1\|SB08G018570 | sorghum | 32 | 501 |
| LNU326 | tomato\|09v1\|BG126891 | tomato | 33 | 502 |
| LNU327 | wheat\|gb164\|CA692356 | wheat | 34 | 503 |
| LNU328 | tomato\|09v1\|BG128098 | tomato | 35 | 504 |
| LNU329 | tomato\|09v1\|BG791244 | tomato | 36 | 505 |
| LNU330 | tomato\|09v1\|AW096846 | tomato | 37 | 506 |
| LNU331 | tomato\|09v1\|AW031707 | tomato | 38 | 507 |
| LNU332 | maize\|gb170\|AW052982 | maize | 39 | 508 |
| LNU333 | wheat\|gb164\|BE489159 | wheat | 40 | 509 |
| LNU335 | wheat\|gb164\|BE500673 | wheat | 41 | 510 |
| LNU336 | tomato\|09v1\|AI773791 | tomato | 42 | 511 |
| LNU337 | grape\|gb160\|CB968839 | grape | 43 | 512 |
| LNU339 | maize\|gb170\|CB605279 | maize | 44 | 513 |
| LNU340 | wheat\|gb164\|BG604469 | wheat | 45 | 514 |
| LNU341 | wheat\|gb164\|BE490253 | wheat | 46 | 515 |
| LNU342 | tomato\|09v1\|BG123334 | tomato | 47 | 516 |
| LNU343 | wheat\|gb164\|AL825714 | wheat | 48 | 517 |
| LNU344 | wheat\|gb164\|BJ256846 | wheat | 49 | 518 |
| LNU345 | wheat\|gb164\|BF483929 | wheat | 50 | 519 |
| LNU346 | sorghum\|09v1\|SB09G026910 | sorghum | 51 | 520 |
| LNU347 | sorghum\|09v1\|SB09G000370 | sorghum | 52 | 521 |
| LNU348 | maize\|gb170\|W21614 | maize | 53 | 522 |
| LNU349 | soybean\|gb168\|CA910292 | soybean | 54 | 523 |
| LNU350 | wheat\|gb164\|BF201187 | wheat | 55 | 524 |
| LNU351 | wheat\|gb164\|BE423861 | wheat | 56 | 525 |
| LNU352 | wheat\|gb164\|BF474109 | wheat | 57 | 526 |
| LNU353 | wheat\|gb164\|BF201797 | wheat | 58 | 527 |
| LNU354 | wheat\|gb164\|BE445429 | wheat | 59 | 528 |
| LNU355 | wheat\|gb164\|BF484349 | wheat | 60 | 529 |
| LNU356 | tomato\|09v1\|BG629014 | tomato | 61 | 530 |
| LNU357 | tomato\|09v1\|AI775669 | tomato | 62 | 531 |
| LNU359 | maize\|gb170\|AI901501 | maize | 63 | 532 |
| LNU360 | maize\|gb170\|AI637191 | maize | 64 | 533 |
| LNU361 | maize\|gb170\|AI612217 | maize | 65 | 534 |
| LNU362 | rice\|gb170\|OS02G49850 | rice | 66 | 535 |
| LNU363 | rice\|gb170\|OS01G59870 | rice | 67 | 536 |
| LNU364 | rice\|gb170\|OS02G49470 | rice | 68 | 537 |
| LNU365 | rice\|gb170\|OS04G37820 | rice | 69 | 538 |
| LNU366 | rice\|gb170\|OS03G48030 | rice | 70 | 539 |
| LNU367 | rice\|gb170\|OS02G38970 | rice | 71 | 540 |
| LNU368 | wheat\|gb164\|BE490258 | wheat | 72 | 541 |
| LNU369 | wheat\|gb164\|CA500696 | wheat | 73 | 542 |
| LNU370 | tomato\|09v1\|AI772811 | tomato | 74 | 543 |
| LNU371 | maize\|gb170\|CK985828 | maize | 75 | 544 |
| LNU372 | wheat\|gb164\|AL825623 | wheat | 76 | 545 |
| LNU373 | rice\|gb170\|OS12G25200 | rice | 77 | 546 |
| LNU374 | rice\|gb170\|OS03G63700 | rice | 78 | 547 |
| LNU375 | tomato\|09v1\|BG125016 | tomato | 79 | 548 |
| LNU376 | maize\|gb170\|AW017929 | maize | 80 | 549 |
| LNU377 | sorghum\|09v1\|SB01G000775 | sorghum | 81 | 550 |
| LNU378 | wheat\|gb164\|AJ717146 | wheat | 82 | 551 |
| LNU379 | sorghum\|09v1\|SB01G015660 | sorghum | 83 | 552 |
| LNU380 | wheat\|gb164\|BQ483748 | wheat | 84 | 553 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU381 | sorghum\|09v1\|SB04G034690 | sorghum | 85 | 554 |
| LNU382 | arabidopsis\|gb165\|AT1G65070 | arabidopsis | 86 | 555 |
| LNU383 | tomato\|09v1\|BG123484 | tomato | 87 | 556 |
| LNU384 | tomato\|09v1\|AI482780 | tomato | 88 | 557 |
| LNU385 | rice\|gb170\|OS01G25600 | rice | 89 | 558 |
| LNU386 | rice\|gb170\|OS06G35200 | rice | 90 | 559 |
| LNU387 | sorghum\|09v1\|SB02G032450 | sorghum | 91 | 560 |
| LNU388 | rice\|gb170\|OS04G58410 | rice | 92 | 561 |
| LNU390 | tomato\|09v1\|BG125049 | tomato | 93 | 562 |
| LNU391 | barley\|10v1\|BE060369 | barley | 94 | 563 |
| LNU392 | rice\|gb170\|OS03G11420 | rice | 95 | 564 |
| LNU393 | sorghum\|09v1\|SB04G005560 | sorghum | 96 | 565 |
| LNU395 | sorghum\|09v1\|SB06G025090 | sorghum | 97 | 566 |
| LNU396 | sorghum\|09v1\|SB01G048410 | sorghum | 98 | 567 |
| LNU397 | sorghum\|09v1\|SB03G031230 | sorghum | 99 | 568 |
| LNU399 | wheat\|gb164\|CA655009 | wheat | 100 | 569 |
| LNU401 | sorghum\|09v1\|SB04G002180 | sorghum | 101 | 570 |
| LNU402 | wheat\|gb164\|CK212389 | wheat | 102 | 571 |
| LNU403 | sorghum\|09v1\|SB03G041600 | sorghum | 103 | 572 |
| LNU405 | tomato\|09v1\|BG125067 | tomato | 104 | 573 |
| LNU407 | barley\|10v1\|AJ484347 | barley | 105 | 574 |
| LNU408 | barley\|10v1\|BE421189 | barley | 106 | 575 |
| LNU409 | barley\|10v1\|GH227248 | barley | 107 | 576 |
| LNU410 | wheat\|gb164\|BE424655 | wheat | 108 | 577 |
| LNU411 | tomato\|09v1\|BI207068 | tomato | 109 | 578 |
| LNU412 | cotton\|gb164\|BE053302 | cotton | 110 | 579 |
| LNU413 | tomato\|09v1\|BG126757 | tomato | 111 | 580 |
| LNU414 | wheat\|gb164\|CA653735 | wheat | 112 | 581 |
| LNU415 | sorghum\|09v1\|SB01G048990 | sorghum | 113 | 582 |
| LNU416 | b_juncea\|gb164\|EVGN00464924783313 | b_juncea | 114 | 583 |
| LNU417 | wheat\|gb164\|BG607934 | wheat | 115 | 584 |
| LNU419 | tomato\|09v1\|BG132251 | tomato | 116 | 585 |
| LNU420 | sorghum\|09v1\|SB01G040070 | sorghum | 117 | 586 |
| LNU421 | sorghum\|09v1\|SB06G031090 | sorghum | 118 | 587 |
| LNU422 | sorghum\|09v1\|SB07G002970 | sorghum | 119 | 588 |
| LNU423 | sorghum\|09v1\|SB01G001120 | sorghum | 120 | 589 |
| LNU424 | arabidopsis\|gb165\|AT5G02240 | arabidopsis | 121 | 590 |
| LNU425 | barley\|10v1\|AJ461142 | barley | 122 | 591 |
| LNU426 | rice\|gb170\|OS06G48320 | rice | 123 | 592 |
| LNU427 | rice\|gb170\|OS03G03140 | rice | 124 | 593 |
| LNU429 | tomato\|09v1\|BG124215 | tomato | 125 | 594 |
| LNU430 | tomato\|09v1\|BG130012 | tomato | 126 | 595 |
| LNU431 | sorghum\|09v1\|SB10G024110 | sorghum | 127 | 596 |
| LNU432 | sorghum\|09v1\|SB03G013220 | sorghum | 128 | 597 |
| LNU433 | sorghum\|09v1\|SB04G026690 | sorghum | 129 | 598 |
| LNU434 | sorghum\|09v1\|SB01G046460 | sorghum | 130 | 599 |
| LNU435 | barley\|10v1\|BE060935 | barley | 131 | 600 |
| LNU436 | barley\|10v1\|BE422114 | barley | 132 | 601 |
| LNU437 | barley\|10v1\|BI950410 | barley | 133 | 602 |
| LNU438 | barley\|10v1\|BE437298 | barley | 134 | 603 |
| LNU439 | sorghum\|09v1\|SB09G005970 | sorghum | 135 | 604 |
| LNU441 | sorghum\|09v1\|SB01G037770 | sorghum | 136 | 605 |
| LNU442 | tomato\|09v1\|AW735755 | tomato | 137 | 606 |
| LNU443 | brachypodium\|09v1\|GT769494 | brachypodium | 138 | 607 |
| LNU444 | cotton\|gb164\|AI726042 | cotton | 139 | 608 |
| LNU445 | soybean\|gb168\|FK341642 | soybean | 140 | 609 |
| LNU446 | soybean\|gb168\|BE917590 | soybean | 141 | 610 |
| LNU447 | barley\|10v1\|BF254963 | barley | 142 | 611 |
| LNU448 | barley\|10v1\|BE422325 | barley | 143 | 612 |
| LNU449 | cotton\|gb164\|AI725388 | cotton | 144 | 613 |
| LNU450 | cotton\|gb164\|AI728722 | cotton | 145 | 614 |
| LNU451 | tomato\|09v1\|BG124246 | tomato | 146 | 615 |
| LNU453 | sorghum\|09v1\|SB10G027420 | sorghum | 147 | 616 |
| LNU454 | tomato\|09v1\|BG127794 | tomato | 148 | 617 |
| LNU455 | tomato\|09v1\|BG626661 | tomato | 149 | 618 |
| LNU456 | barley\|10v1\|BF265366 | barley | 150 | 619 |
| LNU457 | tomato\|gb164\|CK714827 | tomato | 151 | 620 |
| LNU458 | cotton\|10v1\|DW508164 | cotton | 152 | 621 |
| LNU459 | maize\|gb170\|BM350702 | maize | 153 | 622 |
| LNU460 | maize\|gb170\|AW066359 | maize | 154 | 623 |
| LNU461 | tomato\|09v1\|AI483350 | tomato | 155 | 624 |
| LNU462 | tomato\|09v1\|AI896771 | tomato | 156 | 625 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU463 | grape\|gb160\|CB346636 | grape | 157 | 626 |
| LNU464 | grape\|gb160\|CB968657 | grape | 158 | 627 |
| LNU465 | sorghum\|09v1\|SB03G033750 | sorghum | 159 | 628 |
| LNU466 | barley\|10v1\|AV833763 | barley | 160 | 629 |
| LNU467 | barley\|10v1\|BF254449 | barley | 161 | 630 |
| LNU468 | tomato\|09v1\|AI637280 | tomato | 162 | 631 |
| LNU469 | maize\|gb170\|BI542994 | maize | 163 | 632 |
| LNU470 | barley\|10v1\|BQ760445 | barley | 164 | 633 |
| LNU471 | maize\|gb170\|BQ035243 | maize | 165 | 634 |
| LNU472 | barley\|10v1\|BI780920 | barley | 166 | 635 |
| LNU473 | sorghum\|09v1\|SB03G013160 | sorghum | 167 | 636 |
| LNU474 | soybean\|gb168\|CV536461 | soybean | 168 | 637 |
| LNU476 | maize\|gb170\|AW400216 | maize | 169 | 638 |
| LNU477 | sorghum\|09v1\|SB01G035950 | sorghum | 170 | 639 |
| LNU479 | sorghum\|09v1\|SB01G011640 | sorghum | 171 | 640 |
| LNU480 | sorghum\|09v1\|SB01G003380 | sorghum | 172 | 641 |
| LNU481 | sorghum\|09v1\|SB01G045180 | sorghum | 173 | 642 |
| LNU482 | cotton\|10v1\|BF273404 | cotton | 174 | 643 |
| LNU483 | rice\|gb170\|OS02G49880 | rice | 175 | 644 |
| LNU485 | rice\|gb170\|OS04G52230 | rice | 176 | 645 |
| LNU486 | rice\|gb170\|OS08G04560 | rice | 177 | 646 |
| LNU489 | tomato\|09v1\|BG32312 | tomato | 178 | 647 |
| LNU490 | poplar\|10v1\|CA822678 | poplar | 179 | 648 |
| LNU491 | sorghum\|09v1\|SB01G031120 | sorghum | 180 | 649 |
| LNU492 | rice\|gb170\|OS07G46790 | rice | 181 | 650 |
| LNU493 | rice\|gb170\|OS06G34040 | rice | 182 | 651 |
| LNU494 | maize\|gb170\|BE186249 | maize | 183 | 652 |
| LNU495 | sorghum\|09v1\|SB03G028760 | sorghum | 184 | 653 |
| LNU496 | wheat\|gb164\|CA640674 | wheat | 185 | 654 |
| LNU497 | wheat\|gb164\|BE516527 | wheat | 186 | 655 |
| LNU498 | sorghum\|09v1\|SB02G002830 | sorghum | 187 | 656 |
| LNU499 | barley\|10v1\|AV923755 | barley | 188 | 657 |
| LNU500 | tomato\|09v1\|BG643024 | tomato | 189 | 658 |
| LNU501 | sorghum\|09v1\|SB10G026500 | sorghum | 190 | 659 |
| LNU502 | barley\|10v1\|BI958006 | barley | 191 | 660 |
| LNU503 | rice\|gb170\|OS04G52300 | rice | 192 | 661 |
| LNU504 | arabidopsis\|gb165\|AT2G19110 | arabidopsis | 193 | 662 |
| LNU506 | tomato\|09v1\|AI490778 | tomato | 194 | 663 |
| LNU507 | barley\|10v1\|BF621023 | barley | 195 | 664 |
| LNU508 | rice\|gb170\|AA753097 | rice | 196 | 665 |
| LNU509 | rice\|gb170\|OS01G21990 | rice | 197 | 666 |
| LNU510 | rice\|gb170\|OS06G29844 | rice | 198 | 667 |
| LNU511 | rice\|gb170\|OS03G48260 | rice | 199 | 668 |
| LNU512 | arabidopsis\|gb165\|AT1G54040 | arabidopsis | 200 | 669 |
| LNU513 | soybean\|gb168\|BE822210 | soybean | 201 | 670 |
| LNU514 | rice\|gb170\|BE040128 | rice | 202 | 671 |
| LNU517 | soybean\|gb168\|AW201968 | soybean | 203 | 672 |
| LNU518 | maize\|gb170\|CA404810 | maize | 204 | 673 |
| LNU519 | maize\|gb170\|CF046227 | maize | 205 | 674 |
| LNU520 | sorghum\|09v1\|SB10G027140 | sorghum | 206 | 675 |
| LNU309 H3 | maize\|gb170\|AW165565 | maize | 207 | 676 |
| LNU417 H4 | maize\|10v1\|CB381339 | maize | 208 | 677 |
| LNU431 H1 | maize\|10v1\|CO528919 | maize | 209 | 678 |
| LNU437 H2 | rice\|gb170\|OS11G37700 | rice | 210 | 679 |
| LNU313 | sorghum\|09v1\|CF757586 | sorghum | 211 | — |
| LNU358 | maize\|gb170\|AI615229 | maize | 212 | — |
| LNU394 | maize\|gb170\|AI491593 | maize | 213 | — |
| LNU418 | maize\|gb170\|AW165449 | maize | 214 | — |
| LNU487 | barley\|10v1\|AJ475337 | barley | 215 | — |
| LNU488 | barley\|10v1\|AJ469759 | barley | 216 | — |
| LNU410 | wheat\|gb164\|BE424655 | wheat | 108 | 699 |
| LNU504 | arabidopsis\|gb165\|AT2G19110 | arabidopsis | 193 | 712 |
| LNU487 | barley\|10v1\|AJ475337 | barley | 215 | 708 |
| LNU290 | wheat\|gb164\|BE586041 | wheat | 217 | 680 |
| LNU292 | sorghum\|09v1\|SB09G025040 | sorghum | 218 | 472 |
| LNU294 | soybean\|gb168\|BM526182 | soybean | 219 | 681 |
| LNU297 | barley\|10v1\|AV835353 | barley | 220 | 682 |
| LNU300 | maize\|gb170\|AI861194 | maize | 221 | 683 |
| LNU309 | millet\|09v1\|EV0454PM042396 | millet | 222 | 684 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| LNU312 | rice\|gb170\|OS04G53730 | rice | 223 | 492 |
| LNU314 | sorghum\|09v1\|SB10G001680 | sorghum | 224 | 685 |
| LNU332 | maize\|gb170\|AW052982 | maize | 225 | 508 |
| LNU337 | grape\|gb160\|CB968839 | grape | 226 | 686 |
| LNU341 | wheat\|gb164\|BE490253 | wheat | 227 | 687 |
| LNU350 | wheat\|gb164\|BF201187 | wheat | 228 | 688 |
| LNU353 | wheat\|gb164\|BF201797 | wheat | 229 | 689 |
| LNU364 | rice\|gb170\|OS02G49470 | rice | 230 | 537 |
| LNU368 | wheat\|gb164\|BE490258 | wheat | 231 | 690 |
| LNU369 | wheat\|gb164\|CA500696 | wheat | 232 | 691 |
| LNU372 | wheat\|gb164\|AL825623 | wheat | 233 | 692 |
| LNU378 | wheat\|gb164\|AJ717146 | wheat | 234 | 693 |
| LNU378 | wheat\|gb164\|AJ717146 | wheat | 235 | 694 |
| LNU380 | wheat\|gb164\|BQ483748 | wheat | 236 | 695 |
| LNU381 | sorghum\|09v1\|SB04G034690 | sorghum | 237 | 554 |
| LNU382 | arabidopsis\|gb165\|AT1G65070 | arabidopsis | 238 | 555 |
| LNU393 | sorghum\|09v1\|SB04G005560 | sorghum | 239 | 565 |
| LNU401 | sorghum\|09v1\|SB04G002180 | sorghum | 240 | 696 |
| LNU407 | barley\|10v1\|AJ484347 | barley | 241 | 697 |
| LNU409 | barley\|10v1\|GH227248 | barley | 242 | 698 |
| LNU414 | wheat\|gb164\|CA653735 | wheat | 243 | 700 |
| LNU416 | b_juncea\|gb164\|EVGN00464924783313 | b_juncea | 244 | 701 |
| LNU417 | wheat\|gb164\|BG607934 | wheat | 245 | 702 |
| LNU433 | sorghum\|09v1\|SB04G026690 | sorghum | 246 | 598 |
| LNU443 | brachypodium\|09v1\|GT769494 | brachypodium | 247 | 607 |
| LNU447 | barley\|10v1\|BF254963 | barley | 248 | 611 |
| LNU453 | sorghum\|09v1\|SB10G027420 | sorghum | 249 | 703 |
| LNU454 | tomato\|09v1\|BG127794 | tomato | 250 | 617 |
| LNU457 | tomato\|gb164\|CK714827 | tomato | 251 | 704 |
| LNU466 | barley\|10v1\|AV833763 | barley | 252 | 705 |
| LNU470 | barley\|10v1\|BQ760445 | barley | 253 | 706 |
| LNU474 | soybean\|gb168\|CV536461 | soybean | 254 | 707 |
| LNU488 | barley\|10v1\|AJ469759 | barley | 255 | 709 |
| LNU490 | poplar\|10v1\|CA822678 | poplar | 256 | 648 |
| LNU495 | sorghum\|09v1\|SB03G028760 | sorghum | 257 | 710 |
| LNU500 | tomato\|09v1\|BG643024 | tomato | 258 | 711 |
| LNU506 | tomato\|09v1\|AI490778 | tomato | 259 | 713 |
| LNU508 | rice\|gb170\|AA753097 | rice | 260 | 714 |
| LNU509 | rice\|gb170\|OS01G21990 | rice | 261 | 666 |
| LNU309 H3 | maize\|gb170\|AW165565 | maize | 262 | 715 |
| LNU431 H1 | maize\|gb170\|CO528919 | maize | 263 | 716 |
| LNU313 | sorghum\|09v1\|CF757586 | sorghum | 264 | — |
| LNU358 | maize\|gb170\|AI615229 | maize | 265 | — |

Provided are the identified genes along with their sequence identifiers.
"Polyp." = polypeptide;
"Polyn."—Polynucleotide.

Example 2

Identification of Homologous Sequences that Increase Nitrogen Use Efficiency, Fertilizer Use Efficiency, Yield, Growth Rate, Vigor, Biomass, Oil Content, Abiotic Stress Tolerance and/or Water Use Efficiency in Plants The concepts of orthology and paralogy have recently been applied to functional characterizations and classifications on the scale of whole-genome comparisons. Orthologs and paralogs constitute two major types of homologs: The first evolved from a common ancestor by specialization, and the latter is related by duplication events. It is assumed that paralogs arising from ancient duplication events are likely to have diverged in function while true orthologs are more likely to retain identical function over evolutionary time.

To further investigate and identify putative orthologs of the genes affecting nitrogen use efficiency, fertilizer use efficiency, yield (e.g., seed yield, oil yield, biomass, grain quantity and/or quality), growth rate, vigor, biomass, oil content, abiotic stress tolerance and/or water use efficiency, all sequences were aligned using the BLAST™ (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST™ programs. There are five implementations of BLAST™, three designed for nucleotide sequence queries (BLASTN™, BLASTX™, and TBLASTX™) and two designed for protein sequence queries (BLASTP™ and TBLASTN™) (Coulson, Trends in Biotechnology: 76-80, 1994; Birren et al., Genome Analysis, I: 543, 1997). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the genes of some embodiments of the invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of some embodiments of the invention. Example of other plants include, but not limited to, barley (*Hordeum vulgare*), *Arabidopsis* (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*) and Wheat (*Triticum aestivum*).

The above-mentioned analyses for sequence homology is preferably carried out on a full-length sequence, but may also be based on a comparison of certain regions such as conserved domains. The identification of such domains, would also be well within the realm of the person skilled in the art and would involve, for example, a computer readable format of the nucleic acids of some embodiments of the invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/db-browser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution Tables are well known in the art [see for example Creighton (1984) Proteins. W.H. Freeman and Company]. Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST™ software using the BLASTP™ and TBLASTN™ algorithms. The query polypeptide sequences were SEQ ID NOs: 470-716 (which are encoded by the polynucleotides SEQ ID NOs:1-265, shown in Table 1 above) and SEQ ID NOs:717-784 (which are encoded by the cloned genes SEQ ID NOs:266-469, shown in Table 68 (Example 13, below) and the identified homologous sequences are provided in Table 2, below.

TABLE 2

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 785 | LNU290 | leymus\|gb166\|EG374697_P1 | 2398 | 470 | 89.8 | globlastp |
| 786 | LNU290 | wheat\|10v2\|BE499260_P1 | 2399 | 470 | 81 | globlastp |
| 787 | LNU290 | barley\|10v2\|BF624085_P1 | 2400 | 470 | 80.8 | globlastp |
| 788 | LNU290 | oat\|10v2\|GR316625_P1 | 2401 | 470 | 80.2 | globlastp |
| 789 | LNU291 | maize\|gb170\|CF035629 | 471 | 471 | 100 | globlastp |
| 790 | LNU291 | sugarcane\|10v1\|GFXAE009947X12 | 471 | 471 | 100 | globlastp |
| 791 | LNU291 | maize\|10v1\|EG151714_P1 | 2402 | 471 | 98.5 | globlastp |
| 792 | LNU291 | maize\|gb170\|CRPZM2N041615 | 2402 | 471 | 98.5 | globlastp |
| 793 | LNU291 | maize\|10v1\|DW738796_P1 | 2403 | 471 | 98 | globlastp |
| 794 | LNU291 | maize\|gb170\|DW809324 | 2403 | 471 | 98 | globlastp |
| 795 | LNU291 | rice\|gb170\|OS04G16738 | 2404 | 471 | 97.01 | glotblastn |
| 796 | LNU291 | rice\|gb170\|OSP1G00360 | 2405 | 471 | 97 | globlastp |
| 797 | LNU291 | wheat\|10v2\|GFXWHTCPPSBGX1_T1 | — | 471 | 96.02 | glotblastn |
| 798 | LNU291 | barley\|10v1\|BJ463973 | 2406 | 471 | 95.52 | glotblastn |
| 799 | LNU291 | barley\|10v2\|BJ463973_P1 | 2407 | 471 | 95.5 | globlastp |
| 800 | LNU291 | brachypodium\|09v1\|GFXEU325680X11_P1 | 2408 | 471 | 95.5 | globlastp |
| 801 | LNU291 | brachypodium\|09v1\|CRPBD014715_T1 | 2409 | 471 | 94.53 | glotblastn |
| 802 | LNU291 | lolium\|10v1\|GFXAM777385X11_T1 | 2410 | 471 | 94.03 | glotblastn |
| 803 | LNU291 | maize\|10v1\|DW746358_P1 | 2411 | 471 | 90 | globlastp |
| 804 | LNU291 | maize\|gb170\|CRPZM2N041741 | 2411 | 471 | 90 | globlastp |
| 805 | LNU291 | maize\|10v1\|DW898492_P1 | 2412 | 471 | 85.1 | globlastp |
| 806 | LNU291 | maize\|gb170\|CRPZM2N087668 | 2412 | 471 | 85.1 | globlastp |
| 807 | LNU291 | banana\|10v1\|GFXEU017022X1_P1 | 2413 | 471 | 84.1 | globlastp |
| 807 | LNU302 | banana\|10v1\|GFXEU017022X1_P1 | 2413 | 482 | 86.1 | globlastp |
| 808 | LNU291 | poppy\|gb166\|FE967418_T1 | 2414 | 471 | 80.6 | glotblastn |
| 808 | LNU302 | poppy\|gb166\|FE967418_T1 | 2414 | 482 | 91.04 | glotblastn |
| 809 | LNU291 | arabidopsis_lyrata\|09v1\|JGIAL006450_P1 | 2415 | 471 | 80.1 | globlastp |
| 809 | LNU302 | arabidopsis_lyrata\|09v1\|JGIAL006450_P1 | 2415 | 482 | 88.1 | globlastp |
| 810 | LNU292 | maize\|10v1\|AI855230_T1 | 2416 | 472 | 93.33 | glotblastn |
| 811 | LNU292 | maize\|gb170\|AI855230 | 2417 | 472 | 93.3 | globlastp |
| 812 | LNU292 | maize\|10v1\|AI629623_P1 | 2418 | 472 | 89.8 | globlastp |
| 813 | LNU292 | millet\|10v1\|EVO454PM068054_P1 | 2419 | 472 | 83.7 | globlastp |
| 814 | LNU295 | solanum_phureja\|09v1\|SPHAA824887 | 2420 | 475 | 97.7 | globlastp |
| 815 | LNU295 | eggplant\|10v1\|FS032066_P1 | 2421 | 475 | 95 | globlastp |
| 816 | LNU295 | petunia\|gb171\|CV300743_P1 | 2422 | 475 | 94.6 | globlastp |
| 817 | LNU295 | nicotiana_benthamiana\|gb162\|EH366260_P1 | 2423 | 475 | 94.1 | globlastp |
| 818 | LNU295 | pepper\|gb171\|AF082717_P1 | 2424 | 475 | 94.1 | globlastp |
| 819 | LNU295 | aquilegia\|10v1\|DR939800 | 2425 | 475 | 86.4 | globlastp |
| 820 | LNU295 | aquilegia\|10v2\|DR939800_P1 | 2425 | 475 | 86.4 | globlastp |
| 821 | LNU295 | coffea\|10v1\|CF588912_P1 | 2426 | 475 | 85.5 | globlastp |
| 822 | LNU295 | onion\|gb162\|CF450542_P1 | 2427 | 475 | 84.6 | globlastp |
| 823 | LNU295 | kiwi\|gb166\|FG406602_P1 | 2428 | 475 | 82.8 | globlastp |
| 824 | LNU295 | papaya\|gb165\|EX249843_P1 | 2429 | 475 | 82.8 | globlastp |
| 825 | LNU295 | citrus\|gb166\|CD575353_P1 | 2430 | 475 | 82.4 | globlastp |
| 826 | LNU295 | apple\|gb171\|CN493682_P1 | 2431 | 475 | 81.9 | globlastp |
| 827 | LNU295 | oak\|10v1\|FP026569_P1 | 2432 | 475 | 81 | globlastp |
| 828 | LNU295 | cleome_spinosa\|10v1\|GR935187_P1 | 2433 | 475 | 81 | globlastp |
| 829 | LNU295 | ipomoea_nil\|10v1\|BJ553751_P1 | 2434 | 475 | 80.6 | globlastp |
| 830 | LNU295 | peanut\|10v1\|CD037840_P1 | 2435 | 475 | 80.5 | globlastp |
| 830 | LNU299 | peanut\|10v1\|CD037840_P1 | 2435 | 479 | 80.1 | globlastp |
| 831 | LNU295 | avocado\|10v1\|CK754477_P1 | 2436 | 475 | 80.5 | globlastp |
| 832 | LNU295 | nasturtium\|10v1\|SRR032558S0015258_P1 | 2437 | 475 | 80.5 | globlastp |
| 833 | LNU295 | peanut\|gb171\|CD037840 | 2435 | 475 | 80.5 | globlastp |
| 833 | LNU299 | peanut\|gb171\|CD037840 | 2435 | 479 | 80.1 | globlastp |
| 834 | LNU295 | prunus\|10v1\|CB823956_P1 | 2438 | 475 | 80.1 | globlastp |
| 834 | LNU299 | prunus\|10v1\|CB823956_P1 | 2438 | 479 | 80.5 | globlastp |
| 835 | LNU295 | b_rapa\|gb162\|CX272134_P1 | 2439 | 475 | 80.1 | globlastp |
| 836 | LNU295 | cotton\|10v1\|AI726608 | 2440 | 475 | 80.1 | globlastp |
| 837 | LNU295 | cotton\|10v2\|BE053131_P1 | 2441 | 475 | 80.1 | globlastp |
| 838 | LNU295 | thellungiella\|gb167\|BY803571 | 2442 | 475 | 80.1 | globlastp |
| 839 | LNU295 | prunus\|gb167\|CB823956 | 2438 | 475 | 80.1 | globlastp |
| 839 | LNU299 | prunus\|gb167\|CB823956 | 2438 | 479 | 80.5 | globlastp |
| 840 | LNU295 | grape\|gb160\|BM436999_T1 | 2443 | 475 | 80.09 | glotblastn |
| 841 | LNU298 | wheat\|gb164\|BF483176 | 2444 | 478 | 91.8 | globlastp |
| 842 | LNU298 | wheat\|10v2\|CA678180_P1 | 2445 | 478 | 89.2 | globlastp |
| 843 | LNU298 | wheat\|gb164\|BE500660 | 2445 | 478 | 89.2 | globlastp |
| 844 | LNU298 | barley\|10v1\|AV832797 | 2446 | 478 | 85.9 | globlastp |
| 845 | LNU298 | barley\|10v2\|AV832797_P1 | 2446 | 478 | 85.9 | globlastp |
| 846 | LNU299 | sorghum\|09v1\|SB03G006050 | 2447 | 479 | 97.3 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 847 | LNU299 | sugarcane\|10v1\|BQ535654 | 2448 | 479 | 95.9 | globlastp |
| 848 | LNU299 | foxtail_millet\|10v2\|SICRP019205_P1 | 2449 | 479 | 90.5 | globlastp |
| 849 | LNU299 | rice\|gb170\|OS04G20280 | 2450 | 479 | 88.2 | globlastp |
| 850 | LNU299 | cenchrus\|gb166\|EB654614_P1 | 2451 | 479 | 87.4 | globlastp |
| 851 | LNU299 | cynodon\|10v1\|ES292284_P1 | 2452 | 479 | 86.4 | globlastp |
| 852 | LNU299 | rice\|gb170\|OS01G05694 | 2453 | 479 | 86 | globlastp |
| 853 | LNU299 | millet\|10v1\|EVO454PM008366_P1 | 2454 | 479 | 85.1 | globlastp |
| 854 | LNU299 | brachypodium\|09v1\|GT782155_P1 | 2455 | 479 | 83.8 | globlastp |
| 855 | LNU299 | switchgrass\|gb167\|DN148482 | 2456 | 479 | 83.71 | glotblastn |
| 856 | LNU299 | switchgrass\|gb167\|DN152162 | 2457 | 479 | 83.3 | globlastp |
| 857 | LNU299 | wheat\|gb164\|BE404513 | 2458 | 479 | 82.4 | globlastp |
| 858 | LNU299 | wheat\|10v2\|BE404513_P1 | 2458 | 479 | 82.4 | globlastp |
| 859 | LNU299 | wheat\|gb164\|BF203016 | 2459 | 479 | 82.4 | globlastp |
| 860 | LNU299 | pseudoroegneria\|gb167\|FF352036 | 2460 | 479 | 81.9 | globlastp |
| 861 | LNU299 | wheat\|gb164\|BE414418 | 2461 | 479 | 81 | globlastp |
| 862 | LNU299 | wheat\|10v2\|BE414418_P1 | 2461 | 479 | 81 | globlastp |
| 863 | LNU299 | barley\|10v2\|AJ461592_P1 | 2462 | 479 | 80.5 | globlastp |
| 864 | LNU299 | lovegrass\|gb167\|EH184276_P1 | 2463 | 479 | 80.5 | globlastp |
| 865 | LNU300 | maize\|10v1\|T18817_P1 | 2464 | 480 | 98.5 | globlastp |
| 866 | LNU300 | sorghum\|09v1\|SB09G004320_P1 | 2465 | 480 | 98.3 | globlastp |
| 867 | LNU300 | sugarcane\|10v1\|CA065017_P1 | 2466 | 480 | 98.3 | globlastp |
| 868 | LNU300 | foxtail_millet\|10v2\|OXEC612314T1_P1 | 2467 | 480 | 95.1 | globlastp |
| 869 | LNU300 | millet\|10v1\|CD725150_P1 | 2468 | 480 | 93.8 | globlastp |
| 870 | LNU300 | switchgrass\|gb167\|FE621296_P1 | 2469 | 480 | 90.4 | globlastp |
| 871 | LNU300 | rice\|gb170\|OS05G06350_P1 | 2470 | 480 | 89.9 | globlastp |
| 872 | LNU300 | brachypodium\|09v1\|DV470466_P1 | 2471 | 480 | 89.1 | globlastp |
| 873 | LNU300 | barley\|10v2\|BE413102_P1 | 2472 | 480 | 88.8 | globlastp |
| 874 | LNU300 | wheat\|10v2\|BE400103_P1 | 2473 | 480 | 88.6 | globlastp |
| 875 | LNU300 | oat\|10v2\|CN815116_P1 | 2474 | 480 | 88 | globlastp |
| 876 | LNU300 | cassava\|09v1\|JGICASSAVA12817VALIDM1_P1 | 2475 | 480 | 82.7 | globlastp |
| 877 | LNU300 | cassava\|09v1\|DV441758_P1 | 2476 | 480 | 82 | globlastp |
| 878 | LNU300 | cacao\|10v1\|CU476740_P1 | 2477 | 480 | 81.4 | globlastp |
| 879 | LNU300 | centaurea\|gb166\|EH712147_P1 | 2478 | 480 | 81.4 | globlastp |
| 880 | LNU300 | castorbean\|09v1\|XM002512439_P1 | 2479 | 480 | 81.1 | globlastp |
| 881 | LNU300 | sequoia\|10v1\|SRR065044S0000578_P1 | 2480 | 480 | 81.1 | globlastp |
| 882 | LNU300 | eucalyptus\|11v1\|CD668810_P1 | 2481 | 480 | 81 | globlastp |
| 883 | LNU300 | podocarpus\|10v1\|SRR065014S0001157_P1 | 2482 | 480 | 80.9 | globlastp |
| 884 | LNU300 | aristolochia\|10v1\|SRR039082S0002761_P1 | 2483 | 480 | 80.7 | globlastp |
| 885 | LNU300 | cotton\|10v2\|CO071731_P1 | 2484 | 480 | 80.6 | globlastp |
| 886 | LNU300 | melon\|10v1\|DV631718_P1 | 2485 | 480 | 80.6 | globlastp |
| 887 | LNU300 | poplar\|10v1\|BI070314_P1 | 2486 | 480 | 80.6 | globlastp |
| 888 | LNU300 | abies\|11v1\|SRR098676X100270_P1 | 2487 | 480 | 80.5 | globlastp |
| 889 | LNU300 | pine\|10v2\|AA556627_P1 | 2488 | 480 | 80.5 | globlastp |
| 890 | LNU300 | taxus\|10v1\|SRR032523S0008792_T1 | 2489 | 480 | 80.34 | glotblastn |
| 891 | LNU300 | aquilegia\|10v2\|DR928227_P1 | 2490 | 480 | 80.2 | globlastp |
| 892 | LNU300 | cucumber\|09v1\|DN909459_P1 | 2491 | 480 | 80.2 | globlastp |
| 893 | LNU300 | poplar\|10v1\|AI165556_P1 | 2492 | 480 | 80.2 | globlastp |
| 894 | LNU300 | lettuce\|10v1\|DW046351_T1 | 2493 | 480 | 80.19 | glotblastn |
| 895 | LNU300 | eucalyptus\|11v1\|CD668073_P1 | 2494 | 480 | 80.1 | globlastp |
| 896 | LNU300 | melon\|10v1\|AM728431_P1 | 2495 | 480 | 80.1 | globlastp |
| 897 | LNU300 | spurge\|gb161\|BI961995_P1 | 2496 | 480 | 80.1 | globlastp |
| 898 | LNU300 | pseudotsuga\|10v1\|SRR065119S0006823_P1 | 2497 | 480 | 80 | globlastp |
| 899 | LNU300 | soybean\|11v1\|GLYMA10G29000_P1 | 2498 | 480 | 80 | globlastp |
| 900 | LNU300 | soybean\|11v1\|GLYMA17G03430_P1 | 2499 | 480 | 80 | globlastp |
| 901 | LNU300 | soybean\|11v1\|GLYMA20G38320_P1 | 2500 | 480 | 80 | globlastp |
| 902 | LNU300 | spruce\|gb162\|CO216885_P1 | 2501 | 480 | 80 | globlastp |
| 903 | LNU301 | maize\|gb170\|LLBE049863 | 2502 | 481 | 93.02 | glotblastn |
| 904 | LNU301 | sugarcane\|10v1\|BQ533050 | 2503 | 481 | 92.3 | globlastp |
| 905 | LNU301 | switchgrass\|gb167\|FL742623 | 2504 | 481 | 92.2 | globlastp |
| 906 | LNU301 | sorghum\|09v1\|SB06G026660 | 2505 | 481 | 90.8 | globlastp |
| 907 | LNU301 | switchgrass\|gb167\|FL879708 | 2506 | 481 | 90.6 | globlastp |
| 908 | LNU301 | foxtail_millet\|10v2\|SICRP008244_P1 | 2507 | 481 | 88.4 | globlastp |
| 909 | LNU301 | millet\|10v1\|EVO454PM138026_P1 | 2508 | 481 | 87.5 | globlastp |
| 910 | LNU301 | cenchrus\|gb166\|EB660401_P1 | 2509 | 481 | 86.8 | globlastp |
| 911 | LNU302 | solanum_phureja\|09v1\|SPHBG126319 | 2510 | 482 | 99.5 | globlastp |
| 912 | LNU302 | solanum_phureja\|09v1\|SPHAW216568 | 2511 | 482 | 98.5 | globlastp |
| 913 | LNU302 | guizotia\|10v1\|GE556119_T1 | 2512 | 482 | 95.02 | glotblastn |
| 914 | LNU302 | coffea\|10v1\|GFXEF044213X12_P1 | 2513 | 482 | 95 | globlastp |
| 915 | LNU302 | tragopogon\|10v1\|SRR020205S0004258 | 2514 | 482 | 94.5 | globlastp |
| 916 | LNU302 | parthenium\|10v1\|GFXGU120098X5_P1 | 2515 | 482 | 94 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 917 | LNU302 | lettuce\|10v1\|GFXAP007232X13__P1 | 2516 | 482 | 94 | globlastp |
| 918 | LNU302 | artemisia\|10v1\|SRR019254S0016920__T1 | 2517 | 482 | 93.53 | glotblastn |
| 919 | LNU302 | sunflower\|gb162\|CD854704 | 2518 | 482 | 93.5 | globlastp |
| 920 | LNU302 | sunflower\|10v1\|CD854108__P1 | 2518 | 482 | 93.5 | globlastp |
| 921 | LNU302 | cassava\|09v1\|GFXEU117376X11__P1 | 2519 | 482 | 93 | globlastp |
| 922 | LNU302 | dandelion\|10v1\|DR400271__T1 | 2520 | 482 | 92.54 | glotblastn |
| 923 | LNU302 | castorbean\|09v1\|SRR020784S0000611__P1 | 2521 | 482 | 92 | globlastp |
| 924 | LNU302 | ginseng\|10v1\|GFXAY582139X12__P1 | 2522 | 482 | 92 | globlastp |
| 925 | LNU302 | prunus\|gb167\|AJ873078 | 2523 | 482 | 91.5 | globlastp |
| 926 | LNU302 | potato\|10v1\|BQ116812__P1 | 2524 | 482 | 91 | globlastp |
| 927 | LNU302 | oak\|10v1\|GFXGQ998723X1__T1 | — | 482 | 90.59 | glotblastn |
| 928 | LNU302 | peanut\|10v1\|EG030533__T1 | 2525 | 482 | 90.55 | glotblastn |
| 929 | LNU302 | oak\|gb170\|SRR006307S0026883 | 2526 | 482 | 90.1 | globlastp |
| 930 | LNU302 | grape\|gb160\|BM437168__T1 | 2527 | 482 | 90.05 | glotblastn |
| 931 | LNU302 | lotus\|09v1\|CRPLJ002102__T1 | 2528 | 482 | 90.05 | glotblastn |
| 932 | LNU302 | walnuts\|gb166\|EL892734 | 2529 | 482 | 90.05 | glotblastn |
| 933 | LNU302 | cotton\|10v2\|GFXAP009123X10__T1 | — | 482 | 90.05 | glotblastn |
| 934 | LNU302 | cotton\|10v1\|GFXAP009123X11 | 2530 | 482 | 90 | globlastp |
| 935 | LNU302 | grape\|gb160\|CD717918__P1 | 2531 | 482 | 90 | globlastp |
| 936 | LNU302 | lotus\|09v1\|CRPKJ004552__P1 | 2532 | 482 | 90 | globlastp |
| 937 | LNU302 | medicago\|09v1\|BI271493__P1 | 2533 | 482 | 90 | globlastp |
| 938 | LNU302 | lotus\|09v1\|CRPLJ033270__P1 | 2534 | 482 | 89.6 | globlastp |
| 939 | LNU302 | oak\|10v1\|GFXAF132888X1__T1 | — | 482 | 89.6 | glotblastn |
| 940 | LNU302 | medicago\|09v1\|CRPMT030772__T1 | 2535 | 482 | 89.55 | glotblastn |
| 941 | LNU302 | canola\|10v1\|H07661__T1 | 2536 | 482 | 89.05 | glotblastn |
| 942 | LNU302 | citrus\|gb166\|BQ624493__T1 | 2537 | 482 | 89.05 | glotblastn |
| 943 | LNU302 | radish\|gb164\|EV526475 | 2538 | 482 | 89.05 | glotblastn |
| 944 | LNU302 | acacia\|10v1\|FS585044__T1 | — | 482 | 88.67 | glotblastn |
| 945 | LNU302 | arabidopsis_lyrata\|09v1\|JGIAL006381__T1 | 2539 | 482 | 88.56 | glotblastn |
| 946 | LNU302 | arabidopsis\|10v1\|ATCG00380__P1 | 2540 | 482 | 88.1 | globlastp |
| 947 | LNU302 | strawberry\|11v1\|SRR034865S0051981__T1 | 2541 | 482 | 88.06 | glotblastn |
| 948 | LNU302 | aristolochia\|10v1\|GFXAF528920X1__T1 | — | 482 | 88.06 | glotblastn |
| 949 | LNU302 | pigeonpea\|10v1\|GW346536XX1__P1 | 2542 | 482 | 87.1 | globlastp |
| 950 | LNU302 | avocado\|10v1\|CK766348__P1 | 2543 | 482 | 87.1 | globlastp |
| 951 | LNU302 | castorbean\|09v1\|CRPRC006998__T1 | 2544 | 482 | 87.06 | glotblastn |
| 952 | LNU302 | soybean\|gb168\|BE940860 | 2545 | 482 | 87.06 | glotblastn |
| 953 | LNU302 | amborella\|gb166\|CD482397__P1 | 2546 | 482 | 86.1 | globlastp |
| 954 | LNU302 | lotus\|09v1\|CRPLJ009646__P1 | 2547 | 482 | 85.2 | globlastp |
| 955 | LNU302 | orobanche\|10v1\|GFXAJ007723X1__P1 | 2548 | 482 | 84.7 | globlastp |
| 956 | LNU302 | bean\|gb167\|CA903466__P1 | 2549 | 482 | 84.1 | globlastp |
| 957 | LNU302 | pigeonpea\|10v1\|SRR054580S0061346__T1 | 2550 | 482 | 84.08 | glotblastn |
| 958 | LNU302 | soybean\|11v1\|CRPGM014792__T1 | 2551 | 482 | 83.58 | glotblastn |
| 959 | LNU302 | soybean\|gb168\|GD329396 | 2551 | 482 | 83.58 | glotblastn |
| 960 | LNU302 | sunflower\|gb162\|CD854693 | 2552 | 482 | 83.17 | glotblastn |
| 961 | LNU302 | iceplant\|gb164\|CA834888__P1 | 2553 | 482 | 82.8 | globlastp |
| 962 | LNU302 | zostera\|10v1\|AM768670__P1 | 2554 | 482 | 82.1 | globlastp |
| 963 | LNU302 | lotus\|09v1\|CRPLJ011938__P1 | 2555 | 482 | 82.1 | globlastp |
| 964 | LNU302 | nuphar\|gb166\|FD384632__P1 | 2556 | 482 | 81.6 | globlastp |
| 965 | LNU302 | lotus\|09v1\|CRPLJ040445__T1 | 2557 | 482 | 81.09 | glotblastn |
| 966 | LNU302 | solanum_phureja\|09v1\|SPHCRPSP004055 | 2558 | 482 | 80.6 | glotblastn |
| 967 | LNU302 | b_oleracea\|gb161\|DY019834__T1 | 2559 | 482 | 80.1 | glotblastn |
| 968 | LNU303 | sugarcane\|10v1\|CA076623 | 2560 | 483 | 96.3 | globlastp |
| 969 | LNU303 | maize\|gb170\|LLAF055471 | 2561 | 483 | 92 | globlastp |
| 970 | LNU303 | maize\|10v1\|CB280860__P1 | 2562 | 483 | 88 | globlastp |
| 971 | LNU303 | millet\|10v1\|EVO454PM042955__P1 | 2563 | 483 | 85.8 | globlastp |
| 972 | LNU303 | foxtail_millet\|10v2\|EC613241__P1 | 2564 | 483 | 82.9 | globlastp |
| 973 | LNU304 | switchgrass\|gb167\|FE613746 | 2565 | 484 | 85.4 | globlastp |
| 974 | LNU304 | foxtail_millet\|10v2\|SICRP021546__P1 | 2566 | 484 | 84.4 | globlastp |
| 975 | LNU304 | millet\|10v1\|EVO454PM063553__P1 | 2567 | 484 | 83.3 | globlastp |
| 976 | LNU304 | millet\|09v1\|EVO454PM063553 | 2567 | 484 | 83.3 | globlastp |
| 977 | LNU304 | sorghum\|09v1\|SB10G020830 | 2568 | 484 | 83.2 | globlastp |
| 978 | LNU304 | sugarcane\|10v1\|BQ533360 | 2569 | 484 | 83.2 | globlastp |
| 979 | LNU304 | cenchrus\|gb166\|BM084119__P1 | 2570 | 484 | 82.3 | globlastp |
| 980 | LNU304 | maize\|gb170\|LLBM335916 | 2571 | 484 | 82.3 | globlastp |
| 981 | LNU304 | maize\|gb170\|LLAI855177 | 2572 | 484 | 82.1 | globlastp |
| 982 | LNU304 | wheat\|10v2\|BG604828__P1 | 2573 | 484 | 81.1 | globlastp |
| 983 | LNU304 | wheat\|gb164\|BG604828 | 2573 | 484 | 81.1 | globlastp |
| 984 | LNU304 | cynodon\|10v1\|ES294050__P1 | 2574 | 484 | 80.6 | globlastp |
| 985 | LNU304 | maize\|10v1\|BM501421__P1 | 2575 | 484 | 80 | globlastp |
| 986 | LNU304 | maize\|gb170\|BM501421 | 2576 | 484 | 80 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 987 | LNU304 | wheat\|10v2\|BF478734_P1 | 2577 | 484 | 80 | globlastp |
| 988 | LNU304 | wheat\|gb164\|BF478734 | 2577 | 484 | 80 | globlastp |
| 989 | LNU304 | wheat\|10v2\|CA620694_P1 | 2577 | 484 | 80 | globlastp |
| 990 | LNU304 | wheat\|gb164\|CA620694 | 2577 | 484 | 80 | globlastp |
| 991 | LNU305 | wheat\|10v2\|BE429958_P1 | 2578 | 485 | 90.5 | globlastp |
| 992 | LNU305 | wheat\|gb164\|BE429958 | 2579 | 485 | 89.8 | globlastp |
| 993 | LNU305 | pseudoroegneria\|gb167\|FF355165 | 2580 | 485 | 87.5 | globlastp |
| 994 | LNU305 | leymus\|gb166\|EG401835_P1 | 2581 | 485 | 80.4 | globlastp |
| 995 | LNU306 | arabidopsis_lyrata\|09v1\|JGIAL008724_P1 | 2582 | 486 | 95 | globlastp |
| 996 | LNU306 | radish\|gb164\|EV545889 | 2583 | 486 | 83.4 | globlastp |
| 997 | LNU306 | canola\|10v1\|EV004258_P1 | 2584 | 486 | 82.5 | globlastp |
| 998 | LNU307 | sorghum\|09v1\|SB04G000775 | 2585 | 487 | 81.46 | glotblastn |
| 999 | LNU308 | arabidopsis_lyrata\|09v1\|JGIAL011758_P1 | 2586 | 488 | 97.9 | globlastp |
| 1000 | LNU308 | thellungiella\|gb167\|BY803273 | 2587 | 488 | 91.6 | globlastp |
| 1001 | LNU308 | radish\|gb164\|EX749633 | 2588 | 488 | 91.1 | globlastp |
| 1002 | LNU308 | radish\|gb164\|EX750313 | 2589 | 488 | 91.1 | globlastp |
| 1003 | LNU308 | canola\|10v1\|CD822987_P1 | 2590 | 488 | 88.9 | globlastp |
| 1004 | LNU308 | b_oleracea\|gb161\|DY030174_P1 | 2591 | 488 | 88.4 | globlastp |
| 1005 | LNU308 | canola\|10v1\|EE465545_P1 | 2591 | 488 | 88.4 | globlastp |
| 1006 | LNU308 | cleome_spinosa\|10v1\|GR931012_P1 | 2592 | 488 | 84.7 | globlastp |
| 1007 | LNU309 | sorghum\|09v1\|SB03G036080 | 2593 | 489 | 85.6 | glotblastn |
| 1007 | LNU930_H3 | sorghum\|09v1\|SB03G036080 | 2593 | 676 | 92.3 | globlastp |
| 1008 | LNU309 | foxtail_millet\|10v2\|SICRP027522_T1 | 2594 | 489 | 83.12 | glotblastn |
| 1008 | LNU309_H3 | foxtail_millet\|10v2\|SICRP027522_T1 | 2594 | 715 | 85.71 | glotblastn |
| 1009 | LNU309 | brachypodium\|09v1\|DV479613_T1 | 2595 | 489 | 80.03 | glotblastn |
| 1009 | LNU309_H3 | brachypodium\|09v1\|DV479613_T1 | 2595 | 715 | 84.76 | glotblastn |
| 1010 | LNU311 | sugarcane\|10v1\|CA183153 | 2596 | 491 | 80.95 | glotblastn |
| 1011 | LNU315 | pseudoroegneria\|gb167\|FF344590 | 2597 | 494 | 98.1 | globlastp |
| 1012 | LNU315 | wheat\|gb164\|BE604654 | 2598 | 494 | 97.5 | globlastp |
| 1013 | LNU315 | foxtail_millet\|10v2\|FXTSLX00113403D1_P1 | 2599 | 494 | 96.2 | globlastp |
| 1014 | LNU315 | wheat\|10v2\|CA598385_P1 | 2600 | 494 | 95.6 | globlastp |
| 1015 | LNU315 | wheat\|10v2\|CJ898820_P1 | 2601 | 494 | 94.9 | globlastp |
| 1016 | LNU315 | wheat\|gb164\|BE606227 | 2601 | 494 | 94.9 | globlastp |
| 1017 | LNU315 | barley\|10v1\|BE420626 | 2602 | 494 | 91.9 | globlastp |
| 1018 | LNU315 | barley\|10v2\|BE420626_P1 | 2602 | 494 | 91.9 | globlastp |
| 1019 | LNU315 | wheat\|10v2\|DR735055_T1 | 2603 | 494 | 87.97 | glotblastn |
| 1020 | LNU315 | wheat\|gb164\|DR735055 | 2603 | 494 | 87.97 | glotblastn |
| 1021 | LNU317 | sorghum\|09v1\|SB09G020280 | 2604 | 496 | 85.8 | globlastp |
| 1022 | LNU318 | wheat\|10v2\|BE406534_P1 | 2605 | 497 | 97.6 | globlastp |
| 1023 | LNU318 | wheat\|gb164\|BE406534 | 2605 | 497 | 97.6 | globlastp |
| 1024 | LNU318 | leymus\|gb166\|EG378119_P1 | 2606 | 497 | 95.9 | globlastp |
| 1025 | LNU318 | wheat\|10v2\|CA602663_P1 | 2607 | 497 | 94.3 | globlastp |
| 1026 | LNU318 | wheat\|gb164\|CA602663 | 2607 | 497 | 94.3 | globlastp |
| 1027 | LNU318 | barley\|10v1\|BE412753 | 2608 | 497 | 92.7 | globlastp |
| 1028 | LNU318 | barley\|10v2\|BE412753_P1 | 2608 | 497 | 92.7 | globlastp |
| 1029 | LNU318 | oat\|10v1\|GO587598 | 2609 | 497 | 86.2 | globlastp |
| 1030 | LNU318 | oat\|10v2\|GR319951_P1 | 2610 | 497 | 85.4 | globlastp |
| 1031 | LNU318 | oat\|10v2\|GR332951_P1 | 2611 | 497 | 84.7 | globlastp |
| 1032 | LNU318 | oat\|10v1\|GR319951 | 2611 | 497 | 84.7 | globlastp |
| 1033 | LNU318 | brachypodium\|09v1\|GT768729_P1 | 2612 | 497 | 82.1 | globlastp |
| 1034 | LNU319 | sugarcane\|10v1\|CA070744 | 2613 | 498 | 97.7 | globlastp |
| 1035 | LNU319 | switchgrass\|gb167\|FL790597 | 2614 | 498 | 94.2 | globlastp |
| 1036 | LNU319 | maize\|10v1\|AW052987_P1 | 2615 | 498 | 93.1 | globlastp |
| 1037 | LNU319 | switchgrass\|gb167\|FE614987 | 2616 | 498 | 93.1 | globlastp |
| 1038 | LNU319 | millet\|10v1\|EVO454PM019765_P1 | 2617 | 498 | 90.8 | globlastp |
| 1039 | LNU319 | rice\|gb170\|OS03G52730 | 2618 | 498 | 87.9 | globlastp |
| 1040 | LNU319 | foxtail_millet\|10v2\|FXTRMSLX00487607D1_P1 | 2619 | 498 | 87.1 | globlastp |
| 1041 | LNU319 | oat\|10v2\|SRR020741S0030408_P1 | 2620 | 498 | 85 | globlastp |
| 1042 | LNU319 | oat\|10v1\|CN815589 | 2621 | 498 | 85 | globlastp |
| 1043 | LNU319 | wheat\|gb164\|CA659883 | 2622 | 498 | 84.7 | globlastp |
| 1044 | LNU319 | brachypodium\|09v1\|DV486914_P1 | 2623 | 498 | 83.8 | globlastp |
| 1045 | LNU319 | wheat\|gb164\|BG312713 | 2624 | 498 | 83.5 | globlastp |
| 1046 | LNU319 | wheat\|gb164\|CA697520 | 2625 | 498 | 83.5 | globlastp |
| 1047 | LNU319 | wheat\|10v2\|BG312713_P1 | 2626 | 498 | 83.5 | globlastp |
| 1048 | LNU319 | barley\|10v2\|BF621514_P1 | 2627 | 498 | 81.6 | globlastp |
| 1049 | LNU322 | wheat\|10v2\|BE426358_P1 | 2628 | 499 | 95.2 | globlastp |
| 1050 | LNU322 | wheat\|gb164\|BE426358 | 2628 | 499 | 95.2 | globlastp |
| 1051 | LNU322 | wheat\|10v2\|BF293712_T1 | 2629 | 499 | 88.27 | glotblastn |
| 1052 | LNU322 | oat\|10v2\|CN817938_P1 | 2630 | 499 | 82.6 | globlastp |
| 1053 | LNU322 | oat\|10v1\|GR329806 | 2630 | 499 | 82.6 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1054 | LNU322 | brachypodium\|09v1\|GT790865_P1 | 2631 | 499 | 81.9 | globlastp |
| 1054 | LNU420 | brachypodium\|09v1\|GT790865_P1 | 2631 | 586 | 80.5 | globlastp |
| 1055 | LNU324 | maize\|10v1\|BE122952_P1 | 2632 | 501 | 95.5 | globlastp |
| 1056 | LNU324 | maize\|gb170\|BE122952 | 2632 | 501 | 95.5 | globlastp |
| 1057 | LNU324 | maize\|gb170\|AI600531 | 2633 | 501 | 93.5 | globlastp |
| 1058 | LNU324 | maize\|10v1\|AI600531_P1 | 2633 | 501 | 93.5 | globlastp |
| 1059 | LNU324 | switchgrass\|gb167\|FE601004 | 2634 | 501 | 91 | globlastp |
| 1060 | LNU324 | maize\|gb170\|LLAY104119 | 2635 | 501 | 88.98 | glotblastn |
| 1061 | LNU324 | millet\|10v1\|CD726160_P1 | 2636 | 501 | 88.4 | globlastp |
| 1062 | LNU324 | brachypodium\|09v1\|GT764807_P1 | 2637 | 501 | 87.1 | globlastp |
| 1063 | LNU324 | oat\|10v2\|GR352457_P1 | 2638 | 501 | 86.8 | globlastp |
| 1064 | LNU324 | wheat\|10v2\|BE429701_P1 | 2639 | 501 | 85.7 | globlastp |
| 1065 | LNU324 | wheat\|gb164\|BE429701 | 2640 | 501 | 85.7 | globlastp |
| 1066 | LNU324 | rice\|gb170\|OS12G37960 | 2641 | 501 | 85.4 | globlastp |
| 1067 | LNU324 | barley\|10v2\|BF625656_P1 | 2642 | 501 | 85.1 | globlastp |
| 1068 | LNU324 | leymus\|gb166\|EG374667_T1 | 2643 | 501 | 84.79 | glotblastn |
| 1069 | LNU324 | pseudoroegneria\|gb167\|FF341068 | 2644 | 501 | 83.1 | globlastp |
| 1070 | LNU327 | wheat\|10v2\|CV770918_P1 | 2645 | 503 | 97.1 | globlastp |
| 1071 | LNU327 | barley\|10v1\|BG415996 | 2646 | 503 | 95.2 | globlastp |
| 1072 | LNU327 | barley\|10v2\|BG415996_P1 | 2646 | 503 | 95.2 | globlastp |
| 1073 | LNU328 | solanum_phureja\|09v1\|SPHBG128098 | 2647 | 504 | 89.6 | globlastp |
| 1074 | LNU330 | solanum_phureja\|09v1\|SPHAW096846 | 2648 | 506 | 97.4 | globlastp |
| 1075 | LNU330 | potato\|10v1\|AW096846_P1 | 2649 | 506 | 96.6 | globlastp |
| 1076 | LNU330 | pepper\|gb171\|GD057272_P1 | 2650 | 506 | 81.1 | globlastp |
| 1077 | LNU330 | tobacco\|gb162\|AM786444 | 2651 | 506 | 80.79 | glotblastn |
| 1078 | LNU331 | solanum_phureja\|09v1\|SPHAW031707 | 2652 | 507 | 96.5 | globlastp |
| 1079 | LNU331 | potato\|10v1\|BQ519367_P1 | 2653 | 507 | 95.9 | globlastp |
| 1080 | LNU332 | sorghum\|09v1\|SB03G028460 | 2654 | 508 | 92.6 | globlastp |
| 1081 | LNU332 | maize\|gb170\|AW231427 | 2655 | 508 | 90.8 | globlastp |
| 1082 | LNU332 | maize\|10v1\|AW231427_P1 | 2656 | 508 | 90.6 | globlastp |
| 1083 | LNU332 | rice\|gb170\|OS01G43580 | 2657 | 508 | 84.8 | globlastp |
| 1084 | LNU332 | brachypodium\|09v1\|GT760062_T1 | 2658 | 508 | 81.44 | glotblastn |
| 1085 | LNU333 | wheat\|10v2\|BE418424_P1 | 2659 | 509 | 94.6 | globlastp |
| 1086 | LNU333 | wheat\|gb164\|BE418424 | 2659 | 509 | 94.6 | globlastp |
| 1087 | LNU333 | wheat\|10v2\|BI751337_P1 | 2660 | 509 | 91.2 | globlastp |
| 1088 | LNU333 | wheat\|gb164\|BI751337 | 2660 | 509 | 91.2 | globlastp |
| 1089 | LNU333 | pseudoroegneria\|gb167\|FF342941 | 2661 | 509 | 89.1 | globlastp |
| 1090 | LNU333 | barley\|10v1\|BF621665 | 2662 | 509 | 88.1 | globlastp |
| 1091 | LNU333 | barley\|10v2\|BF621665_P1 | 2662 | 509 | 88.1 | globlastp |
| 1092 | LNU333 | oat\|10v2\|GR329274_P1 | 2663 | 509 | 80.3 | globlastp |
| 1093 | LNU333 | oat\|10v1\|GR329274 | 2663 | 509 | 80.3 | globlastp |
| 1094 | LNU335 | wheat\|gb164\|BF483351 | 2664 | 510 | 97 | globlastp |
| 1095 | LNU335 | barley\|10v1\|BI951100 | 2665 | 510 | 91.2 | globlastp |
| 1096 | LNU335 | barley\|10v2\|BI951100_P1 | 2665 | 510 | 91.2 | globlastp |
| 1097 | LNU335 | brachypodium\|09v1\|GT787495_P1 | 2666 | 510 | 83.5 | globlastp |
| 1098 | LNU335 | wheat\|10v2\|BF202225_T1 | 2667 | 510 | 82.22 | glotblastn |
| 1099 | LNU336 | solanum_phureja\|09v1\|SPHAI773791 | 2668 | 511 | 98.6 | globlastp |
| 1100 | LNU336 | tobacco\|gb162\|AB003038 | 2669 | 511 | 95.2 | globlastp |
| 1101 | LNU337 | cassava\|09v1\|JGICASSAVA31518VALIDM1_P1 | 2670 | 512 | 84.9 | globlastp |
| 1102 | LNU337 | cacao\|10v1\|CU502884_P1 | 2671 | 512 | 83.4 | globlastp |
| 1103 | LNU337 | castorbean\|09v1\|EG671098_P1 | 2672 | 512 | 83.4 | globlastp |
| 1104 | LNU337 | clementine\|11v1\|CV885061_P1 | 2673 | 512 | 82.3 | globlastp |
| 1105 | LNU337 | orange\|11v1\|CV885061_P1 | 2674 | 512 | 82.3 | globlastp |
| 1106 | LNU337 | strawberry\|11v1\|EX671413_P1 | 2675 | 512 | 82 | globlastp |
| 1107 | LNU337 | oak\|10v1\|DN949924_P1 | 2676 | 512 | 81.2 | globlastp |
| 1108 | LNU337 | prunus\|10v1\|CN494497_P1 | 2677 | 512 | 81.2 | globlastp |
| 1109 | LNU337 | cotton\|10v2\|SRR032368S0318405_P1 | 2678 | 512 | 80.2 | globlastp |
| 1110 | LNU337 | cotton\|10v1\|CO105456 | 2679 | 512 | 80.1 | globlastp |
| 1111 | LNU337 | poplar\|10v1\|CX170984_P1 | 2680 | 512 | 80 | globlastp |
| 1112 | LNU340 | barley\|10v1\|AJ476977 | 2681 | 514 | 99.6 | globlastp |
| 1113 | LNU340 | barley\|10v2\|AJ476977_P1 | 2681 | 514 | 99.6 | globlastp |
| 1114 | LNU340 | oat\|10v1\|CN820997_P1 | 2682 | 514 | 92.1 | globlastp |
| 1115 | LNU340 | brachypodium\|09v1\|GT772953_P1 | 2683 | 514 | 87.4 | globlastp |
| 1116 | LNU340 | rice\|gb170\|OS12G02380 | 2684 | 514 | 82.2 | globlastp |
| 1117 | LNU340 | rice\|gb170\|OS11G02450 | 2685 | 514 | 81.7 | globlastp |
| 1118 | LNU341 | leymus\|gb166\|EG382663_P1 | 2686 | 515 | 88.2 | globlastp |
| 1119 | LNU342 | potato\|10v1\|BI176929_P1 | 2687 | 516 | 94.3 | globlastp |
| 1120 | LNU342 | solanum_phureja\|09v1\|SPHBG123334 | 2688 | 516 | 94 | globlastp |
| 1121 | LNU342 | eggplant\|10v1\|FS005150_P1 | 2689 | 516 | 88.6 | globlastp |
| 1122 | LNU342 | tobacco\|gb162\|DW000438 | 2690 | 516 | 85.8 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1123 | LNU342 | pepper\|gb171\|BM064975_P1 | 2691 | 516 | 85.5 | globlastp |
| 1124 | LNU343 | barley\|10v2\|BF624427_P1 | 2692 | 517 | 99.2 | globlastp |
| 1125 | LNU343 | pseudoroegneria\|gb167\|FF354777 | 2693 | 517 | 98.5 | globlastp |
| 1126 | LNU343 | wheat\|10v2\|SRR043332S0002679_P1 | 2694 | 517 | 97 | globlastp |
| 1127 | LNU343 | wheat\|gb164\|AL822523 | 2694 | 517 | 97 | globlastp |
| 1128 | LNU343 | oat\|10v2\|SRR020741S0012373_P1 | 2695 | 517 | 88 | globlastp |
| 1129 | LNU344 | barley\|10v1\|AV922746 | 2696 | 518 | 97.1 | globlastp |
| 1129 | LNU347 | barley\|10v1\|AV922746 | 2696 | 521 | 81.4 | globlastp |
| 1130 | LNU344 | barley\|10v1\|BE437694 | 2696 | 518 | 97.1 | globlastp |
| 1130 | LNU347 | barley\|10v1\|BE437694 | 2696 | 521 | 81.4 | globlastp |
| 1131 | LNU344 | brachypodium\|09v1\|GT770285_P1 | 2696 | 518 | 97.1 | globlastp |
| 1131 | LNU347 | brachypodium\|09v1\|GT770285_P1 | 2696 | 521 | 81.4 | globlastp |
| 1132 | LNU344 | oat\|10v1\|SRR020741S0153418 | 2696 | 518 | 97.1 | globlastp |
| 1132 | LNU347 | oat\|10v1\|SRR020741S0153418 | 2696 | 521 | 81.4 | globlastp |
| 1133 | LNU344 | wheat\|10v2\|BE404009_P1 | 2696 | 518 | 97.1 | globlastp |
| 1133 | LNU347 | wheat\|10v2\|BE404009_P1 | 2696 | 521 | 81.4 | globlastp |
| 1134 | LNU344 | wheat\|gb164\|BE404009 | 2696 | 518 | 97.1 | globlastp |
| 1134 | LNU347 | wheat\|gb164\|BE404009 | 2696 | 521 | 81.4 | globlastp |
| 1135 | LNU344 | wheat\|10v2\|BE605093_P1 | 2696 | 518 | 97.1 | globlastp |
| 1135 | LNU347 | wheat\|10v2\|BE605093_P1 | 2696 | 521 | 81.4 | globlastp |
| 1136 | LNU344 | wheat\|gb164\|BE605093 | 2696 | 518 | 97.1 | globlastp |
| 1136 | LNU347 | wheat\|gb164\|BE605093 | 2696 | 521 | 81.4 | globlastp |
| 1137 | LNU344 | wheat\|gb164\|CA627002 | 2696 | 518 | 97.1 | globlastp |
| 1137 | LNU347 | wheat\|gb164\|CA627002 | 2696 | 521 | 81.4 | globlastp |
| 1138 | LNU344 | barley\|10v2\|BE437694_P1 | 2696 | 518 | 97.1 | globlastp |
| 1138 | LNU347 | barley\|10v2\|BE437694_P1 | 2696 | 521 | 81.4 | globlastp |
| 1139 | LNU344 | oat\|10v2\|GR334207_P1 | 2697 | 518 | 95.7 | globlastp |
| 1139 | LNU347 | oat\|10v2\|GR334207_P1 | 2697 | 521 | 80 | globlastp |
| 1140 | LNU344 | oat\|10v1\|GR334207 | 2697 | 518 | 95.7 | globlastp |
| 1140 | LNU347 | oat\|10v1\|GR334207 | 2697 | 521 | 80 | globlastp |
| 1141 | LNU344 | fescue\|gb161\|DT700305_P1 | 2698 | 518 | 94.2 | globlastp |
| 1141 | LNU347 | fescue\|gb161\|DT700305_P1 | 2698 | 521 | 81.4 | globlastp |
| 1142 | LNU344 | rye\|gb164\|BE637285 | 2699 | 518 | 91.3 | glotblastn |
| 1143 | LNU344 | rice\|gb170\|OS05G01290 | 2700 | 518 | 87 | globlastp |
| 1143 | LNU347 | rice\|gb170\|OS05G01290 | 2700 | 521 | 88.6 | globlastp |
| 1144 | LNU344 | foxtail_millet\|10v2\|FXTSLX00736715D2_T1 | 2701 | 518 | 85.51 | glotblastn |
| 1145 | LNU344 | cynodon\|10v1\|ES296145_P1 | 2702 | 518 | 84.3 | globlastp |
| 1145 | LNU347 | cynodon\|10v1\|ES296145_P1 | 2702 | 521 | 87.1 | globlastp |
| 1146 | LNU344 | foxtail_millet\|10v2\|FXTRMSLX00208339D1_P1 | 2703 | 518 | 81.4 | globlastp |
| 1146 | LNU347 | foxtail_millet\|10v2\|FXTRMSLX00208339D1_P1 | 2703 | 521 | 88.6 | globlastp |
| 1147 | LNU345 | wheat\|gb164\|BG604995 | 2704 | 519 | 95.7 | globlastp |
| 1148 | LNU345 | wheat\|10v2\|BG604995_P1 | 2705 | 519 | 94.9 | globlastp |
| 1149 | LNU345 | barley\|10v1\|BI954292 | 2706 | 519 | 92.2 | globlastp |
| 1150 | LNU345 | barley\|10v2\|BI954292_P1 | 2706 | 519 | 92.2 | globlastp |
| 1151 | LNU345 | pseudoroegneria\|gb167\|FF342688 | 2707 | 519 | 88.8 | globlastp |
| 1152 | LNU345 | wheat\|gb164\|CA719534 | 2708 | 519 | 87.1 | globlastp |
| 1153 | LNU345 | leymus\|gb166\|EG386923_T1 | 2709 | 519 | 82.64 | glotblastn |
| 1154 | LNU346 | sugarcane\|10v1\|CA067223 | 2710 | 520 | 96.3 | globlastp |
| 1155 | LNU346 | maize\|10v1\|AI676894_P1 | 2711 | 520 | 94.9 | globlastp |
| 1156 | LNU346 | maize\|gb170\|LLAI676894 | 2711 | 520 | 94.9 | globlastp |
| 1157 | LNU346 | maize\|10v1\|AI677358_P1 | 2712 | 520 | 92.5 | globlastp |
| 1158 | LNU346 | maize\|gb170\|AI677358 | 2713 | 520 | 92.5 | globlastp |
| 1159 | LNU346 | foxtail_millet\|10v2\|SICRP019925_P1 | 2714 | 520 | 91.2 | globlastp |
| 1160 | LNU346 | millet\|10v1\|EVO454PM028709_P1 | 2715 | 520 | 90.4 | globlastp |
| 1161 | LNU346 | switchgrass\|gb167\|FE610979 | 2716 | 520 | 90.1 | globlastp |
| 1162 | LNU346 | rice\|gb170\|OS05G46230 | 2717 | 520 | 85.9 | globlastp |
| 1163 | LNU346 | brachypodium\|09v1\|GT773225_P1 | 2718 | 520 | 84.6 | globlastp |
| 1164 | LNU346 | oat\|10v2\|GO586894_P1 | 2719 | 520 | 82.9 | globlastp |
| 1165 | LNU346 | oat\|10v1\|GO586894 | 2719 | 520 | 82.9 | globlastp |
| 1166 | LNU346 | wheat\|10v2\|BQ238470_P1 | 2720 | 520 | 82.8 | globlastp |
| 1167 | LNU346 | wheat\|gb164\|BE400556 | 2720 | 520 | 82.8 | globlastp |
| 1168 | LNU346 | leymus\|gb166\|EG381704_P1 | 2721 | 520 | 82.1 | globlastp |
| 1169 | LNU346 | wheat\|gb164\|BQ238470 | 2722 | 520 | 80.64 | glotblastn |
| 1170 | LNU346 | millet\|09v1\|CD726327 | 2723 | 520 | 80 | glotblastn |
| 1171 | LNU347 | maize\|gb170\|LLFL008896 | 2724 | 521 | 92.9 | globlastp |
| 1172 | LNU347 | maize\|gb170\|BG836075 | 2725 | 521 | 91.4 | globlastp |
| 1173 | LNU347 | maize\|10v1\|BG836075_P1 | 2725 | 521 | 91.4 | globlastp |
| 1174 | LNU347 | millet\|09v1\|EVO454PM007718 | 2726 | 521 | 84.3 | globlastp |
| 1175 | LNU347 | millet\|10v1\|EVO454PM007718_P1 | 2726 | 521 | 84.3 | globlastp |
| 1176 | LNU347 | switchgrass\|gb167\|FL737420 | 2727 | 521 | 82.86 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1177 | LNU348 | sugarcane\|10v1\|CA103796 | 2728 | 522 | 87.9 | globlastp |
| 1178 | LNU348 | maize\|10v1\|EU942853_P1 | 2729 | 522 | 85.6 | globlastp |
| 1179 | LNU348 | maize\|gb170\|EU942853 | 2729 | 522 | 85.6 | globlastp |
| 1180 | LNU348 | sorghum\|09v1\|SB03G009900 | 2730 | 522 | 85.5 | globlastp |
| 1181 | LNU348 | foxtail_millet\|10v2\|SICRP040741_P1 | 2731 | 522 | 82.4 | globlastp |
| 1182 | LNU348 | millet\|10v1\|PMSLX0001425D2_P1 | 2732 | 522 | 81 | globlastp |
| 1183 | LNU349 | bean\|gb167\|BQ481480_P1 | 2733 | 523 | 96 | globlastp |
| 1184 | LNU349 | soybean\|11v1\|GLYMA15G06990_P1 | 2734 | 523 | 96 | globlastp |
| 1185 | LNU349 | soybean\|gb168\|AW687261 | 2734 | 523 | 96 | globlastp |
| 1186 | LNU349 | pigeonpea\|10v1\|SRR054580S0126664_P1 | 2735 | 523 | 93.8 | globlastp |
| 1187 | LNU349 | cowpea\|gb166\|FF395146_P1 | 2736 | 523 | 93 | globlastp |
| 1188 | LNU349 | liquorice\|gb171\|FS268558_P1 | 2737 | 523 | 83.4 | globlastp |
| 1189 | LNU349 | peanut\|10v1\|GO260668_P1 | 2738 | 523 | 83.2 | globlastp |
| 1190 | LNU349 | peanut\|gb171\|ES752840 | 2739 | 523 | 83.2 | globlastp |
| 1191 | LNU349 | lotus\|09v1\|LLBW601593_P1 | 2740 | 523 | 81.2 | globlastp |
| 1192 | LNU351 | barley\|10v1\|BI948837 | 2741 | 525 | 98 | globlastp |
| 1193 | LNU351 | barley\|10v2\|BI948837_P1 | 2741 | 525 | 98 | globlastp |
| 1194 | LNU351 | wheat\|10v2\|BE419429_P1 | 2742 | 525 | 97.2 | globlastp |
| 1195 | LNU351 | wheat\|gb164\|BE419429 | 2742 | 525 | 97.2 | globlastp |
| 1196 | LNU351 | oat\|10v2\|CN818075_P1 | 2743 | 525 | 95.7 | globlastp |
| 1197 | LNU351 | oat\|10v1\|CN818075 | 2743 | 525 | 95.7 | globlastp |
| 1198 | LNU351 | fescue\|gb161\|DT694710_P1 | 2744 | 525 | 94.6 | globlastp |
| 1199 | LNU351 | brachypodium\|09v1\|DV473443_P1 | 2745 | 525 | 92.2 | globlastp |
| 1200 | LNU351 | cynodon\|10v1\|ES299286_P1 | 2746 | 525 | 90.7 | globlastp |
| 1201 | LNU351 | millet\|10v1\|EVO454PM006850_P1 | 2747 | 525 | 89.9 | globlastp |
| 1201 | LNU424 | millet\|10v1\|EVO454PM006850_T1 | 2747 | 590 | 80.24 | glotblastn |
| 1202 | LNU351 | foxtail_millet\|10v2\|OXFXTSLX00031185D1T1_P1 | 2748 | 525 | 89.5 | globlastp |
| 1203 | LNU351 | sugarcane\|10v1\|CA119908 | 2749 | 525 | 89.5 | globlastp |
| 1203 | LNU424 | sugarcane\|10v1\|CA119908 | 2749 | 590 | 81.03 | glotblastn |
| 1204 | LNU351 | switchgrass\|gb167\|FL735769 | 2750 | 525 | 89.1 | globlastp |
| 1205 | LNU351 | sorghum\|09v1\|SB01G003100 | 2751 | 525 | 88.7 | globlastp |
| 1206 | LNU351 | cenchrus\|gb166\|EB657417_P1 | 2752 | 525 | 88.3 | globlastp |
| 1207 | LNU351 | pseudoroegneria\|gb167\|FF361410 | 2753 | 525 | 88.2 | globlastp |
| 1208 | LNU351 | rice\|gb170\|OS03G60740 | 2754 | 525 | 87.9 | globlastp |
| 1209 | LNU351 | wheat\|gb164\|BE425410 | 2755 | 525 | 87.6 | globlastp |
| 1210 | LNU351 | maize\|10v1\|AA979757_P1 | 2756 | 525 | 87.5 | globlastp |
| 1211 | LNU351 | maize\|gb170\|AA979757 | 2756 | 525 | 87.5 | globlastp |
| 1212 | LNU351 | millet\|09v1\|EVO0454PM006850 | 2757 | 525 | 86.6 | globlastp |
| 1213 | LNU351 | switchgrass\|gb167\|DN145627 | 2758 | 525 | 85.6 | globlastp |
| 1214 | LNU351 | melon\|10v1\|AM724047_P1 | 2759 | 525 | 85.5 | globlastp |
| 1214 | LNU424 | melon\|10v1\|AM724047_P1 | 2759 | 590 | 81.6 | globlastp |
| 1215 | LNU351 | pigeonpea\|10v1\|GW351947_P1 | 2760 | 525 | 85.1 | globlastp |
| 1216 | LNU351 | cucumber\|09v1\|CV004115_P1 | 2761 | 525 | 84.8 | globlastp |
| 1216 | LNU424 | cucumber\|09v1\|CV004115_P1 | 2761 | 590 | 81.2 | globlastp |
| 1217 | LNU351 | cassava\|09v1\|DV444815_P1 | 2762 | 525 | 83.5 | globlastp |
| 1218 | LNU351 | lotus\|09v1\|LLBI419507_P1 | 2763 | 525 | 83.1 | globlastp |
| 1219 | LNU351 | medicago\|09v1\|LLAL374329_P1 | 2764 | 525 | 83.1 | globlastp |
| 1220 | LNU351 | peanut\|10v1\|EE125913_P1 | 2765 | 525 | 82.7 | globlastp |
| 1221 | LNU351 | peanut\|10v1\|ES703043_P1 | 2766 | 525 | 82.7 | globlastp |
| 1222 | LNU351 | pepper\|gb171\|BM061311_P1 | 2767 | 525 | 82.7 | globlastp |
| 1222 | LNU424 | pepper\|gb171\|BM061311_P1 | 2767 | 590 | 80.8 | globlastp |
| 1223 | LNU351 | melon\|gb165\|AM724047 | 2768 | 525 | 82.68 | glotblastn |
| 1224 | LNU351 | ginger\|gb164\|DY345448_P1 | 2769 | 525 | 82.4 | globlastp |
| 1225 | LNU351 | peanut\|gb171\|EC365304 | 2770 | 525 | 82.4 | globlastp |
| 1226 | LNU351 | chestnut\|gb170\|SRR006295S0003362_P1 | 2771 | 525 | 82.4 | globlastp |
| 1226 | LNU424 | chestnut\|gb170\|SRR006295S0003362_P1 | 2771 | 590 | 80.8 | globlastp |
| 1227 | LNU351 | potato\|10v1\|BE921048_P1 | 2772 | 525 | 82.4 | globlastp |
| 1227 | LNU424 | potato\|10v1\|BE921048_P1 | 2772 | 590 | 80 | globlastp |
| 1228 | LNU351 | solanum_phureja\|09v1\|SPHAI484349 | 2772 | 525 | 82.4 | globlastp |
| 1228 | LNU424 | solanum_phureja\|09v1\|SPHAI484349 | 2772 | 590 | 80 | globlastp |
| 1229 | LNU351 | cleome_gynandra\|10v1\|SRR015532S0006049_T1 | 2773 | 525 | 82.28 | glotblastn |
| 1229 | LNU424 | cleome_gynandra\|10v1\|SRR015532S0006049_T1 | 2773 | 590 | 80.63 | glotblastn |
| 1230 | LNU351 | cleome_spinosa\|10v1\|SRR015531S0002685_T1 | 2774 | 525 | 82.28 | glotblastn |
| 1230 | LNU424 | cleome_spinosa\|10v1\|SRR015531S0002685_T1 | 2774 | 590 | 80.63 | glotblastn |
| 1231 | LNU351 | eggplant\|10v1\|FS009160_P1 | 2775 | 525 | 82 | globlastp |
| 1232 | LNU351 | sunflower\|10v1\|DY916239_P1 | 2776 | 525 | 82 | globlastp |
| 1233 | LNU351 | sunflower\|gb162\|DY916239 | 2776 | 525 | 82 | globlastp |
| 1234 | LNU351 | eucalyptus\|11v1\|CD669334_P1 | 2777 | 525 | 82 | globlastp |
| 1235 | LNU351 | cassava\|09v1\|CK644785_P1 | 2778 | 525 | 82 | globlastp |
| 1235 | LNU424 | cassava\|09v1\|CK644785_P1 | 2778 | 590 | 81.6 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1236 | LNU351 | aristolochia\|10v1\|SRR039082S0026666_P1 | 2779 | 525 | 81.6 | globlastp |
| 1237 | LNU351 | artemisia\|10v1\|EY044641_P1 | 2780 | 525 | 81.6 | globlastp |
| 1238 | LNU351 | eucalyptus\|gb166\|CD669334 | 2781 | 525 | 81.6 | globlastp |
| 1239 | LNU351 | oak\|10v1\|CU657816_P1 | 2782 | 525 | 81.6 | globlastp |
| 1240 | LNU351 | oak\|gb170\|CU657816 | 2783 | 525 | 81.6 | globlastp |
| 1240 | LNU424 | oak\|gb170\|CU657816 | 2783 | 590 | 80.4 | globlastp |
| 1241 | LNU351 | canola\|10v1\|BQ704593_T1 | 2784 | 525 | 81.57 | glotblastn |
| 1242 | LNU351 | petunia\|gb171\|CV296541_T1 | 2785 | 525 | 81.57 | glotblastn |
| 1243 | LNU351 | radish\|gb164\|EV535078 | 2786 | 525 | 81.57 | glotblastn |
| 1244 | LNU351 | cowpea\|gb166\|FF382538_P1 | 2787 | 525 | 81.2 | globlastp |
| 1245 | LNU351 | tomato\|09v1\|BG130491 | 2788 | 525 | 81.2 | globlastp |
| 1246 | LNU351 | nasturtium\|10v1\|GH170446_P1 | 2789 | 525 | 81.2 | globlastp |
| 1246 | LNU424 | nasturtium\|10v1\|GH170446_P1 | 2789 | 590 | 81.6 | globlastp |
| 1247 | LNU351 | b_rapa\|gb162\|CA991656_T1 | 2790 | 525 | 81.18 | glotblastn |
| 1248 | LNU351 | clementine\|11v1\|BQ623383_T1 | 2791 | 525 | 81.1 | glotblastn |
| 1248 | LNU424 | clementine\|11v1\|BQ623383_T1 | 2791 | 590 | 81.03 | glotblastn |
| 1249 | LNU351 | cleome_spinosa\|10v1\|SRR015531S0011482_P1 | 2792 | 525 | 81.1 | globlastp |
| 1249 | LNU424 | cleome_spinosa\|10v1\|SRR015531S0011482_P1 | 2792 | 590 | 87 | globlastp |
| 1250 | LNU351 | cotton\|10v1\|AI727053 | 2793 | 525 | 81.1 | globlastp |
| 1250 | LNU424 | cotton\|10v1\|AI727053 | 2793 | 590 | 80.2 | globlastp |
| 1251 | LNU351 | cotton\|10v2\|BF276321_T1 | 2794 | 525 | 81.1 | glotblastn |
| 1251 | LNU424 | cotton\|10v2\|BF276321_T1 | 2794 | 590 | 80.63 | glotblastn |
| 1252 | LNU351 | tobacco\|gb162\|DV162696 | 2795 | 525 | 80.8 | globlastp |
| 1253 | LNU351 | centaurea\|gb166\|EH725206_P1 | 2796 | 525 | 80.8 | globlastp |
| 1253 | LNU424 | centaurea\|gb166\|EH725206_P1 | 2796 | 590 | 80 | globlastp |
| 1254 | LNU351 | cichorium\|gb171\|DT212712_P1 | 2797 | 525 | 80.8 | globlastp |
| 1254 | LNU424 | cichorium\|gb171\|DT212712_P1 | 2797 | 590 | 80.4 | globlastp |
| 1255 | LNU351 | canola\|10v1\|CB686246_T1 | 2798 | 525 | 80.78 | glotblastn |
| 1256 | LNU351 | aquilegia\|10v1\|DR918778 | 2799 | 525 | 80.71 | glotblastn |
| 1257 | LNU351 | aquilegia\|10v2\|DR918778_T1 | 2800 | 525 | 80.71 | glotblastn |
| 1258 | LNU351 | poplar\|10v1\|BU867914_T1 | 2801 | 525 | 80.71 | glotblastn |
| 1259 | LNU351 | citrus\|gb166\|BQ623383_T1 | 2802 | 525 | 80.71 | glotblastn |
| 1259 | LNU424 | citrus\|gb166\|BQ623383_T1 | 2802 | 590 | 80.63 | glotblastn |
| 1260 | LNU351 | prunus\|10v1\|CB821110_P1 | 2803 | 525 | 80.4 | globlastp |
| 1260 | LNU424 | Prunus\|10v1\|CB821110_P1 | 2803 | 590 | 80.4 | globlastp |
| 1261 | LNU351 | castorbean\|09v1\|EE255183_P1 | 2804 | 525 | 80.4 | globlastp |
| 1261 | LNU424 | castorbean\|09v1\|EE255183_P1 | 2804 | 590 | 80 | globlastp |
| 1262 | LNU351 | tragopogon\|10v1\|SRR020205S0033542 | 2805 | 525 | 80.4 | globlastp |
| 1262 | LNU424 | tragopogon\|10v1\|SRR020205S0033542 | 2805 | 590 | 80.24 | glotblastn |
| 1263 | LNU351 | orange\|11v1\|BQ623383_T1 | 2806 | 525 | 80.31 | glotblastn |
| 1263 | LNU424 | orange\|11v1\|BQ623383_T1 | 2806 | 590 | 80.24 | glotblastn |
| 1264 | LNU351 | soybean\|11v1\|GLYMA07G15960_P1 | 2807 | 525 | 80.3 | globlastp |
| 1265 | LNU351 | soybean\|gb168\|AW349893 | 2807 | 525 | 80.3 | globlastp |
| 1266 | LNU351 | radish\|gb164\|EV548023 | 2808 | 525 | 80.3 | globlastp |
| 1266 | LNU424 | radish\|gb164\|EV548023 | 2808 | 590 | 94.5 | globlastp |
| 1267 | LNU351 | artemisia\|10v1\|SRR019254S0015151_P1 | 2809 | 525 | 80 | globlastp |
| 1268 | LNU351 | avocado\|10v1\|CK756872_T1 | 2810 | 525 | 80 | glotblastn |
| 1269 | LNU351 | b_juncea\|gb164\|EVGN00219108490673 | 2811 | 525 | 80 | globlastp |
| 1270 | LNU351 | cowpea\|gb166\|FC458138_P1 | 2812 | 525 | 80 | globlastp |
| 1271 | LNU351 | tea\|10v1\|CV014405 | 2813 | 525 | 80 | glotblastn |
| 1272 | LNU351 | apple\|gb171\|CN494974_P1 | 2814 | 525 | 80 | globlastp |
| 1272 | LNU424 | apple\|gb171\|CN494974_P1 | 2814 | 590 | 80 | globlastp |
| 1273 | LNU351 | coffea\|10v1\|DV673538_T1 | 2815 | 525 | 80 | glotblastn |
| 1273 | LNU424 | coffea\|10v1\|DV673538_T1 | 2815 | 590 | 80.39 | glotblastn |
| 1274 | LNU351 | nasturtium\|10v1\|SRR032558S0065877_P1 | 2816 | 525 | 80 | globlastp |
| 1274 | LNU424 | nasturtium\|10v1\|SRR032558S0065877_P1 | 2816 | 590 | 80.8 | globlastp |
| 1275 | LNU351 | prunus\|gb167\|CB821110 | 2817 | 525 | 80 | globlastp |
| 1275 | LNU424 | prunus\|gb167\|CB821110 | 2817 | 590 | 80 | globlastp |
| 1276 | LNU352 | wheat\|gb164\|BE352575 | 2818 | 526 | 99.5 | globlastp |
| 1277 | LNU352 | wheat\|gb164\|CA647188 | 2819 | 526 | 99.3 | globlastp |
| 1278 | LNU352 | barley\|10v1\|BI947860 | 2820 | 526 | 98.6 | globlastp |
| 1279 | LNU352 | barley\|10v2\|BI947860_P1 | 2820 | 526 | 98.6 | globlastp |
| 1280 | LNU352 | brachypodium\|09v1\|DV477609_P1 | 2821 | 526 | 93.1 | globlastp |
| 1281 | LNU352 | rice\|gb170\|OS07G04690 | 2822 | 526 | 90.5 | globlastp |
| 1282 | LNU352 | cenchrus\|gb166\|BM084107_P1 | 2823 | 526 | 89.6 | globlastp |
| 1283 | LNU352 | switchgrass\|gb167\|DN143189 | 2824 | 526 | 89.6 | globlastp |
| 1284 | LNU352 | millet\|10v1\|EVO454PM016009_P1 | 2825 | 526 | 89.1 | globlastp |
| 1285 | LNU352 | sugarcane\|10v1\|CA096470 | 2826 | 526 | 86.5 | globlastp |
| 1286 | LNU352 | sorghum\|09v1\|SB02G002660 | 2827 | 526 | 86 | globlastp |
| 1287 | LNU352 | fescue\|gb161\|DT699878_T1 | 2828 | 526 | 80.33 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1288 | LNU353 | brachypodium|09v1|GT820624__T1 | 2829 | 527 | 82.27 | glotblastn |
| 1289 | LNU353 | rice|gb170|OS09G26870__P1 | 2830 | 527 | 80.4 | globlastp |
| 1290 | LNU354 | barley|10v1|BE060054 | 2831 | 528 | 91.3 | globlastp |
| 1291 | LNU354 | barley|10v2|BE060054__P1 | 2831 | 528 | 91.3 | globlastp |
| 1292 | LNU354 | wheat|10v2|CK212438__P1 | 2832 | 528 | 89.9 | globlastp |
| 1293 | LNU354 | wheat|gb164|CK212438 | 2833 | 528 | 89.86 | glotblastn |
| 1294 | LNU354 | wheat|gb164|BG314359 | 2834 | 528 | 84.9 | globlastp |
| 1295 | LNU354 | wheat|10v2|BE518059__P1 | 2835 | 528 | 84.1 | globlastp |
| 1296 | LNU354 | wheat|10v2|BE426361__P1 | 2836 | 528 | 83.6 | globlastp |
| 1297 | LNU354 | wheat|gb164|BE426361 | 2836 | 528 | 83.6 | globlastp |
| 1298 | LNU354 | wheat|gb164|BE518059 | 2837 | 528 | 82.6 | globlastp |
| 1299 | LNU354 | barley|10v1|BJ449982 | 2838 | 528 | 80.3 | globlastp |
| 1300 | LNU354 | barley|10v2|BJ449982__P1 | 2838 | 528 | 80.3 | globlastp |
| 1301 | LNU355 | wheat|gb164|BE426518 | 2839 | 529 | 97.1 | globlastp |
| 1302 | LNU355 | wheat|gb164|BF200864 | 2840 | 529 | 96.8 | globlastp |
| 1303 | LNU355 | pseudoroegneria|gb167|FF340622 | 2841 | 529 | 96.1 | globlastp |
| 1304 | LNU355 | leymus|gb166|EG375848__P1 | 2842 | 529 | 95.1 | globlastp |
| 1305 | LNU355 | barley|10v1|BF628570 | 2843 | 529 | 92.9 | globlastp |
| 1306 | LNU355 | barley|10v2|BF628570__P1 | 2843 | 529 | 92.9 | globlastp |
| 1307 | LNU355 | rice|gb170|OS05G38230 | 2844 | 529 | 83 | globlastp |
| 1308 | LNU355 | cynodon|10v1|ES295926__T1 | 2845 | 529 | 81.35 | glotblastn |
| 1309 | LNU355 | sorghum|09v1|SB09G022370 | 2846 | 529 | 80.39 | glotblastn |
| 1310 | LNU356 | solanum__phureja|09v1|SPHBG631091 | 2847 | 530 | 93.6 | globlastp |
| 1311 | LNU356 | pepper|gb171|GD057444__P1 | 2848 | 530 | 86 | globlastp |
| 1312 | LNU357 | solanum__phureja|09v1|SPHAI775669 | 2849 | 531 | 98.6 | globlastp |
| 1313 | LNU357 | potato|10v1|BM112538__P1 | 2850 | 531 | 98.3 | globlastp |
| 1314 | LNU357 | pepper|gb171|BM064560__P1 | 2851 | 531 | 91 | globlastp |
| 1315 | LNU357 | eggplant|10v1|FS005730__P1 | 2852 | 531 | 90.7 | globlastp |
| 1316 | LNU357 | tobacco|gb162|CV018003 | 2853 | 531 | 88.6 | globlastp |
| 1317 | LNU357 | potato|10v1|BG350748__P1 | 2854 | 531 | 87.2 | globlastp |
| 1318 | LNU357 | solanum__phureja|09v1|SPHAF225512 | 2854 | 531 | 87.2 | globlastp |
| 1319 | LNU357 | tomato|09v1|AF225512 | 2855 | 531 | 87.2 | globlastp |
| 1320 | LNU357 | petunia|gb171|CV294419__P1 | 2856 | 531 | 86.5 | globlastp |
| 1321 | LNU357 | tobacco|gb162|EB445511 | 2857 | 531 | 83.4 | globlastp |
| 1322 | LNU357 | triphysaria|10v1|BE574853 | 2858 | 531 | 83.4 | globlastp |
| 1323 | LNU357 | triphysaria|10v1|EY165458 | 2859 | 531 | 83 | globlastp |
| 1324 | LNU357 | ipomoea_nil|10v1|BJ555173__P1 | 2860 | 531 | 82.4 | globlastp |
| 1325 | LNU357 | orobanche|10v1|SRR023189S0021630__P1 | 2861 | 531 | 82.4 | globlastp |
| 1326 | LNU357 | monkeyflower|10v1|CV521906__P1 | 2862 | 531 | 80.6 | globlastp |
| 1327 | LNU359 | sorghum|09v1|SB03G007230 | 2863 | 532 | 96.2 | globlastp |
| 1328 | LNU359 | millet|10v1|EB410926__T1 | 2864 | 532 | 90.72 | glotblastn |
| 1329 | LNU359 | rice|gb170|OS01G03950 | 2865 | 532 | 87.6 | globlastp |
| 1330 | LNU359 | wheat|10v2|BI480386__P1 | 2866 | 532 | 82.6 | globlastp |
| 1331 | LNU359 | brachypodium|09v1|DV474090__P1 | 2867 | 532 | 82.5 | globlastp |
| 1332 | LNU359 | barley|10v1|BQ469878 | 2868 | 532 | 81.6 | globlastp |
| 1333 | LNU359 | barley|10v2|BQ469878__T1 | 2869 | 532 | 81.45 | glotblastn |
| 1334 | LNU360 | sugarcane|10v1|CA118302 | 2870 | 533 | 94.1 | globlastp |
| 1335 | LNU360 | sorghum|09v1|SB10G006380 | 2871 | 533 | 90.9 | globlastp |
| 1336 | LNU360 | foxtail_millet|10v2|SICRP000016__P1 | 2872 | 533 | 87.7 | globlastp |
| 1337 | LNU360 | cynodon|10v1|ES302376__P1 | 2873 | 533 | 85.3 | globlastp |
| 1338 | LNU360 | leymus|gb166|EG385922__P1 | 2874 | 533 | 84.2 | globlastp |
| 1339 | LNU360 | oat|10v2|GR320403__P1 | 2875 | 533 | 83.8 | globlastp |
| 1340 | LNU360 | oat|10v1|GR320403 | 2875 | 533 | 83.8 | globlastp |
| 1341 | LNU360 | fescue|gb161|DT681344__P1 | 2876 | 533 | 82.9 | globlastp |
| 1342 | LNU360 | brachypodium|09v1|GT772421__P1 | 2877 | 533 | 80.9 | globlastp |
| 1343 | LNU361 | sorghum|09v1|SB04G025150 | 2878 | 534 | 92.2 | globlastp |
| 1344 | LNU368 | wheat|gb164|BE400257 | 2879 | 541 | 92 | globlastp |
| 1345 | LNU369 | brachypodium|09v1|GT787733__P1 | 2880 | 542 | 93.4 | globlastp |
| 1346 | LNU369 | leymus|gb166|EG389109__P1 | 2881 | 542 | 90.1 | globlastp |
| 1347 | LNU369 | rice|gb170|OS01G70100 | 2882 | 542 | 89.3 | globlastp |
| 1348 | LNU369 | millet|10v1|EVO454PM068764__P1 | 2883 | 542 | 89.1 | globlastp |
| 1349 | LNU369 | switchgrass|gb167|FE654078 | 2884 | 542 | 88.8 | globlastp |
| 1350 | LNU369 | brachypodium|09v1|TMPLEG389109T1__P1 | 2885 | 542 | 88.7 | globlastp |
| 1351 | LNU369 | maize|gb170|AI621555 | 2886 | 542 | 88.2 | globlastp |
| 1352 | LNU369 | maize|10v1|AI621555__P1 | 2886 | 542 | 88.2 | globlastp |
| 1353 | LNU369 | maize|10v1|AW308727__P1 | 2887 | 542 | 85.7 | globlastp |
| 1354 | LNU369 | maize|gb170|AW308727 | 2887 | 542 | 85.7 | globlastp |
| 1355 | LNU370 | potato|10v1|BG591992__P1 | 2888 | 543 | 99 | globlastp |
| 1356 | LNU370 | solanum__phureja|09v1|SPHAI772811 | 2889 | 543 | 99 | globlastp |
| 1357 | LNU370 | eggplant|10v1|FS023252__P1 | 2890 | 543 | 91.6 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1358 | LNU370 | petunia\|gb171\|FN005093__T1 | 2891 | 543 | 81.65 | glotblastn |
| 1359 | LNU371 | sorghum\|09v1\|SB03G041730 | 2892 | 544 | 88.12 | glotblastn |
| 1360 | LNU373 | sorghum\|09v1\|SB10G026090 | 2893 | 546 | 85.9 | globlastp |
| 1361 | LNU373 | maize\|10v1\|CD936590__P1 | 2894 | 546 | 85.5 | globlastp |
| 1362 | LNU373 | maize\|gb170\|CD936590 | 2895 | 546 | 85.41 | glotblastn |
| 1363 | LNU373 | brachypodium\|09v1\|DV483814__P1 | 2896 | 546 | 85.1 | globlastp |
| 1364 | LNU373 | foxtail__millet\|10v2\|SICRP003144__T1 | 2897 | 546 | 84.65 | glotblastn |
| 1365 | LNU373 | millet\|10v1\|EVO454PM064645__P1 | 2898 | 546 | 80.1 | globlastp |
| 1366 | LNU375 | solanum_phureja\|09v1\|SPHBG125016 | 2899 | 548 | 95 | globlastp |
| 1367 | LNU375 | potato\|10v1\|BF459523__P1 | 2900 | 548 | 94.4 | globlastp |
| 1368 | LNU375 | pepper\|gb171\|AA840787__P1 | 2901 | 548 | 92.2 | globlastp |
| 1369 | LNU375 | eggplant\|10v1\|FS016985__P1 | 2902 | 548 | 90 | globlastp |
| 1370 | LNU375 | nicotiana__benthamiana\|gb162\|CK280835__P1 | 2903 | 548 | 87 | globlastp |
| 1371 | LNU376 | sorghum\|09v1\|SB03G037440 | 2904 | 549 | 85.5 | globlastp |
| 1372 | LNU378 | brachypodium\|09v1\|SRR031797S0001956__P1 | 2905 | 551 | 89 | globlastp |
| 1373 | LNU379 | sugarcane\|10v1\|CA080471 | 2906 | 552 | 99 | globlastp |
| 1374 | LNU379 | maize\|10v1\|CD440138__P1 | 2907 | 552 | 93.4 | globlastp |
| 1375 | LNU379 | maize\|gb170\|CD440138 | 2907 | 552 | 93.4 | globlastp |
| 1376 | LNU379 | millet\|09v1\|CD725143 | 2908 | 552 | 92.4 | globlastp |
| 1377 | LNU379 | millet\|10v1\|CD725143__P1 | 2908 | 552 | 92.4 | globlastp |
| 1378 | LNU379 | foxtail__millet\|10v2\|SICRP004364__P1 | 2909 | 552 | 92 | globlastp |
| 1379 | LNU379 | cenchrus\|gb166\|EB659921__P1 | 2910 | 552 | 92 | globlastp |
| 1380 | LNU379 | sugarcane\|10v1\|CA070722 | 2911 | 552 | 85.5 | globlastp |
| 1381 | LNU379 | switchgrass\|gb167\|FE598481 | 2912 | 552 | 85.5 | globlastp |
| 1382 | LNU379 | foxtail__millet\|10v2\|OXFXTSLX00041407D1T1__P1 | 2913 | 552 | 85.1 | globlastp |
| 1383 | LNU379 | maize\|10v1\|AI712016__P1 | 2914 | 552 | 85.1 | globlastp |
| 1384 | LNU379 | maize\|gb170\|AI712016 | 2914 | 552 | 85.1 | globlastp |
| 1385 | LNU379 | millet\|10v1\|CD724799__P1 | 2915 | 552 | 84.8 | globlastp |
| 1386 | LNU379 | millet\|09v1\|CD724799 | 2916 | 552 | 83.4 | globlastp |
| 1387 | LNU379 | leymus\|gb166\|CD808758__P1 | 2917 | 552 | 83 | globlastp |
| 1388 | LNU379 | wheat\|10v2\|BE404550__P1 | 2918 | 552 | 82.7 | globlastp |
| 1389 | LNU379 | wheat\|gb164\|BE404550 | 2918 | 552 | 82.7 | globlastp |
| 1390 | LNU379 | barley\|10v1\|BE413350 | 2919 | 552 | 82.4 | globlastp |
| 1391 | LNU379 | barley\|10v2\|BE413350__P1 | 2919 | 552 | 82.4 | globlastp |
| 1392 | LNU379 | brachypodium\|09v1\|DV474291__P1 | 2920 | 552 | 82 | globlastp |
| 1393 | LNU379 | rice\|gb170\|OS08G18110 | 2921 | 552 | 82 | globlastp |
| 1394 | LNU379 | oat\|10v2\|GO589632__P1 | 2922 | 552 | 80.6 | globlastp |
| 1395 | LNU379 | oat\|10v1\|GO589632 | 2922 | 552 | 80.6 | globlastp |
| 1396 | LNU381 | wheat\|10v2\|CA485868__P1 | 554 | 554 | 100 | globlastp |
| 1396 | LNU381 | wheat\|gb164\|CA485868 | 2927 | 554 | 80.2 | globlastp |
| 1397 | LNU381 | sugarcane\|10v1\|CA282730 | 2923 | 554 | 91.09 | glotblastn |
| 1398 | LNU381 | maize\|10v1\|CO533611__P1 | 2924 | 554 | 87.1 | globlastp |
| 1399 | LNU381 | maize\|gb170\|CO533611 | 2924 | 554 | 87.1 | globlastp |
| 1400 | LNU381 | millet\|10v1\|PMSLX0058175D2__P1 | 2925 | 554 | 84.5 | globlastp |
| 1401 | LNU381 | cenchrus\|gb166\|EB662230__P1 | 2926 | 554 | 84.2 | globlastp |
| 1402 | LNU382 | arabidopsis__lyrata\|09v1\|JGIAL006288__P1 | 2928 | 555 | 90.5 | globlastp |
| 1403 | LNU383 | solanum__phureja\|09v1\|SPHBG123484 | 2929 | 556 | 94.5 | globlastp |
| 1404 | LNU385 | sorghum\|09v1\|SB03G014370 | 2930 | 558 | 88 | globlastp |
| 1405 | LNU385 | brachypodium\|09v1\|DV471590__P1 | 2931 | 558 | 86.9 | globlastp |
| 1406 | LNU385 | barley\|10v2\|AW983394__P1 | 2932 | 558 | 84.9 | globlastp |
| 1407 | LNU385 | wheat\|10v2\|BE497298__P1 | 2933 | 558 | 84.6 | globlastp |
| 1408 | LNU385 | wheat\|gb164\|BE497298 | 2934 | 558 | 82.8 | globlastp |
| 1409 | LNU385 | barley\|10v1\|AW983394 | 2935 | 558 | 82.49 | glotblastn |
| 1410 | LNU387 | maize\|10v1\|BG518113__P1 | 2936 | 560 | 93.7 | globlastp |
| 1411 | LNU387 | maize\|gb170\|BG518113 | 2936 | 560 | 93.7 | globlastp |
| 1412 | LNU387 | maize\|10v1\|AI600775__P1 | 2937 | 560 | 92.3 | globlastp |
| 1413 | LNU387 | maize\|gb170\|AI600775 | 2937 | 560 | 92.3 | globlastp |
| 1414 | LNU387 | rice\|gb170\|OS09G38420 | 2938 | 560 | 86.7 | globlastp |
| 1415 | LNU387 | brachypodium\|09v1\|GT768177__P1 | 2939 | 560 | 82.6 | globlastp |
| 1416 | LNU388 | brachypodium\|09v1\|GT785236__P1 | 2940 | 561 | 80.2 | globlastp |
| 1417 | LNU390 | solanum__phureja\|09v1\|SPHBG125049 | 2941 | 562 | 88.7 | globlastp |
| 1418 | LNU390 | solanum__phureja\|09v1\|SPHSRR015435S0020890 | 2942 | 562 | 80.2 | globlastp |
| 1419 | LNU391 | wheat\|10v2\|BE499752__P1 | 2943 | 563 | 98.6 | globlastp |
| 1420 | LNU391 | wheat\|gb164\|BE499752 | 2944 | 563 | 97.8 | globlastp |
| 1421 | LNU391 | brachypodium\|09v1\|DV481377__P1 | 2945 | 563 | 93.5 | globlastp |
| 1422 | LNU391 | fescue\|gb161\|DT686577__P1 | 2946 | 563 | 92.6 | globlastp |
| 1423 | LNU391 | sorghum\|09v1\|SB01G032340 | 2947 | 563 | 84.1 | globlastp |
| 1424 | LNU391 | rice\|gb170\|OS03G30790 | 2948 | 563 | 83.96 | glotblastn |
| 1425 | LNU391 | maize\|10v1\|AW054498__P1 | 2949 | 563 | 83.3 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1426 | LNU391 | maize\|gb170\|AW054498 | 2949 | 563 | 83.3 | globlastp |
| 1427 | LNU391 | sugarcane\|10v1\|CA121549 | 2950 | 563 | 82.7 | globlastp |
| 1428 | LNU391 | switchgrass\|gb167\|FL697122 | 2951 | 563 | 82.7 | globlastp |
| 1429 | LNU391 | maize\|10v1\|AW288496_P1 | 2952 | 563 | 82.5 | globlastp |
| 1430 | LNU391 | millet\|10v1\|EVO454PM001107_P1 | 2953 | 563 | 81.4 | globlastp |
| 1431 | LNU392 | brachypodium\|09v1\|GT773267_P1 | 2954 | 564 | 85.1 | globlastp |
| 1431 | LNU417_H4 | brachypodium\|09v1\|GT773267_P1 | 2954 | 677 | 80 | globlastp |
| 1431 | LNU417 | brachypodium\|09v1\|GT773267_T1 | 2954 | 702 | 89.04 | glotblastn |
| 1432 | LNU392 | maize\|10v1\|BM078460_P1 | 2955 | 564 | 83.8 | globlastp |
| 1432 | LNU417_H4 | maize\|10v1\|BM078460_P1 | 2955 | 677 | 82.6 | globlastp |
| 1432 | LNU417 | maize\|10v1\|BM078460_T1 | 2955 | 702 | 84.97 | glotblastn |
| 1433 | LNU392 | sorghum\|09v1\|SB01G043030 | 2956 | 564 | 83 | globlastp |
| 1433 | LNU417_H4 | sorghum\|09v1\|SB01G043030 | 2956 | 677 | 86.3 | globlastp |
| 1433 | LNU417 | sorghum\|09v1\|SB01G043030 | 2956 | 702 | 87.12 | glotblastn |
| 1434 | LNU392 | millet\|10v1\|EVO454PM040968_P1 | 2957 | 564 | 82.3 | globlastp |
| 1434 | LNU417_H4 | millet\|10v1\|EVO454PM040968_P1 | 2957 | 677 | 82.8 | globlastp |
| 1434 | LNU417 | millet\|10v1\|EVO454PM040968_T1 | 2957 | 702 | 84.43 | glotblastn |
| 1435 | LNU392 | maize\|gb170\|BM078460 | 2958 | 564 | 80.3 | globlastp |
| 1435 | LNU417_H4 | maize\|gb170\|BM078460 | 2958 | 677 | 80.97 | globlastp |
| 1435 | LNU417 | maize\|gb170\|BM078460 | 2958 | 702 | 84.97 | glotblastn |
| 1436 | LNU393 | maize\|10v1\|EB166150_T1 | 2959 | 565 | 85.24 | glotblastn |
| 1437 | LNU393 | maize\|gb170\|EB166150 | 2959 | 565 | 85.24 | glotblastn |
| 1438 | LNU395 | maize\|10v1\|EU972999_P1 | 2960 | 566 | 85.6 | globlastp |
| 1439 | LNU395 | maize\|gb170\|EU972999 | 2961 | 566 | 83.2 | globlastp |
| 1440 | LNU396 | maize\|10v1\|AI670204_P1 | 2962 | 567 | 99.1 | globlastp |
| 1441 | LNU396 | foxtail_millet\|10v2\|SICRP011369_P1 | 2963 | 567 | 97.2 | globlastp |
| 1442 | LNU396 | sugarcane\|10v1\|CA075971 | 2964 | 567 | 96.3 | globlastp |
| 1443 | LNU396 | switchgrass\|gb167\|DN151549 | 2965 | 567 | 96.3 | globlastp |
| 1444 | LNU396 | millet\|09v1\|CD725448 | 2966 | 567 | 95.4 | globlastp |
| 1445 | LNU396 | millet\|10v1\|CD725448_P1 | 2966 | 567 | 95.4 | globlastp |
| 1446 | LNU396 | switchgrass\|gb167\|DN144669 | 2967 | 567 | 92.7 | globlastp |
| 1447 | LNU396 | cenchrus\|gb166\|EB666773_P1 | 2968 | 567 | 92.6 | globlastp |
| 1448 | LNU396 | fescue\|gb161\|DT674442_P1 | 2969 | 567 | 87.4 | globlastp |
| 1449 | LNU396 | oat\|10v2\|CN815301_P1 | 2970 | 567 | 87.2 | globlastp |
| 1450 | LNU396 | brachypodium\|09v1\|DV486678_P1 | 2971 | 567 | 86.5 | globlastp |
| 1451 | LNU396 | rice\|gb170\|OS03G03770 | 2972 | 567 | 86.4 | globlastp |
| 1452 | LNU396 | wheat\|10v2\|BG314370_P1 | 2973 | 567 | 84.7 | globlastp |
| 1453 | LNU396 | barley\|10v1\|BE411304 | 2974 | 567 | 84.7 | globlastp |
| 1454 | LNU396 | barley\|10v2\|BE411304_P1 | 2974 | 567 | 84.7 | globlastp |
| 1455 | LNU396 | pseudoroegneria\|gb167\|FF358290 | 2975 | 567 | 84.7 | globlastp |
| 1456 | LNU396 | wheat\|gb164\|BE404919 | 2973 | 567 | 84.7 | globlastp |
| 1457 | LNU396 | wheat\|gb164\|BE405061 | 2973 | 567 | 84.7 | globlastp |
| 1458 | LNU396 | wheat\|gb164\|BG909911 | 2976 | 567 | 83.8 | globlastp |
| 1459 | LNU397 | switchgrass\|gb167\|DN142167 | 2977 | 568 | 87.6 | globlastp |
| 1460 | LNU397 | foxtail_millet\|10v2\|SICRP040427_P1 | 2978 | 568 | 87.3 | globlastp |
| 1461 | LNU401 | sugarcane\|10v1\|CA068996_P1 | 2979 | 570 | 93.7 | globlastp |
| 1462 | LNU401 | maize\|10v1\|AI396373_T1 | 2980 | 570 | 84.44 | glotblastn |
| 1463 | LNU401 | maize\|10v1\|DR792581_P1 | 2981 | 570 | 83.4 | globlastp |
| 1464 | LNU402 | pseudoroegneria\|gb167\|FF345540 | 2982 | 571 | 98.7 | globlastp |
| 1465 | LNU402 | brachypodium\|09v1\|SRR031798S0004329_P1 | 2983 | 571 | 83.5 | globlastp |
| 1466 | LNU403 | maize\|10v1\|AI920392_T1 | 2984 | 572 | 87.96 | glotblastn |
| 1467 | LNU403 | maize\|10v1\|BI417041_T1 | 2985 | 572 | 85.45 | glotblastn |
| 1468 | LNU403 | maize\|gb170\|BI417041 | 2985 | 572 | 85.45 | glotblastn |
| 1469 | LNU403 | switchgrass\|gb167\|DN145126 | 2986 | 572 | 82.41 | glotblastn |
| 1470 | LNU403 | sugarcane\|10v1\|CA071352 | 2987 | 572 | 82.21 | glotblastn |
| 1471 | LNU403 | maize\|10v1\|DR823873_T1 | 2988 | 572 | 82.04 | glotblastn |
| 1472 | LNU403 | switchgrass\|gb167\|DN141486 | 2989 | 572 | 80.56 | glotblastn |
| 1473 | LNU405 | potato\|10v1\|CK260581_T1 | 2990 | 573 | 86.18 | glotblastn |
| 1474 | LNU408 | fescue\|gb161\|DT685544_T1 | 2991 | 575 | 91.07 | glotblastn |
| 1475 | LNU408 | wheat\|gb164\|BE399717 | 2992 | 575 | 89.3 | globlastp |
| 1476 | LNU408 | wheat\|gb164\|BQ170889 | 2992 | 575 | 89.3 | globlastp |
| 1477 | LNU408 | wheat\|10v2\|BF485415_T1 | 2993 | 575 | 89.29 | glotblastn |
| 1478 | LNU408 | wheat\|10v2\|BE399717_T1 | 2994 | 575 | 89.29 | glotblastn |
| 1479 | LNU408 | wheat\|10v2\|BE414880_T1 | 2995 | 575 | 89.29 | glotblastn |
| 1480 | LNU408 | wheat\|gb164\|BE414880 | 2996 | 575 | 89.29 | glotblastn |
| 1481 | LNU408 | oat\|10v2\|SRR020741S0174434_P1 | 2997 | 575 | 87.5 | globlastp |
| 1482 | LNU408 | oat\|10v1\|GO587069 | 2997 | 575 | 87.5 | globlastp |
| 1483 | LNU408 | oat\|10v2\|GO587069_T1 | 2998 | 575 | 85.71 | glotblastn |
| 1484 | LNU408 | brachypodium\|09v1\|DV470560_P1 | 2999 | 575 | 80.4 | globlastp |
| 1485 | LNU408 | rye\|gb164\|BF145769 | 3000 | 575 | 80.36 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1486 | LNU408 | wheat\|gb164\|DR737280 | 3001 | 575 | 80.36 | glotblastn |
| 1487 | LNU410 | brachypodium\|09v1\|DV473415_T1 | 3002 | 577 | 84.65 | glotblastn |
| 1488 | LNU410 | oat\|10v2\|GR329792_T1 | 3003 | 577 | 82.61 | glotblastn |
| 1489 | LNU411 | solanum_phureja\|09v1\|SPHBI207068 | 3004 | 578 | 96.1 | globlastp |
| 1490 | LNU412 | cacao\|10v1\|CU619568_P1 | 3005 | 579 | 86.1 | globlastp |
| 1491 | LNU413 | solanum_phureja\|09v1\|SPHBG126757 | 3006 | 580 | 97.7 | globlastp |
| 1492 | LNU413 | pepper\|gb171\|BM063553_T1 | 3007 | 580 | 82.64 | glotblastn |
| 1493 | LNU414 | brachypodium\|09v1\|SRR031795S0008555_P1 | 3008 | 581 | 88 | globlastp |
| 1494 | LNU414 | barley\|10v2\|BE413415_P1 | 3009 | 581 | 87.8 | globlastp |
| 1495 | LNU414 | rice\|gb170\|OS02G56310 | 3010 | 581 | 80.1 | globlastp |
| 1496 | LNU415 | maize\|10v1\|AI391766_P1 | 3011 | 582 | 87.5 | globlastp |
| 1497 | LNU415 | maize\|gb170\|AI391766 | 3011 | 582 | 87.5 | globlastp |
| 1498 | LNU415 | foxtail_millet\|10v2\|SICRP012424_P1 | 3012 | 582 | 83.5 | globlastp |
| 1499 | LNU419 | cacao\|10v1\|CA795077_P1 | 3013 | 585 | 83.5 | globlastp |
| 1500 | LNU419 | chestnut\|gb170\|SRR006295S0002815_P1 | 3014 | 585 | 81.7 | globlastp |
| 1501 | LNU419 | strawberry\|11v1\|DY666645_P1 | 3015 | 585 | 81.6 | globlastp |
| 1502 | LNU419 | medicago\|09v1\|AI974351_P1 | 3016 | 585 | 81 | globlastp |
| 1503 | LNU419 | pea\|11v1\|CD858805_P1 | 3017 | 585 | 80.4 | globlastp |
| 1504 | LNU420 | wheat\|10v2\|CA484146_P1 | 586 | 586 | 100 | globlastp |
| 1505 | LNU420 | wheat\|gb164\|CA484146 | 586 | 586 | 100 | globlastp |
| 1506 | LNU420 | sugarcane\|10v1\|CA075634 | 3018 | 586 | 97.6 | globlastp |
| 1507 | LNU420 | maize\|10v1\|AW562562_P1 | 3019 | 586 | 90.3 | globlastp |
| 1508 | LNU420 | maize\|gb170\|AW562562 | 3019 | 586 | 90.3 | globlastp |
| 1509 | LNU420 | switchgrass\|gb167\|FE618444 | 3020 | 586 | 86.6 | globlastp |
| 1510 | LNU420 | millet\|10v1\|PMSLX0017470D1_P1 | 3021 | 586 | 86.1 | globlastp |
| 1511 | LNU420 | foxtail_millet\|10v2\|SICRP015318_P1 | 3022 | 586 | 83.5 | globlastp |
| 1512 | LNU422 | maize\|10v1\|AW067318_P1 | 3023 | 588 | 89.1 | globlastp |
| 1513 | LNU422 | maize\|gb170\|AW067318 | 3023 | 588 | 89.1 | globlastp |
| 1514 | LNU422 | millet\|10v1\|EVO454PM057489_P1 | 3024 | 588 | 87.4 | globlastp |
| 1515 | LNU422 | switchgrass\|gb167\|FL823704 | 3025 | 588 | 87.4 | globlastp |
| 1516 | LNU422 | barley\|10v1\|BF621668 | 3026 | 588 | 84.1 | globlastp |
| 1517 | LNU422 | barley\|10v2\|BF621668_T1 | 3026 | 588 | 84.1 | globlastp |
| 1518 | LNU422 | wheat\|10v2\|BE426240_P1 | 3027 | 588 | 84.1 | globlastp |
| 1519 | LNU422 | wheat\|gb164\|BE426240 | 3027 | 588 | 84.1 | globlastp |
| 1520 | LNU422 | leymus\|gb166\|EG392745_P1 | 3028 | 588 | 83.3 | globlastp |
| 1521 | LNU422 | wheat\|10v2\|BE518320_P1 | 3029 | 588 | 83.2 | globlastp |
| 1522 | LNU422 | wheat\|gb164\|BE518320 | 3030 | 588 | 82.8 | globlastp |
| 1523 | LNU422 | brachypodium\|09v1\|DV473145_P1 | 3031 | 588 | 81.9 | globlastp |
| 1524 | LNU422 | rice\|gb170\|OS08G04450 | 3032 | 588 | 80.8 | globlastp |
| 1525 | LNU423 | maize\|10v1\|BE128849_P1 | 3033 | 589 | 87.6 | globlastp |
| 1526 | LNU423 | maize\|gb170\|BE128849 | 3034 | 589 | 87.6 | globlastp |
| 1527 | LNU423 | millet\|10v1\|EVO454PM020049_P1 | 3035 | 589 | 81.3 | globlastp |
| 1528 | LNU424 | arabidopsis_lyrata\|09v1\|JGIAL019853_P1 | 3036 | 590 | 97.6 | globlastp |
| 1529 | LNU424 | radish\|gb164\|EW734440 | 3037 | 590 | 95.3 | globlastp |
| 1530 | LNU424 | radish\|gb164\|EW723032 | 3038 | 590 | 94.9 | globlastp |
| 1531 | LNU424 | thellungiella\|gb167\|BY808370 | 3039 | 590 | 94.9 | globlastp |
| 1532 | LNU424 | radish\|gb164\|EV524742 | 3040 | 590 | 94.5 | globlastp |
| 1533 | LNU424 | b_juncea\|10v2\|E6ANDIZ01A8BJU_P1 | 3041 | 590 | 94.5 | globlastp |
| 1534 | LNU424 | radish\|gb164\|EW733020 | 3042 | 590 | 94.1 | globlastp |
| 1535 | LNU424 | b_oleracea\|gb161\|AM059842_P1 | 3043 | 590 | 93.7 | globlastp |
| 1536 | LNU424 | b_rapa\|gb162\|CV545782_P1 | 3044 | 590 | 93.3 | globlastp |
| 1537 | LNU424 | canola\|10v1\|CD817789_P1 | 3045 | 590 | 92.9 | globlastp |
| 1538 | LNU424 | b_juncea\|10v2\|BJ1SLX00005485_P1 | 3046 | 590 | 89.7 | globlastp |
| 1539 | LNU424 | cleome_gynandra\|10v1\|SRR015532S0005578_P1 | 3047 | 590 | 84.6 | globlastp |
| 1540 | LNU424 | radish\|gb164\|EV539241 | 3048 | 590 | 82.6 | globlastp |
| 1541 | LNU424 | b_juncea\|gb164\|EVGN00823111331395 | 3049 | 590 | 81 | globlastp |
| 1542 | LNU424 | thellungiella\|gb167\|BY801711 | 3050 | 590 | 80.63 | globlastp |
| 1543 | LNU424 | senecio\|gb170\|DY660615 | 3051 | 590 | 80.24 | glotblastn |
| 1544 | LNU425 | wheat\|10v2\|BE415800_P1 | 3052 | 591 | 97.9 | globlastp |
| 1545 | LNU425 | wheat\|gb164\|CA701400 | 3052 | 591 | 97.9 | globlastp |
| 1546 | LNU425 | brachypodium\|09v1\|SRR031797S0133764_P1 | 3053 | 591 | 89.7 | globlastp |
| 1547 | LNU425 | wheat\|gb164\|BE415800 | 3054 | 591 | 85.7 | globlastp |
| 1548 | LNU426 | cenchrus\|gb166\|EB657129_P1 | 3055 | 592 | 81.5 | globlastp |
| 1549 | LNU426 | sugarcane\|10v1\|CA096527 | 3056 | 592 | 80.7 | globlastp |
| 1550 | LNU426 | brachypodium\|09v1\|DV472433_P1 | 3057 | 592 | 80.5 | globlastp |
| 1551 | LNU426 | switchgrass\|gb167\|DN147719 | 3058 | 592 | 80.3 | globlastp |
| 1552 | LNU426 | foxtail_millet\|10v2\|SICRP009618_P1 | 3059 | 592 | 80.1 | globlastp |
| 1553 | LNU426 | maize\|10v1\|CD996749_P1 | 3060 | 592 | 80 | globlastp |
| 1554 | LNU426 | barley\|10v1\|BF065562 | 3061 | 592 | 80 | glotblastn |
| 1555 | LNU426 | barley\|10v2\|BF065562_T1 | 3061 | 592 | 80 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1556 | LNU429 | solanum_phureja\|09v1\|SPHBG124215 | 3062 | 594 | 89.1 | globlastp |
| 1557 | LNU429 | potato\|10v1\|BF460297_P1 | 3063 | 594 | 82.8 | globlastp |
| 1558 | LNU429 | potato\|10v1\|BE922360_P1 | 3064 | 594 | 81.3 | globlastp |
| 1559 | LNU430 | potato\|10v1\|BF154026_P1 | 3065 | 595 | 90.8 | globlastp |
| 1560 | LNU430 | solanum_phureja\|09v1\|SPHBG134528 | 3066 | 595 | 89.7 | globlastp |
| 1561 | LNU431 | maize\|10v1\|AW331095_T1 | 3067 | 596 | 82.95 | glotblastn |
| 1561 | LNU431_H1 | maize\|10v1\|AW331095_T1 | 3067 | 716 | 87.11 | glotblastn |
| 1562 | LNU432 | switchgrass\|gb167\|FL911295 | 3068 | 597 | 80.3 | globlastp |
| 1563 | LNU433 | maize\|10v1\|EC858802_P1 | 3069 | 598 | 82.2 | globlastp |
| 1564 | LNU433 | maize\|gb170\|EC858802 | 3069 | 598 | 82.2 | globlastp |
| 1565 | LNU434 | maize\|10v1\|AI372108_P1 | 3070 | 599 | 83.7 | globlastp |
| 1566 | LNU435 | wheat\|gb164\|BE400160 | 3071 | 600 | 96.6 | globlastp |
| 1567 | LNU435 | wheat\|10v2\|BQ579132_P1 | 3072 | 600 | 96.6 | globlastp |
| 1568 | LNU435 | wheat\|gb164\|BQ579132 | 3072 | 600 | 96.6 | globlastp |
| 1569 | LNU435 | wheat\|gb164\|BI751574 | 3073 | 600 | 96.2 | globlastp |
| 1570 | LNU435 | wheat\|10v2\|BE400160_P1 | 3073 | 600 | 96.2 | globlastp |
| 1571 | LNU435 | brachypodium\|09v1\|DV473618_P1 | 3074 | 600 | 84.7 | globlastp |
| 1572 | LNU436 | barley\|10v1\|BE413139 | 3075 | 601 | 96.3 | globlastp |
| 1573 | LNU436 | barley\|10v2\|BE413139_P1 | 3075 | 601 | 96.3 | globlastp |
| 1574 | LNU436 | wheat\|10v2\|BE418697_P1 | 3076 | 601 | 94.7 | globlastp |
| 1575 | LNU436 | wheat\|gb164\|BE418697 | 3076 | 601 | 94.7 | globlastp |
| 1576 | LNU437 | wheat\|10v2\|BM136523XX1_P1 | 3077 | 602 | 93.7 | globlastp |
| 1577 | LNU437 | wheat\|10v2\|BM136523XX2_T1 | 3078 | 602 | 90.4 | glotblastn |
| 1578 | LNU437 | brachypodium\|09v1\|DV485772_T1 | 3079 | 602 | 88.25 | glotblastn |
| 1578 | LNU437_H2 | brachypodium\|09v1\|DV485772_P1 | 3079 | 679 | 82.2 | globlastp |
| 1579 | LNU437 | maize\|10v1\|CD960306_T1 | 3080 | 602 | 86.26 | glotblastn |
| 1579 | LNU437_H2 | maize\|10v1\|CD960306_P1 | 3080 | 679 | 82.4 | globlastp |
| 1580 | LNU437 | wheat\|gb164\|BF293149 | 3081 | 602 | 86.2 | globlastp |
| 1581 | LNU437 | maize\|10v1\|AI902127_T1 | 3082 | 602 | 85.43 | glotblastn |
| 1581 | LNU437_H2 | maize\|10v1\|AI902127_P1 | 3082 | 679 | 81.9 | globlastp |
| 1582 | LNU437 | wheat\|10v2\|BF293149_T1 | 3083 | 602 | 82.78 | glotblastn |
| 1583 | LNU437 | sorghum\|09v1\|SB01G000220 | 3084 | 602 | 82.18 | globlastp |
| 1584 | LNU437 | maize\|gb170\|CD960306 | 3085 | 602 | 81.62 | glotblastn |
| 1585 | LNU437 | maize\|10v1\|DW838041_T1 | 3086 | 602 | 81.52 | glotblastn |
| 1586 | LNU437 | maize\|gb170\|AI902127 | 3087 | 602 | 80.79 | glotblastn |
| 1587 | LNU437 | maize\|gb170\|DW838041 | 3088 | 602 | 80.79 | glotblastn |
| 1588 | LNU437 | rice\|gb170\|OS07G33780 | 3089 | 602 | 80.17 | glotblastn |
| 1589 | LNU438 | wheat\|10v2\|BE416560_P1 | 3090 | 603 | 98.3 | globlastp |
| 1590 | LNU438 | wheat\|gb164\|BE416560 | 3090 | 603 | 98.3 | globlastp |
| 1591 | LNU438 | brachypodium\|09v1\|GT783610_P1 | 3091 | 603 | 96.2 | globlastp |
| 1592 | LNU438 | sorghum\|09v1\|SB10G022490 | 3092 | 603 | 93.6 | globlastp |
| 1593 | LNU438 | rice\|gb170\|OS06G37160 | 3093 | 603 | 93.5 | globlastp |
| 1594 | LNU438 | switchgrass\|gb167\|DN152570 | 3094 | 603 | 91.6 | globlastp |
| 1595 | LNU438 | foxtail_millet\|10v2\|FXTRMSLX00002766D1_P1 | 3095 | 603 | 91.4 | globlastp |
| 1596 | LNU438 | brachypodium\|09v1\|GFXEU730900X15_T1 | 3096 | 603 | 90.29 | glotblastn |
| 1597 | LNU438 | millet\|09v1\|EVO454PM004612 | 3097 | 603 | 80.5 | globlastp |
| 1598 | LNU438 | millet\|10v1\|EVO454PM004612_P1 | 3097 | 603 | 80.5 | globlastp |
| 1599 | LNU438 | sugarcane\|10v1\|CA077281 | 3098 | 603 | 80.1 | globlastp |
| 1600 | LNU439 | sugarcane\|10v1\|CA068568 | 3099 | 604 | 89.1 | globlastp |
| 1601 | LNU441 | foxtail_millet\|10v2\|SICRP008836_T1 | 3100 | 605 | 88.85 | glotblastn |
| 1602 | LNU441 | switchgrass\|gb167\|DN140960 | 3101 | 605 | 88.08 | glotblastn |
| 1603 | LNU441 | wheat\|gb164\|CA502719 | 3102 | 605 | 87.5 | globlastp |
| 1604 | LNU441 | maize\|gb170\|AA979820 | 3103 | 605 | 87.31 | glotblastn |
| 1605 | LNU441 | maize\|10v1\|AA979820_T1 | 3104 | 605 | 86.59 | glotblastn |
| 1606 | LNU441 | switchgrass\|gb167\|FE601692 | 3105 | 605 | 86.54 | glotblastn |
| 1607 | LNU441 | millet\|10v1\|EVO454PM053619_T1 | 3106 | 605 | 83.85 | glotblastn |
| 1608 | LNU441 | millet\|09v1\|EVO454PM009153 | 3107 | 605 | 83.85 | glotblastn |
| 1609 | LNU441 | millet\|10v1\|EVO454PM009153_T1 | 3108 | 605 | 83.85 | glotblastn |
| 1610 | LNU442 | potato\|10v1\|CV503625_T1 | 3109 | 606 | 89.2 | glotblastn |
| 1611 | LNU444 | cotton\|10v1\|CO069493 | 3110 | 608 | 92.4 | globlastp |
| 1612 | LNU444 | cotton\|10v2\|CO069742_P1 | 3111 | 608 | 92 | globlastp |
| 1613 | LNU444 | castorbean\|09v1\|EE254681_P1 | 3112 | 608 | 84.6 | globlastp |
| 1614 | LNU444 | chestnut\|gb170\|SRR006295S0008870_P1 | 3113 | 608 | 84.6 | globlastp |
| 1615 | LNU444 | clementine\|11v1\|CB322234_P1 | 3114 | 608 | 83 | globlastp |
| 1616 | LNU444 | orange\|11v1\|CB322234_P1 | 3114 | 608 | 83 | globlastp |
| 1617 | LNU444 | citrus\|gb166\|CB322234_P1 | 3114 | 608 | 83 | globlastp |
| 1618 | LNU444 | tamarix\|gb166\|CD151484 | 3115 | 608 | 82.5 | globlastp |
| 1619 | LNU444 | spurge\|gb161\|DR066805 | 3116 | 608 | 82.2 | globlastp |
| 1620 | LNU444 | cleome_gynandra\|10v1\|SRR015532S0000170_P1 | 3117 | 608 | 81.7 | globlastp |
| 1621 | LNU444 | cleome_spinosa\|10v1\|GR931499_P1 | 3118 | 608 | 81.7 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1622 | LNU444 | beech\|gb170\|AM062846_T1 | 3119 | 608 | 81.03 | glotblastn |
| 1623 | LNU444 | cucumber\|09v1\|AA660032_P1 | 3120 | 608 | 80.9 | globlastp |
| 1624 | LNU444 | cowpea\|gb166\|AF139468_P1 | 3121 | 608 | 80.6 | globlastp |
| 1625 | LNU444 | b_juncea\|gb164\|EVGN00773211733256 | 3122 | 608 | 80.5 | globlastp |
| 1626 | LNU444 | eucalyptus\|11v1\|ES591008_P1 | 3123 | 608 | 80.3 | globlastp |
| 1627 | LNU444 | grape\|gb160\|BM436503_P1 | 3124 | 608 | 80.1 | globlastp |
| 1628 | LNU444 | melon\|10v1\|AM716315_P1 | 3125 | 608 | 80.1 | globlastp |
| 1629 | LNU444 | melon\|gb165\|AM716315 | 3125 | 608 | 80.1 | globlastp |
| 1630 | LNU445 | soybean\|11v1\|GLYMA14G08480_P1 | 3126 | 609 | 93.2 | globlastp |
| 1631 | LNU445 | soybean\|gb168\|FK293250 | 3127 | 609 | 89.4 | globlastp |
| 1632 | LNU446 | soybean\|11v1\|GLYMA06G05570_T1 | 3128 | 610 | 96.52 | glotblastn |
| 1633 | LNU446 | pigeonpea\|10v1\|SRR054580S0024764_P1 | 3129 | 610 | 93 | globlastp |
| 1634 | LNU446 | lotus\|09v1\|LLGO005719_P1 | 3130 | 610 | 90.7 | globlastp |
| 1635 | LNU446 | medicago\|09v1\|AW328864_P1 | 3131 | 610 | 88.2 | globlastp |
| 1636 | LNU446 | peanut\|10v1\|GO326813_P1 | 3132 | 610 | 86.9 | globlastp |
| 1637 | LNU446 | soybean\|gb168\|BI968704 | 3133 | 610 | 86.78 | glotblastn |
| 1638 | LNU446 | soybean\|11v1\|GLYMA14G11090_P1 | 3134 | 610 | 84.8 | globlastp |
| 1639 | LNU446 | soybean\|11v1\|GLYMA17G34500_P1 | 3135 | 610 | 84.6 | globlastp |
| 1640 | LNU446 | peanut\|10v1\|CX127972_P1 | 3136 | 610 | 83.4 | globlastp |
| 1641 | LNU446 | prunus\|10v1\|CN940235_P1 | 3137 | 610 | 80.2 | globlastp |
| 1641 | LNU464 | prunus\|10v1\|CN940235_P1 | 3137 | 627 | 81.6 | globlastp |
| 1642 | LNU448 | leymus\|gb166\|EG393138_P1 | 3138 | 612 | 95.3 | globlastp |
| 1643 | LNU448 | wheat\|gb164\|BE404484 | 3139 | 612 | 93.9 | globlastp |
| 1644 | LNU448 | pseudoroegneria\|gb167\|FF342552 | 3140 | 612 | 93.5 | globlastp |
| 1645 | LNU448 | wheat\|10v2\|BE404484_P1 | 3141 | 612 | 93.5 | globlastp |
| 1646 | LNU448 | wheat\|10v2\|BE490784_P1 | 3142 | 612 | 91.1 | globlastp |
| 1647 | LNU448 | wheat\|gb164\|BE405353 | 3143 | 612 | 85.6 | globlastp |
| 1648 | LNU448 | oat\|10v2\|GR366131_P1 | 3144 | 612 | 85.3 | globlastp |
| 1649 | LNU448 | oat\|10v1\|GR366131 | 3145 | 612 | 84.8 | globlastp |
| 1650 | LNU448 | wheat\|gb164\|BE490784 | 3146 | 612 | 83.1 | globlastp |
| 1651 | LNU448 | fescue\|gb161\|CK801098_T1 | 3147 | 612 | 81.49 | glotblastn |
| 1652 | LNU449 | cotton\|10v1\|AI727881 | 3148 | 613 | 89.5 | globlastp |
| 1653 | LNU449 | cotton\|10v2\|BE053391_P1 | 3149 | 613 | 89.5 | globlastp |
| 1654 | LNU449 | cotton\|10v2\|BE054720_P1 | 3150 | 613 | 89.1 | globlastp |
| 1655 | LNU449 | cotton\|10v2\|ES838489_P1 | 3150 | 613 | 89.1 | globlastp |
| 1656 | LNU449 | cotton\|10v1\|BQ410208 | 3150 | 613 | 89.1 | globlastp |
| 1657 | LNU449 | cacao\|10v1\|CA794300_P1 | 3151 | 613 | 88 | globlastp |
| 1658 | LNU449 | cacao\|gb167\|CA794300 | 3152 | 613 | 87.7 | globlastp |
| 1659 | LNU449 | chestnut\|gb170\|SRR006295S0000582_P1 | 3153 | 613 | 87.7 | globlastp |
| 1660 | LNU449 | oak\|10v1\|FP027403_P1 | 3154 | 613 | 87.3 | globlastp |
| 1661 | LNU449 | clementine\|11v1\|CB292027_P1 | 3155 | 613 | 87 | globlastp |
| 1662 | LNU449 | orange\|11v1\|CB292027_P1 | 3156 | 613 | 87 | globlastp |
| 1663 | LNU449 | citrus\|gb166\|CB292027_P1 | 3155 | 613 | 87 | globlastp |
| 1664 | LNU449 | momordica\|10v1\|SRR071315S0012320_P1 | 3157 | 613 | 86.6 | globlastp |
| 1665 | LNU449 | cucumber\|09v1\|AM716760_P1 | 3158 | 613 | 86.2 | globlastp |
| 1666 | LNU449 | papaya\|gb165\|AM904488_P1 | 3159 | 613 | 85.9 | globlastp |
| 1667 | LNU449 | oak\|10v1\|SRR006309S0002232_T1 | 3160 | 613 | 85.51 | glotblastn |
| 1668 | LNU449 | melon\|10v1\|AM716760_P1 | 3161 | 613 | 85.5 | globlastp |
| 1669 | LNU449 | tea\|10v1\|GH159051 | 3162 | 613 | 84.8 | globlastp |
| 1670 | LNU449 | melon\|gb165\|AM716760 | 3163 | 613 | 84.42 | glotblastn |
| 1671 | LNU449 | eucalyptus\|11v1\|CD668460_P1 | 3164 | 613 | 84.4 | globlastp |
| 1672 | LNU449 | prunus\|10v1\|AF139498_P1 | 3165 | 613 | 84.4 | globlastp |
| 1673 | LNU449 | apple\|gb171\|CN495313_P1 | 3166 | 613 | 84.4 | globlastp |
| 1674 | LNU449 | poplar\|10v1\|BI131224_P1 | 3167 | 613 | 84.4 | globlastp |
| 1675 | LNU449 | eschscholzia\|10v1\|CD476462_P1 | 3168 | 613 | 84.1 | globlastp |
| 1676 | LNU449 | prunus\|gb167\|AF139498 | 3169 | 613 | 84.1 | globlastp |
| 1677 | LNU449 | castorbean\|09v1\|EE257410_P1 | 3170 | 613 | 83.7 | globlastp |
| 1678 | LNU449 | coffea\|10v1\|DV665955_P1 | 3171 | 613 | 83.7 | globlastp |
| 1679 | LNU449 | poplar\|10v1\|BU820883_P1 | 3172 | 613 | 83.7 | globlastp |
| 1680 | LNU449 | tobacco\|gb162\|DW002390 | 3173 | 613 | 83.7 | globlastp |
| 1681 | LNU449 | apple\|gb171\|CN865353_P1 | 3174 | 613 | 83.3 | globlastp |
| 1682 | LNU449 | liriodendron\|gb166\|DT601421_P1 | 3175 | 613 | 83.3 | globlastp |
| 1683 | LNU449 | tobacco\|gb162\|EB425519 | 3176 | 613 | 83 | globlastp |
| 1684 | LNU449 | cassava\|09v1\|BM259855_P1 | 3177 | 613 | 82.6 | globlastp |
| 1685 | LNU449 | grape\|gb160\|CB343473_P1 | 3178 | 613 | 82.6 | globlastp |
| 1686 | LNU449 | spurge\|gb161\|BI962025 | 3179 | 613 | 82.6 | globlastp |
| 1687 | LNU449 | petunia\|gb171\|FN001394_P1 | 3180 | 613 | 82.2 | globlastp |
| 1688 | LNU449 | potato\|10v1\|BE920222_P1 | 3181 | 613 | 82.2 | globlastp |
| 1689 | LNU449 | solanum_phureja\|09v1\|SPHBG127776 | 3181 | 613 | 82.2 | globlastp |
| 1690 | LNU449 | sunflower\|10v1\|CD847752_P1 | 3182 | 613 | 82.2 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1691 | LNU449 | sunflower\|gb162\|CD847752 | 3182 | 613 | 82.2 | globlastp |
| 1692 | LNU449 | tragopogon\|10v1\|SRR020205S0015413 | 3183 | 613 | 82.2 | globlastp |
| 1693 | LNU449 | liriodendron\|gb166\|CO996218__P1 | 3184 | 613 | 81.9 | globlastp |
| 1694 | LNU449 | petunia\|gb171\|CV292815__P1 | 3185 | 613 | 81.9 | globlastp |
| 1695 | LNU449 | tomato\|09v1\|BG127776 | 3186 | 613 | 81.9 | globlastp |
| 1696 | LNU449 | lettuce\|10v1\|DW076391__T1 | 3187 | 613 | 81.88 | glotblastn |
| 1697 | LNU449 | centaurea\|gb166\|EH724535__P1 | 3188 | 613 | 81.5 | globlastp |
| 1698 | LNU449 | cichorium\|gb171\|DT213172__P1 | 3189 | 613 | 81.5 | globlastp |
| 1699 | LNU449 | coffea\|10v1\|DV664677__P1 | 3190 | 613 | 81.5 | globlastp |
| 1700 | LNU449 | eggplant\|10v1\|FS002597__P1 | 3191 | 613 | 81.5 | globlastp |
| 1701 | LNU449 | lotus\|09v1\|LLAI967358__P1 | 3192 | 613 | 81.5 | globlastp |
| 1702 | LNU449 | parthenium\|10v1\|GW781311__P1 | 3193 | 613 | 81.2 | globlastp |
| 1703 | LNU449 | pigeonpea\|10v1\|SRR054580S0001717__P1 | 3194 | 613 | 81.2 | globlastp |
| 1704 | LNU449 | pepper\|gb171\|BM068079__P1 | 3195 | 613 | 81.2 | globlastp |
| 1705 | LNU449 | oak\|10v1\|FP028757__P1 | 3196 | 613 | 80.8 | globlastp |
| 1706 | LNU449 | peanut\|10v1\|ES707534__P1 | 3197 | 613 | 80.8 | globlastp |
| 1707 | LNU449 | avocado\|10v1\|CK751924__T1 | 3198 | 613 | 80.8 | glotblastn |
| 1708 | LNU449 | ipomoea_nil\|10v1\|BJ559339__P1 | 3199 | 613 | 80.8 | globlastp |
| 1709 | LNU449 | lettuce\|10v1\|DW054122__P1 | 3200 | 613 | 80.8 | globlastp |
| 1710 | LNU449 | nasturtium\|10v1\|SRR032558S0042354__T1 | 3201 | 613 | 80.8 | glotblastn |
| 1711 | LNU449 | strawberry\|11v1\|CO816865__P1 | 3202 | 613 | 80.8 | globlastp |
| 1712 | LNU449 | strawberry\|gb164\|CO816865 | 3202 | 613 | 80.8 | globlastp |
| 1713 | LNU449 | senecio\|gb170\|DY658995 | 3203 | 613 | 80.4 | globlastp |
| 1714 | LNU449 | sunflower\|10v1\|DY945543__P1 | 3204 | 613 | 80.4 | globlastp |
| 1715 | LNU449 | sunflower\|gb162\|DY945543 | 3204 | 613 | 80.4 | globlastp |
| 1716 | LNU451 | solanum_phureja\|09v1\|SPHBG124246 | 3205 | 615 | 96.1 | globlastp |
| 1717 | LNU451 | pepper\|gb171\|CA523377__P1 | 3206 | 615 | 91.4 | globlastp |
| 1718 | LNU451 | tobacco\|gb162\|DV160269 | 3207 | 615 | 86.4 | globlastp |
| 1719 | LNU451 | monkeyflower\|10v1\|DV209953__P1 | 3208 | 615 | 80 | globlastp |
| 1720 | LNU453 | maize\|10v1\|AW400263__P1 | 3209 | 616 | 93.1 | globlastp |
| 1721 | LNU453 | maize\|10v1\|DW740014__P1 | 3210 | 616 | 81.5 | globlastp |
| 1722 | LNU453 | maize\|gb170\|DW740014 | 3210 | 616 | 81.5 | globlastp |
| 1723 | LNU453 | switchgrass\|gb167\|FL712148 | 3211 | 616 | 81.36 | glotblastn |
| 1724 | LNU455 | potato\|10v1\|BG888608__P1 | 3212 | 618 | 96.7 | globlastp |
| 1725 | LNU455 | solanum_phureja\|09v1\|SPHBG626661 | 3212 | 618 | 96.7 | globlastp |
| 1726 | LNU455 | tobacco\|gb162\|EB426860 | 3213 | 618 | 90 | globlastp |
| 1727 | LNU455 | nicotiana_benthamiana\|gb162\|EX534033__P1 | 3214 | 618 | 88.6 | globlastp |
| 1728 | LNU455 | petunia\|gb171\|CV296478__P1 | 3215 | 618 | 87.6 | globlastp |
| 1729 | LNU456 | wheat\|gb164\|BE216917 | 3216 | 619 | 95.4 | globlastp |
| 1730 | LNU456 | wheat\|10v2\|BE216917__P1 | 3217 | 619 | 95.4 | globlastp |
| 1731 | LNU456 | pseudoroegneria\|gb167\|FF367249 | 3218 | 619 | 94.9 | globlastp |
| 1732 | LNU456 | wheat\|gb164\|BF293470 | 3219 | 619 | 94.9 | globlastp |
| 1733 | LNU456 | wheat\|gb164\|BF474913 | 3220 | 619 | 94.5 | globlastp |
| 1734 | LNU456 | brachypodium\|09v1\|GT778786__P1 | 3221 | 619 | 85 | globlastp |
| 1735 | LNU457 | tomato\|09v1\|BQ512773__T1 | 3222 | 620 | 89.69 | glotblastn |
| 1736 | LNU460 | sugarcane\|10v1\|CA079961 | 3223 | 623 | 94.2 | globlastp |
| 1737 | LNU460 | sorghum\|09v1\|SB01G001140 | 3224 | 623 | 93.7 | globlastp |
| 1738 | LNU460 | switchgrass\|gb167\|FE610157 | 3225 | 623 | 89.3 | globlastp |
| 1739 | LNU460 | wheat\|10v2\|BG606900__P1 | 3226 | 623 | 86.5 | globlastp |
| 1740 | LNU460 | rice\|gb170\|OS03G63330 | 3227 | 623 | 85.1 | globlastp |
| 1741 | LNU460 | brachypodium\|09v1\|DV485015__P1 | 3228 | 623 | 84.9 | globlastp |
| 1742 | LNU460 | wheat\|gb164\|BE429280 | 3229 | 623 | 83 | globlastp |
| 1743 | LNU460 | fescue\|gb161\|DT685320__P1 | 3230 | 623 | 82.4 | globlastp |
| 1744 | LNU460 | oat\|10v2\|CN817353__T1 | 3231 | 623 | 82.39 | glotblastn |
| 1745 | LNU460 | oat\|10v1\|CN817353 | 3232 | 623 | 82.39 | glotblastn |
| 1746 | LNU460 | wheat\|10v2\|BE429280__T1 | 3233 | 623 | 80 | glotblastn |
| 1747 | LNU462 | solanum_phureja\|09v1\|SPHAI896771 | 3234 | 625 | 93.1 | globlastp |
| 1748 | LNU462 | tomato\|09v1\|BG630881 | 3235 | 625 | 80.7 | globlastp |
| 1749 | LNU462 | solanum_phureja\|09v1\|SPHBG630881 | 3236 | 625 | 80.5 | globlastp |
| 1750 | LNU464 | oak\|10v1\|FP067463__P1 | 3237 | 627 | 83.3 | globlastp |
| 1751 | LNU464 | monkeyflower\|10v1\|GR019400__P1 | 3238 | 627 | 80.1 | globlastp |
| 1752 | LNU466 | wheat\|10v2\|BE443236__P1 | 3239 | 629 | 97 | globlastp |
| 1753 | LNU466 | wheat\|gb164\|BE443236 | 3240 | 629 | 91.6 | globlastp |
| 1754 | LNU466 | brachypodium\|09v1\|GT778423__P1 | 3241 | 629 | 91.1 | globlastp |
| 1755 | LNU466 | wheat\|10v2\|CA497187__P1 | 3242 | 629 | 82.9 | globlastp |
| 1756 | LNU466 | rice\|gb170\|OS12G39160 | 3243 | 629 | 82.8 | globlastp |
| 1757 | LNU466 | sorghum\|09v1\|SB01G014910 | 3244 | 629 | 81.7 | globlastp |
| 1758 | LNU466 | rice\|gb170\|OS03G40930 | 3245 | 629 | 80.8 | globlastp |
| 1759 | LNU466 | brachypodium\|09v1\|GT822143__P1 | 3246 | 629 | 80.6 | globlastp |
| 1760 | LNU467 | wheat\|10v2\|BE418022XX1__P1 | 3247 | 630 | 96 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1761 | LNU467 | wheat\|gb164\|BE418022 | 3248 | 630 | 95.8 | globlastp |
| 1762 | LNU467 | brachypodium\|09v1\|GT768192_P1 | 3249 | 630 | 85.9 | globlastp |
| 1763 | LNU467 | rice\|gb170\|OS01G33800 | 3250 | 630 | 80.3 | globlastp |
| 1764 | LNU468 | potato\|10v1\|BI405533_P1 | 3251 | 631 | 97.1 | globlastp |
| 1765 | LNU468 | solanum_phureja\|09v1\|SPHAI637280 | 3251 | 631 | 97.1 | globlastp |
| 1766 | LNU469 | sorghum\|09v1\|SB06G024340 | 3252 | 632 | 90.5 | globlastp |
| 1767 | LNU472 | switchgrass\|gb167\|FL834062 | 3253 | 635 | 85.2 | globlastp |
| 1768 | LNU472 | sorghum\|09v1\|SB03G023773 | 3254 | 635 | 83.6 | globlastp |
| 1769 | LNU472 | millet\|10v1\|PMSLX0282794D1_P1 | 3255 | 635 | 83 | globlastp |
| 1770 | LNU473 | maize\|10v1\|CD956410_P1 | 3256 | 636 | 92.3 | globlastp |
| 1771 | LNU473 | maize\|gb170\|LLCD956410 | 3256 | 636 | 92.3 | globlastp |
| 1772 | LNU473 | foxtail_millet\|10v2\|SICRP007698_T1 | 3257 | 636 | 87.03 | glotblastn |
| 1773 | LNU477 | sugarcane\|10v1\|BQ532957 | 3258 | 639 | 99.4 | globlastp |
| 1774 | LNU477 | foxtail_millet\|10v2\|SICRP038587_P1 | 3259 | 639 | 98.4 | globlastp |
| 1775 | LNU477 | switchgrass\|gb167\|FE613133 | 3260 | 639 | 98 | globlastp |
| 1776 | LNU477 | maize\|10v1\|AI944016_P1 | 3261 | 639 | 97.4 | globlastp |
| 1777 | LNU477 | maize\|gb170\|AI944016 | 3261 | 639 | 97.4 | globlastp |
| 1778 | LNU477 | millet\|10v1\|EVO454PM006681_P1 | 3262 | 639 | 96 | globlastp |
| 1779 | LNU477 | wheat\|10v2\|BE604866_P1 | 3263 | 639 | 95.4 | globlastp |
| 1780 | LNU477 | wheat\|gb164\|BE403167 | 3263 | 639 | 95.4 | globlastp |
| 1781 | LNU477 | barley\|10v1\|BE438172 | 3264 | 639 | 95 | globlastp |
| 1782 | LNU477 | barley\|10v2\|BE438172_P1 | 3264 | 639 | 95 | globlastp |
| 1783 | LNU477 | brachypodium\|09v1\|GT769985_P1 | 3265 | 639 | 95 | globlastp |
| 1784 | LNU477 | rice\|gb170\|OS03G21950 | 3266 | 639 | 95 | globlastp |
| 1785 | LNU477 | aristolochia\|10v1\|FD755001_P1 | 3267 | 639 | 87.2 | globlastp |
| 1786 | LNU477 | aquilegia\|10v2\|DR929807_P1 | 3268 | 639 | 86.1 | globlastp |
| 1787 | LNU477 | eucalyptus\|11v1\|CU396262_P1 | 3269 | 639 | 85.8 | globlastp |
| 1788 | LNU477 | prunus\|10v1\|BU040396_P1 | 3270 | 639 | 85.8 | globlastp |
| 1789 | LNU477 | cotton\|10v1\|AI725667 | 3271 | 639 | 85.8 | globlastp |
| 1790 | LNU477 | aquilegia\|10v2\|JGIAC017994_P1 | 3272 | 639 | 85.7 | globlastp |
| 1791 | LNU477 | clementine\|11v1\|CB292429_P1 | 3273 | 639 | 85.6 | globlastp |
| 1791 | LNU477 | orange\|11v1\|CB292429_P1 | 3273 | 639 | 85.6 | globlastp |
| 1792 | LNU477 | cotton\|10v2\|SRR032367S0638081_P1 | 3274 | 639 | 85.6 | globlastp |
| 1793 | LNU477 | oak\|10v1\|FP028605_P1 | 3275 | 639 | 85.6 | globlastp |
| 1794 | LNU477 | cotton\|10v2\|SRR032367S0193380_P1 | 3276 | 639 | 85.6 | globlastp |
| 1795 | LNU477 | citrus\|gb166\|CB292429_P1 | 3273 | 639 | 85.6 | globlastp |
| 1796 | LNU477 | cotton\|10v2\|SRR032367S0065913_T1 | 3277 | 639 | 85.03 | glotblastn |
| 1797 | LNU477 | melon\|10v1\|DV631444_P1 | 3278 | 639 | 85 | globlastp |
| 1798 | LNU477 | apple\|gb171\|CN489928_P1 | 3279 | 639 | 84.8 | globlastp |
| 1799 | LNU477 | poplar\|10v1\|BI069889_P1 | 3280 | 639 | 84.8 | globlastp |
| 1800 | LNU477 | cacao\|10v1\|CU584416_P1 | 3281 | 639 | 84.6 | globlastp |
| 1801 | LNU477 | bean\|gb167\|CA900306_P1 | 3282 | 639 | 84.6 | globlastp |
| 1802 | LNU477 | cowpea\|gb166\|FF390148_P1 | 3283 | 639 | 84.6 | globlastp |
| 1803 | LNU477 | monkeyflower\|10v1\|GR015985_P1 | 3284 | 639 | 84.4 | globlastp |
| 1804 | LNU477 | triphysaria\|10v1\|DR173958 | 3285 | 639 | 84.3 | globlastp |
| 1805 | LNU477 | lotus\|09v1\|CB826761_P1 | 3286 | 639 | 84.2 | globlastp |
| 1806 | LNU477 | sunflower\|10v1\|DY921185_P1 | 3287 | 639 | 84.2 | globlastp |
| 1807 | LNU477 | strawberry\|11v1\|CO381683_P1 | 3288 | 639 | 84 | globlastp |
| 1808 | LNU477 | orobanche\|10v1\|SRR023189S0000238_P1 | 3289 | 639 | 84 | globlastp |
| 1809 | LNU477 | zostera\|10v1\|SRR057351S0001126_P1 | 3290 | 639 | 83.9 | globlastp |
| 1810 | LNU477 | arabidopsis_lyrata\|09v1\|JGIAL016174_P1 | 3291 | 639 | 83.8 | globlastp |
| 1811 | LNU477 | soybean\|11v1\|GLYMA10G02040_P1 | 3292 | 639 | 83.8 | globlastp |
| 1812 | LNU477 | soybean\|gb168\|AL374333 | 3293 | 639 | 83.8 | globlastp |
| 1813 | LNU477 | sunflower\|gb162\|DY921185 | 3294 | 639 | 83.8 | globlastp |
| 1814 | LNU477 | soybean\|11v1\|GLYMA02G01920_P1 | 3295 | 639 | 83.8 | globlastp |
| 1815 | LNU477 | dandelion\|10v1\|DY805862_T1 | 3296 | 639 | 83.73 | glotblastn |
| 1816 | LNU477 | arabidopsis\|10v1\|AT2G47510_P1 | 3297 | 639 | 83.6 | globlastp |
| 1817 | LNU477 | arabidopsis\|gb165\|AT2G47510 | 3297 | 639 | 83.6 | globlastp |
| 1818 | LNU477 | radish\|gb164\|EV529214 | 3298 | 639 | 83.4 | globlastp |
| 1819 | LNU477 | soybean\|gb168\|CA900306 | 3299 | 639 | 83.4 | globlastp |
| 1820 | LNU477 | centaurea\|gb166\|EH721673_T1 | 3300 | 639 | 83.13 | glotblastn |
| 1821 | LNU477 | lettuce\|10v1\|DW046954_T1 | 3301 | 639 | 83.13 | glotblastn |
| 1822 | LNU477 | podocarpus\|10v1\|SRR065014S0003290_T1 | 3302 | 639 | 83.03 | glotblastn |
| 1823 | LNU477 | sunflower\|10v1\|DY911213_P1 | 3303 | 639 | 83 | globlastp |
| 1824 | LNU477 | pepper\|gb171\|BM064125_P1 | 3304 | 639 | 83 | globlastp |
| 1825 | LNU477 | pigeonpea\|10v1\|SRR054580S0047814_P1 | 3305 | 639 | 82.8 | globlastp |
| 1826 | LNU477 | potato\|10v1\|BG591774_P1 | 3306 | 639 | 82.6 | globlastp |
| 1827 | LNU477 | solanum_phureja\|09v1\|SPHAI895415 | 3306 | 639 | 82.6 | globlastp |
| 1828 | LNU477 | tomato\|09v1\|AW648564 | 3307 | 639 | 82.4 | globlastp |
| 1829 | LNU477 | tomato\|09v1\|BG642408 | 3308 | 639 | 82.2 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1830 | LNU477 | dandelion\|gb161\|DY805862 | 3309 | 639 | 82 | globlastp |
| 1831 | LNU477 | prunus\|gb167\|BU040396 | 3310 | 639 | 81.93 | glotblastn |
| 1832 | LNU477 | cassava\|09v1\|CK649367__P1 | 3311 | 639 | 81.9 | globlastp |
| 1833 | LNU477 | medicago\|09v1\|AL374333__P1 | 3312 | 639 | 81.8 | globlastp |
| 1834 | LNU477 | spruce\|gb162\|CO222288 | 3313 | 639 | 81.8 | globlastp |
| 1835 | LNU477 | antirrhinum\|gb166\|AJ558600__T1 | 3314 | 639 | 81.73 | glotblastn |
| 1836 | LNU477 | artemisia\|10v1\|EY076361__P1 | 3315 | 639 | 81.7 | globlastp |
| 1837 | LNU477 | b_rapa\|gb162\|CV434106__P1 | 3316 | 639 | 81.7 | globlastp |
| 1838 | LNU477 | pine\|10v2\|BF049732__P1 | 3317 | 639 | 81.6 | globlastp |
| 1839 | LNU477 | arabidopsis\|10v1\|AT5G50950__P1 | 3318 | 639 | 81.6 | globlastp |
| 1840 | LNU477 | arabidopsis\|gb165\|AT5G50950 | 3318 | 639 | 81.6 | globlastp |
| 1841 | LNU477 | pine\|10v1\|BE996818 | 3317 | 639 | 81.6 | globlastp |
| 1842 | LNU477 | pseudotsuga\|10v1\|SRR065119S0016339__P1 | 3319 | 639 | 81.5 | globlastp |
| 1843 | LNU477 | castorbean\|09v1\|EV520386__P1 | 3320 | 639 | 81.4 | globlastp |
| 1844 | LNU477 | arabidopsis_lyrata\|09v1\|JGIAL029515__P1 | 3321 | 639 | 81 | globlastp |
| 1845 | LNU477 | canola\|10v1\|CD835523__P1 | 3322 | 639 | 80.8 | globlastp |
| 1846 | LNU477 | cucumber\|09v1\|ES597099__P1 | 3323 | 639 | 80.2 | globlastp |
| 1847 | LNU479 | sugarcane\|10v1\|CA099284 | 3324 | 640 | 91.9 | globlastp |
| 1848 | LNU479 | maize\|10v1\|AI615138__P1 | 3325 | 640 | 89.5 | globlastp |
| 1849 | LNU479 | maize\|gb170\|AI615138 | 3325 | 640 | 89.5 | globlastp |
| 1850 | LNU479 | maize\|10v1\|AI740031__P1 | 3326 | 640 | 88.5 | globlastp |
| 1851 | LNU479 | maize\|gb170\|AI740031 | 3326 | 640 | 88.5 | globlastp |
| 1852 | LNU479 | foxtail_millet\|10v2\|SICRP003741__P1 | 3327 | 640 | 80.7 | globlastp |
| 1853 | LNU480 | maize\|10v1\|AW018101__P1 | 3328 | 641 | 96.7 | globlastp |
| 1854 | LNU480 | maize\|gb170\|AW018101 | 3328 | 641 | 96.7 | globlastp |
| 1855 | LNU480 | rice\|gb170\|OS03G60460 | 3329 | 641 | 92.6 | globlastp |
| 1856 | LNU480 | brachypodium\|09v1\|GT768427__P1 | 3330 | 641 | 90.2 | globlastp |
| 1857 | LNU480 | millet\|10v1\|CD725477__P1 | 3331 | 641 | 80.4 | globlastp |
| 1858 | LNU481 | maize\|10v1\|BM348553__P1 | 3332 | 642 | 86.5 | globlastp |
| 1859 | LNU481 | maize\|gb170\|BM348553 | 3332 | 642 | 86.5 | globlastp |
| 1860 | LNU481 | switchgrass\|gb167\|FE624299 | 3333 | 642 | 81.8 | globlastp |
| 1861 | LNU481 | foxtail_millet\|10v2\|FXTRMSLX00502435D1__P1 | 3334 | 642 | 81.4 | globlastp |
| 1862 | LNU481 | switchgrass\|gb167\|DN141959 | 3335 | 642 | 81.3 | globlastp |
| 1863 | LNU486 | rice\|gb170\|OS08G04540 | 3336 | 646 | 87.4 | globlastp |
| 1864 | LNU486 | millet\|10v1\|EVO454PM108169__P1 | 3337 | 646 | 85.9 | globlastp |
| 1865 | LNU486 | maize\|10v1\|DR797096__P1 | 3338 | 646 | 84.5 | globlastp |
| 1866 | LNU486 | maize\|gb170\|DR797096 | 3338 | 646 | 84.5 | globlastp |
| 1867 | LNU486 | millet\|10v1\|PMSLX0008075D1__P1 | 3339 | 646 | 84.3 | globlastp |
| 1868 | LNU486 | sorghum\|09v1\|SB07G003020 | 3340 | 646 | 84.3 | globlastp |
| 1869 | LNU486 | brachypodium\|09v1\|SRR031795S0042968__P1 | 3341 | 646 | 84.2 | globlastp |
| 1870 | LNU486 | sorghum\|09v1\|SB07G003040 | 3342 | 646 | 83.7 | globlastp |
| 1871 | LNU486 | maize\|10v1\|DT650994__P1 | 3343 | 646 | 83.6 | globlastp |
| 1872 | LNU486 | maize\|gb170\|SRR014549S0325734 | 3344 | 646 | 83 | globlastp |
| 1873 | LNU486 | maize\|10v1\|SRR014549S0325735__P1 | 3345 | 646 | 82.7 | globlastp |
| 1874 | LNU486 | brachypodium\|09v1\|GT763377__P1 | 3346 | 646 | 81.6 | globlastp |
| 1875 | LNU486 | brachypodium\|09v1\|SRR031797S0000753__P1 | 3347 | 646 | 81.6 | globlastp |
| 1876 | LNU486 | brachypodium\|09v1\|DV484841__P1 | 3348 | 646 | 81.1 | globlastp |
| 1877 | LNU486 | maize\|10v1\|GRMZM2G441632T01__P1 | 3349 | 646 | 81.1 | globlastp |
| 1878 | LNU486 | barley\|10v1\|BI947839 | 3350 | 646 | 80.9 | globlastp |
| 1879 | LNU486 | brachypodium\|09v1\|DV473894__P1 | 3351 | 646 | 80.9 | globlastp |
| 1880 | LNU486 | maize\|gb170\|CRPZM2N004754 | 3352 | 646 | 80.7 | globlastp |
| 1881 | LNU486 | wheat\|10v2\|BM135610__P1 | 3353 | 646 | 80.5 | globlastp |
| 1882 | LNU486 | barley\|10v2\|BI951142__P1 | 3354 | 646 | 80.5 | globlastp |
| 1883 | LNU486 | brachypodium\|09v1\|BRADI2G02370__P1 | 3355 | 646 | 80 | globlastp |
| 1884 | LNU489 | solanum_phureja\|09v1\|SPHBG132312 | 3356 | 647 | 97.5 | globlastp |
| 1885 | LNU490 | poplar\|10v1\|BU808912__T1 | 3357 | 648 | 86.43 | glotblastn |
| 1886 | LNU490 | castorbean\|09v1\|XM002517212__P1 | 3358 | 648 | 84.3 | globlastp |
| 1887 | LNU490 | cassava\|09v1\|DB921878__P1 | 3359 | 648 | 80.7 | globlastp |
| 1888 | LNU492 | switchgrass\|gb167\|DN145159 | 3360 | 650 | 89.76 | glotblastn |
| 1889 | LNU492 | millet\|10v1\|EVO454PM001690__P1 | 3361 | 650 | 89.4 | globlastp |
| 1890 | LNU492 | sorghum\|09v1\|SB02G042100 | 3362 | 650 | 89.12 | globlastp |
| 1891 | LNU492 | brachypodium\|09v1\|GT758722__P1 | 3363 | 650 | 87.1 | globlastp |
| 1892 | LNU492 | maize\|gb170\|AW067292 | 3364 | 650 | 85.74 | glotblastn |
| 1893 | LNU492 | barley\|10v1\|AV834942 | 3365 | 650 | 85.1 | globlastp |
| 1894 | LNU492 | barley\|10v2\|AV834942__P1 | 3365 | 650 | 85.1 | globlastp |
| 1895 | LNU492 | maize\|10v1\|AW067292__T1 | 3366 | 650 | 85.01 | glotblastn |
| 1896 | LNU493 | switchgrass\|gb167\|DN144413 | 3367 | 651 | 86.4 | globlastp |
| 1897 | LNU493 | oat\|10v2\|GR318288__P1 | 3368 | 651 | 86.1 | globlastp |
| 1898 | LNU493 | oat\|10v1\|GR318288 | 3368 | 651 | 86.1 | globlastp |
| 1899 | LNU493 | wheat\|10v2\|BQ166641__P1 | 3369 | 651 | 85.7 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1900 | LNU493 | wheat\|10v2\|BF478823__P1 | 3370 | 651 | 85.4 | globlastp |
| 1901 | LNU493 | brachypodium\|09v1\|DV469482__P1 | 3371 | 651 | 85.2 | globlastp |
| 1902 | LNU493 | wheat\|gb164\|BF478823 | 3372 | 651 | 85.2 | globlastp |
| 1903 | LNU493 | sugarcane\|10v1\|BU102536 | 3373 | 651 | 84.94 | glotblastn |
| 1904 | LNU493 | millet\|10v1\|EB411086__T1 | 3374 | 651 | 84.63 | glotblastn |
| 1905 | LNU493 | sorghum\|09v1\|SB10G020910 | 3375 | 651 | 84.48 | glotblastn |
| 1906 | LNU493 | wheat\|gb164\|BI751896 | 3376 | 651 | 84.4 | globlastp |
| 1907 | LNU493 | wheat\|10v2\|BI751896__T1 | 3377 | 651 | 84.08 | glotblastn |
| 1908 | LNU493 | barley\|10v1\|AV833693 | 3378 | 651 | 83.4 | globlastp |
| 1909 | LNU493 | barley\|10v2\|AV833693__P1 | 3378 | 651 | 83.4 | globlastp |
| 1910 | LNU493 | maize\|gb170\|AI902081 | 3379 | 651 | 82.7 | globlastp |
| 1911 | LNU493 | maize\|10v1\|AI902081__P1 | 3380 | 651 | 82.5 | globlastp |
| 1912 | LNU493 | pseudoroegneria\|gb167\|FF349115 | 3381 | 651 | 81.8 | glotblastn |
| 1913 | LNU493 | leymus\|gb166\|EG376779__P1 | 3382 | 651 | 81.1 | globlastp |
| 1914 | LNU494 | sorghum\|09v1\|SB02G011210 | 3383 | 652 | 86.8 | globlastp |
| 1915 | LNU494 | maize\|gb170\|BI478378 | 3384 | 652 | 80.32 | glotblastn |
| 1916 | LNU496 | barley\|10v1\|CD054173 | 3385 | 654 | 87.3 | globlastp |
| 1917 | LNU496 | barley\|10v2\|CD054173__P1 | 3385 | 654 | 87.3 | globlastp |
| 1918 | LNU496 | brachypodium\|09v1\|DV473745__P1 | 3386 | 654 | 85.3 | globlastp |
| 1919 | LNU496 | rice\|gb170\|OS06G46330 | 3387 | 654 | 80.6 | globlastp |
| 1919 | LNU520 | rice\|gb170\|OS06G46330 | 3387 | 675 | 80.9 | globlastp |
| 1920 | LNU497 | wheat\|10v2\|BE405826XX1__P1 | 3388 | 655 | 95.1 | globlastp |
| 1921 | LNU497 | leymus\|gb166\|CD808855__P1 | 3389 | 655 | 93.7 | globlastp |
| 1922 | LNU497 | barley\|10v1\|BE437367 | 3390 | 655 | 92.3 | globlastp |
| 1923 | LNU497 | barley\|10v2\|BE437367__T1 | 3391 | 655 | 92.08 | glotblastn |
| 1924 | LNU497 | barley\|10v1\|BI951306 | 3392 | 655 | 91.8 | globlastp |
| 1925 | LNU497 | barley\|10v2\|BI951306__P1 | 3392 | 655 | 91.8 | globlastp |
| 1926 | LNU497 | wheat\|gb164\|BE400632 | 3393 | 655 | 91.8 | glotblastn |
| 1927 | LNU497 | wheat\|10v2\|BE400632__P1 | 3394 | 655 | 91.3 | globlastp |
| 1928 | LNU497 | wheat\|10v2\|BE400438__P1 | 3395 | 655 | 90.2 | globlastp |
| 1929 | LNU497 | wheat\|gb164\|BE399352 | 3396 | 655 | 88.7 | globlastp |
| 1930 | LNU497 | wheat\|gb164\|BE405826 | 3397 | 655 | 87.9 | globlastp |
| 1931 | LNU497 | wheat\|gb164\|BE400438 | 3398 | 655 | 85.9 | globlastp |
| 1932 | LNU497 | oat\|10v2\|CN815673__P1 | 3399 | 655 | 84.3 | globlastp |
| 1933 | LNU497 | brachypodium\|09v1\|DV469731__P1 | 3400 | 655 | 83.9 | globlastp |
| 1934 | LNU497 | wheat\|gb164\|CA607613 | 3401 | 655 | 82.8 | globlastp |
| 1935 | LNU498 | sugarcane\|10v1\|CA120232 | 3402 | 656 | 94.9 | globlastp |
| 1936 | LNU498 | switchgrass\|gb167\|GD007288 | 3403 | 656 | 90.5 | globlastp |
| 1937 | LNU498 | brachypodium\|09v1\|GT763740__P1 | 3404 | 656 | 82.7 | globlastp |
| 1937 | LNU499 | brachypodium\|09v1\|GT763740__P1 | 3404 | 657 | 85.6 | globlastp |
| 1938 | LNU498 | rice\|gb170\|OS07G05365 | 3405 | 656 | 82 | globlastp |
| 1938 | LNU499 | rice\|gb170\|OS07G05365 | 3405 | 657 | 80.6 | globlastp |
| 1939 | LNU498 | wheat\|10v2\|BE591194__P1 | 3406 | 656 | 80.6 | globlastp |
| 1939 | LNU499 | wheat\|10v2\|BE591194__P1 | 3406 | 657 | 94.2 | globlastp |
| 1940 | LNU499 | fescue\|gb161\|CK801688__P1 | 3407 | 657 | 88.5 | globlastp |
| 1941 | LNU500 | potato\|10v1\|BF153480__P1 | 3408 | 658 | 97.9 | globlastp |
| 1942 | LNU500 | solanum_phureja\|09v1\|SPHBG127476 | 3408 | 658 | 97.9 | globlastp |
| 1943 | LNU500 | tobacco\|gb162\|EB677931 | 3409 | 658 | 92.9 | globlastp |
| 1944 | LNU500 | melon\|10v1\|AM720613__P1 | 3410 | 658 | 83.6 | globlastp |
| 1945 | LNU500 | triphysaria\|10v1\|DR171672 | 3411 | 658 | 82.8 | globlastp |
| 1946 | LNU500 | cucumber\|09v1\|CK760287__P1 | 3412 | 658 | 82.7 | globlastp |
| 1947 | LNU500 | melon\|gb165\|AM720613 | 3413 | 658 | 82.4 | globlastp |
| 1948 | LNU500 | oak\|10v1\|FP033820__P1 | 3414 | 658 | 82.2 | globlastp |
| 1949 | LNU500 | cotton\|10v1\|BQ407081 | 3415 | 658 | 82.1 | globlastp |
| 1950 | LNU500 | monkeyflower\|10v1\|CV517084__P1 | 3416 | 658 | 82.1 | globlastp |
| 1951 | LNU500 | citrus\|gb166\|CX073916__P1 | 3417 | 658 | 82 | globlastp |
| 1952 | LNU500 | arabidopsis_lyrata\|09v1\|JGIAL009912__P1 | 3418 | 658 | 81.7 | globlastp |
| 1953 | LNU500 | bean\|gb167\|CA900254__P1 | 3419 | 658 | 81.7 | globlastp |
| 1954 | LNU500 | b_rapa\|gb162\|CX268091__P1 | 3420 | 658 | 81.4 | globlastp |
| 1955 | LNU500 | medicago\|09v1\|AW689365__P1 | 3421 | 658 | 81.2 | globlastp |
| 1956 | LNU500 | poplar\|10v1\|BI072351__P1 | 3422 | 658 | 81.2 | globlastp |
| 1957 | LNU500 | canola\|10v1\|CD825188__P1 | 3423 | 658 | 81 | globlastp |
| 1958 | LNU500 | soybean\|11v1\|GLYMA19G36580__P1 | 3424 | 658 | 81 | globlastp |
| 1959 | LNU500 | soybean\|gb168\|BU545791 | 3424 | 658 | 81 | globlastp |
| 1960 | LNU500 | cotton\|10v1\|BG440074 | 3425 | 658 | 80.9 | globlastp |
| 1961 | LNU500 | cotton\|10v2\|BG440074__P1 | 3426 | 658 | 80.9 | globlastp |
| 1962 | LNU500 | arabidopsis\|10v1\|AT3G14390__P1 | 3427 | 658 | 80.8 | globlastp |
| 1963 | LNU500 | arabidopsis\|gb165\|AT3G14390 | 3427 | 658 | 80.8 | globlastp |
| 1964 | LNU500 | nasturtium\|10v1\|SRR032558S0026061__P1 | 3428 | 658 | 80.7 | globlastp |
| 1965 | LNU500 | soybean\|11v1\|GLYMA03G33830__P1 | 3429 | 658 | 80.6 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 1966 | LNU500 | soybean\|gb168\|AW689365 | 3429 | 658 | 80.6 | globlastp |
| 1967 | LNU500 | castorbean\|09v1\|EE260114_P1 | 3430 | 658 | 80.4 | globlastp |
| 1968 | LNU500 | eucalyptus\|11v1\|SRR001659X10631_P1 | 3431 | 658 | 80.2 | globlastp |
| 1969 | LNU500 | prunus\|10v1\|BU041335_P1 | 3432 | 658 | 80.2 | globlastp |
| 1970 | LNU500 | poplar\|10v1\|CF233615_P1 | 3433 | 658 | 80.2 | globlastp |
| 1971 | LNU500 | cassava\|09v1\|CK645527_P1 | 3434 | 658 | 80.2 | globlastp |
| 1972 | LNU500 | canola\|10v1\|CN830386_P1 | 3435 | 658 | 80.1 | globlastp |
| 1973 | LNU500 | sunflower\|gb162\|CX947049 | 3436 | 658 | 80.1 | globlastp |
| 1974 | LNU501 | sugarcane\|10v1\|BQ804027 | 3437 | 659 | 99.1 | globlastp |
| 1975 | LNU501 | maize\|10v1\|BM382690_P1 | 3438 | 659 | 97.2 | globlastp |
| 1976 | LNU501 | maize\|gb170\|BM382690 | 3438 | 659 | 97.2 | globlastp |
| 1977 | LNU501 | foxtail_millet\|10v2\|FXTRMSLX00598869D2_P1 | 3439 | 659 | 96.6 | globlastp |
| 1978 | LNU501 | maize\|10v1\|DR817878_P1 | 3440 | 659 | 96.6 | globlastp |
| 1979 | LNU501 | maize\|gb170\|DR817878 | 3440 | 659 | 96.6 | globlastp |
| 1980 | LNU501 | rice\|gb170\|OS06G45280 | 3441 | 659 | 92.3 | globlastp |
| 1981 | LNU501 | brachypodium\|09v1\|GT799485_P1 | 3442 | 659 | 91.1 | globlastp |
| 1982 | LNU501 | wheat\|10v2\|BE605194_P1 | 3443 | 659 | 90.1 | globlastp |
| 1983 | LNU501 | wheat\|gb164\|BE605194 | 3444 | 659 | 89.7 | globlastp |
| 1984 | LNU501 | barley\|10v1\|AJ436214 | 3445 | 659 | 87.6 | globlastp |
| 1985 | LNU501 | barley\|10v2\|AJ436214_P1 | 3445 | 659 | 87.6 | globlastp |
| 1986 | LNU501 | millet\|10v1\|EVO454PM011670_P1 | 3446 | 659 | 85.3 | globlastp |
| 1987 | LNU502 | wheat\|10v2\|BE430987_T1 | 3447 | 660 | 93.45 | glotblastn |
| 1988 | LNU502 | wheat\|gb164\|BE430987 | 3448 | 660 | 93 | globlastp |
| 1989 | LNU502 | rice\|gb170\|OS02G32980 | 3449 | 660 | 85.2 | globlastp |
| 1990 | LNU502 | foxtail_millet\|10v2\|SICRP016205_P1 | 3450 | 660 | 84.8 | globlastp |
| 1991 | LNU502 | millet\|10v1\|CD724444_P1 | 3451 | 660 | 84.8 | globlastp |
| 1992 | LNU502 | brachypodium\|09v1\|SRR031797S0004957_P1 | 3452 | 660 | 83.9 | globlastp |
| 1993 | LNU502 | maize\|10v1\|AW165596_P1 | 3453 | 660 | 80.8 | globlastp |
| 1994 | LNU502 | maize\|gb170\|AW165596 | 3453 | 660 | 80.8 | globlastp |
| 1995 | LNU503 | lovegrass\|gb167\|EH188332_P1 | 3454 | 661 | 86 | globlastp |
| 1996 | LNU503 | switchgrass\|gb167\|FL878118 | 3455 | 661 | 85 | globlastp |
| 1997 | LNU503 | foxtail_millet\|10v2\|SICRP010281_P1 | 3456 | 661 | 84.1 | globlastp |
| 1998 | LNU503 | sorghum\|09v1\|SB06G028260 | 3457 | 661 | 84.1 | globlastp |
| 1999 | LNU503 | switchgrass\|gb167\|FL844303 | 3458 | 661 | 84.1 | globlastp |
| 2000 | LNU503 | millet\|10v1\|EVO454PM635012_P1 | 3459 | 661 | 84.1 | globlastp |
| 2001 | LNU503 | cynodon\|10v1\|ES306614_P1 | 3460 | 661 | 83.2 | globlastp |
| 2002 | LNU503 | millet\|09v1\|EVO454PM652594 | 3461 | 661 | 83.18 | glotblastn |
| 2003 | LNU503 | sugarcane\|10v1\|CA269511 | 3462 | 661 | 83.18 | glotblastn |
| 2004 | LNU503 | cynodon\|10v1\|ES306841_P1 | 3463 | 661 | 82.2 | globlastp |
| 2005 | LNU503 | brachypodium\|09v1\|DV473278_P1 | 3464 | 661 | 82.2 | globlastp |
| 2006 | LNU503 | oat\|10v2\|GR350976_P1 | 3465 | 661 | 81.3 | globlastp |
| 2007 | LNU503 | maize\|10v1\|AI637049_P1 | 3466 | 661 | 81.3 | globlastp |
| 2008 | LNU503 | maize\|gb170\|AI637049 | 3466 | 661 | 81.3 | globlastp |
| 2009 | LNU503 | maize\|gb170\|CF633199 | 3467 | 661 | 81.3 | globlastp |
| 2010 | LNU503 | maize\|gb170\|LLDQ245256 | 3468 | 661 | 81.3 | globlastp |
| 2011 | LNU503 | wheat\|gb164\|BQ483317 | 3468 | 661 | 81.3 | globlastp |
| 2012 | LNU503 | wheat\|gb164\|CK213240 | 3468 | 661 | 81.3 | globlastp |
| 2013 | LNU503 | wheat\|10v2\|BQ483317_P1 | 3468 | 661 | 81.3 | globlastp |
| 2014 | LNU503 | maize\|10v1\|CF633199_P1 | 3469 | 661 | 80.4 | globlastp |
| 2015 | LNU503 | barley\|10v1\|AV910573 | 3470 | 661 | 80.4 | globlastp |
| 2016 | LNU503 | barley\|10v2\|AV910573_P1 | 3470 | 661 | 80.4 | globlastp |
| 2017 | LNU503 | lolium\|10v1\|DT670198_P1 | 3471 | 661 | 80.4 | globlastp |
| 2018 | LNU507 | barley\|10v1\|BQ660103 | 3472 | 664 | 89.4 | globlastp |
| 2019 | LNU507 | wheat\|gb164\|BE425628 | 3473 | 664 | 81 | globlastp |
| 2020 | LNU507 | leymus\|gb166\|EG379808_P1 | 3474 | 664 | 80.3 | globlastp |
| 2021 | LNU507 | wheat\|10v2\|BE425628_T1 | 3475 | 664 | 80.29 | glotblastn |
| 2022 | LNU510 | maize\|10v1\|CO519985_P1 | 3476 | 667 | 82.4 | globlastp |
| 2023 | LNU510 | brachypodium\|09v1\|GT849245_P1 | 3477 | 667 | 80.2 | globlastp |
| 2024 | LNU510 | sorghum\|09v1\|SB10G014190 | 3478 | 667 | 80.2 | glotblastn |
| 2025 | LNU510 | rice\|gb170\|OS06G29994 | 3479 | 667 | 80 | globlastp |
| 2026 | LNU512 | arabidopsis_lyrata\|09v1\|JGIAL012417_P1 | 3480 | 669 | 83 | globlastp |
| 2027 | LNU513 | soybean\|11v1\|GLYMA03G34940_P1 | 3481 | 670 | 89.4 | globlastp |
| 2028 | LNU513 | soybean\|gb168\|BU547595 | 3481 | 670 | 89.4 | globlastp |
| 2029 | LNU514 | switchgrass\|gb167\|FE640485 | 3482 | 671 | 91 | globlastp |
| 2030 | LNU514 | foxtail_millet\|10v2\|SICRP005477_P1 | 3483 | 671 | 90.2 | globlastp |
| 2031 | LNU514 | sorghum\|09v1\|SB07G024530 | 3484 | 671 | 89.8 | globlastp |
| 2032 | LNU514 | maize\|10v1\|AI902049_P1 | 3485 | 671 | 89.2 | globlastp |
| 2033 | LNU514 | maize\|10v1\|AI987368_P1 | 3486 | 671 | 88.9 | globlastp |
| 2034 | LNU514 | maize\|gb170\|AI987368 | 3486 | 671 | 88.9 | globlastp |
| 2035 | LNU514 | maize\|gb170\|AI711932 | 3487 | 671 | 88.54 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2036 | LNU514 | oat\|10v2\|GO582307_P1 | 3488 | 671 | 87.5 | globlastp |
| 2037 | LNU514 | oat\|10v1\|GO582307 | 3488 | 671 | 87.5 | globlastp |
| 2038 | LNU514 | rice\|gb170\|OS09G38530 | 3489 | 671 | 86.8 | globlastp |
| 2039 | LNU514 | wheat\|gb164\|BE414509 | 3490 | 671 | 86.8 | globlastp |
| 2040 | LNU514 | wheat\|10v2\|BE414509_P1 | 3491 | 671 | 86.7 | globlastp |
| 2041 | LNU514 | barley\|10v1\|AV833241 | 3492 | 671 | 86.4 | globlastp |
| 2042 | LNU514 | barley\|10v2\|AV833241_P1 | 3492 | 671 | 86.4 | globlastp |
| 2043 | LNU514 | brachypodium\|09v1\|DV481367_P1 | 3493 | 671 | 86.2 | globlastp |
| 2044 | LNU514 | maize\|10v1\|AI677621_P1 | 3494 | 671 | 85.9 | globlastp |
| 2045 | LNU514 | maize\|gb170\|AI677621 | 3494 | 671 | 85.9 | globlastp |
| 2046 | LNU514 | sorghum\|09v1\|SB02G032530 | 3495 | 671 | 85.8 | globlastp |
| 2047 | LNU514 | foxtail_millet\|10v2\|FXTRMSLX00130007D1_P1 | 3496 | 671 | 85 | globlastp |
| 2048 | LNU514 | maize\|10v1\|BQ295771_P1 | 3497 | 671 | 84.8 | globlastp |
| 2049 | LNU514 | millet\|10v1\|EVO454PM005967_P1 | 3498 | 671 | 84.5 | globlastp |
| 2050 | LNU514 | sorghum\|09v1\|SB07G016310 | 3499 | 671 | 82.4 | globlastp |
| 2051 | LNU514 | sugarcane\|10v1\|BU102774 | 3500 | 671 | 82.2 | globlastp |
| 2052 | LNU514 | brachypodium\|09v1\|DV480469_P1 | 3501 | 671 | 81.9 | globlastp |
| 2053 | LNU514 | maize\|10v1\|AI861629_P1 | 3502 | 671 | 81.9 | globlastp |
| 2054 | LNU514 | millet\|10v1\|EVO454PM001017_P1 | 3503 | 671 | 81.8 | globlastp |
| 2055 | LNU514 | barley\|10v1\|BE412814 | 3504 | 671 | 81.14 | glotblastn |
| 2056 | LNU514 | switchgrass\|gb167\|FE600426 | 3505 | 671 | 81.1 | globlastp |
| 2057 | LNU514 | barley\|10v2\|BE412814_P1 | 3506 | 671 | 80.8 | globlastp |
| 2058 | LNU514 | wheat\|10v2\|BF292545_P1 | 3507 | 671 | 80.8 | globlastp |
| 2059 | LNU514 | wheat\|gb164\|BQ238027 | 3507 | 671 | 80.8 | globlastp |
| 2060 | LNU514 | millet\|10v1\|EVO454PM002776_P1 | 3508 | 671 | 80.7 | globlastp |
| 2061 | LNU514 | cotton\|10v2\|SRR032367S0498385_P1 | 3509 | 671 | 80.1 | globlastp |
| 2062 | LNU517 | bean\|gb167\|CA914436_P1 | 3510 | 672 | 90.6 | globlastp |
| 2063 | LNU517 | cowpea\|gb166\|FF383642_P1 | 3511 | 672 | 89.7 | globlastp |
| 2064 | LNU517 | lotus\|09v1\|BP070981_P1 | 3512 | 672 | 87.5 | globlastp |
| 2065 | LNU517 | medicago\|09v1\|LLAW776024_P1 | 3513 | 672 | 83.3 | globlastp |
| 2066 | LNU517 | peanut\|10v1\|ES723257_T1 | 3514 | 672 | 80.66 | glotblastn |
| 2067 | LNU518 | sorghum\|09v1\|SB10G005570 | 3515 | 673 | 95.5 | globlastp |
| 2068 | LNU518 | switchgrass\|gb167\|FE640709 | 3516 | 673 | 93.4 | globlastp |
| 2069 | LNU518 | millet\|10v1\|EVO454PM012014_P1 | 3517 | 673 | 89.5 | globlastp |
| 2070 | LNU518 | rice\|gb170\|OS06G08400 | 3518 | 673 | 86.8 | globlastp |
| 2071 | LNU518 | wheat\|10v2\|BE493248_P1 | 3519 | 673 | 86.1 | globlastp |
| 2072 | LNU518 | wheat\|gb164\|BE493248 | 3520 | 673 | 86.1 | globlastp |
| 2073 | LNU518 | brachypodium\|09v1\|GT786826_P1 | 3521 | 673 | 85.5 | globlastp |
| 2074 | LNU518 | brachypodium\|09v1\|GT759144_P1 | 3522 | 673 | 85 | globlastp |
| 2075 | LNU520 | maize\|10v1\|BG320595_P1 | 3523 | 675 | 92.1 | globlastp |
| 2076 | LNU520 | maize\|gb170\|BG549573 | 3523 | 675 | 92.1 | globlastp |
| 2077 | LNU520 | switchgrass\|gb167\|FE612728 | 3524 | 675 | 90.03 | glotblastn |
| 2078 | LNU520 | millet\|10v1\|EVO454PM312756_P1 | 3525 | 675 | 81.6 | globlastp |
| 2079 | LNU417_H4 | millet\|10v1\|EVO454PM015064_P1 | 3526 | 677 | 83.1 | globlastp |
| 2079 | LNU417 | millet\|10v1\|EVO454PM015064_T1 | 3526 | 702 | 84.38 | glotblastn |
| 2080 | LNU290 | barley\|10v2\|AV836409_T1 | 3527 | 680 | 82.59 | glotblastn |
| 2081 | LNU290 | wheat\|10v2\|DR737283_T1 | 3528 | 680 | 81.53 | glotblastn |
| 2082 | LNU294 | soybean\|11v1\|GLYMA02G03460_T1 | 3529 | 681 | 83.56 | glotblastn |
| 2083 | LNU309 | switchgrass\|gb167\|DN147382 | 3530 | 684 | 86.82 | glotblastn |
| 2084 | LNU337 | citrus\|gb166\|CN183940_T1 | 3531 | 686 | 86.36 | glotblastn |
| 2085 | LNU337 | aquilegia\|10v1\|DR938015 | 3532 | 686 | 85.54 | glotblastn |
| 2086 | LNU337 | aquilegia\|10v2\|DR938015_T1 | 3533 | 686 | 85.54 | glotblastn |
| 2087 | LNU337 | poplar\|10v1\|AI166531_T1 | 3534 | 686 | 84.68 | glotblastn |
| 2088 | LNU337 | cassava\|09v1\|DB955139_T1 | 3535 | 686 | 84.66 | glotblastn |
| 2089 | LNU337 | cotton\|10v1\|BQ408171 | 3536 | 686 | 84.57 | glotblastn |
| 2090 | LNU337 | soybean\|11v1\|GLYMA08G20750_T1 | 3537 | 686 | 84.5 | glotblastn |
| 2091 | LNU337 | soybean\|gb168\|CX532836 | 3537 | 686 | 84.5 | glotblastn |
| 2092 | LNU337 | soybean\|gb168\|BM779948 | 3538 | 686 | 84.45 | glotblastn |
| 2093 | LNU337 | lotus\|09v1\|GO036990_T1 | 3539 | 686 | 84.1 | glotblastn |
| 2094 | LNU337 | cowpea\|gb166\|FF383005_P1 | 3540 | 686 | 83.9 | globlastp |
| 2095 | LNU337 | aristolochia\|10v1\|FD748181_T1 | 3541 | 686 | 83.74 | glotblastn |
| 2096 | LNU337 | cotton\|10v2\|BQ408171_T1 | 3542 | 686 | 83.64 | glotblastn |
| 2097 | LNU337 | medicago\|09v1\|LLAW696817_T1 | 3543 | 686 | 83.38 | glotblastn |
| 2098 | LNU337 | artemisia\|10v1\|EY088616_T1 | 3544 | 686 | 83.33 | glotblastn |
| 2099 | LNU337 | solanum_phureja\|09v1\|SPHAI488887 | 3545 | 686 | 83.13 | glotblastn |
| 2100 | LNU337 | cucumber\|09v1\|CK086034_T1 | 3546 | 686 | 82.87 | glotblastn |
| 2101 | LNU337 | pigeonpea\|10v1\|SRR054580S0020598_T1 | 3547 | 686 | 82.52 | glotblastn |
| 2102 | LNU337 | tomato\|09v1\|AI488887 | 3548 | 686 | 82.23 | glotblastn |
| 2103 | LNU337 | eucalyptus\|11v1\|SRR001659X140003_T1 | 3549 | 686 | 82.21 | glotblastn |
| 2104 | LNU337 | soybean\|gb168\|AW693235 | 3550 | 686 | 81.27 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2105 | LNU337 | amaranthus\|10v1\|SRR039411S0002870_T1 | 3551 | 686 | 81.17 | glotblastn |
| 2106 | LNU337 | sunflower\|10v1\|DY921887_T1 | 3552 | 686 | 81.17 | glotblastn |
| 2107 | LNU337 | sunflower\|gb162\|DY921887 | 3553 | 686 | 81.17 | glotblastn |
| 2108 | LNU337 | solanum_phureja\|09v1\|SPHBI923775 | 3554 | 686 | 80.55 | glotblastn |
| 2109 | LNU337 | tomato\|09v1\|BI923775 | 3555 | 686 | 80.43 | glotblastn |
| 2110 | LNU337 | triphysaria\|10v1\|EY168040 | 3556 | 686 | 80.25 | glotblastn |
| 2111 | LNU337 | bean\|gb167\|CV538438_T1 | 3557 | 686 | 80.24 | glotblastn |
| 2112 | LNU350 | wheat\|gb164\|BE398679 | 3558 | 688 | 99.1 | globlastp |
| 2113 | LNU350 | pseudoroegneria\|gb167\|FF340338 | 3559 | 688 | 94.3 | globlastp |
| 2114 | LNU350 | leymus\|gb166\|CN466395_P1 | 3560 | 688 | 93.7 | globlastp |
| 2115 | LNU350 | oat\|10v2\|GO591066_P1 | 3561 | 688 | 88.1 | globlastp |
| 2116 | LNU350 | rice\|gb170\|OS10G35520 | 3562 | 688 | 82.4 | globlastp |
| 2117 | LNU369 | pseudoroegneria\|gb167\|FF340190 | 3563 | 691 | 100 | glotblastn |
| 2118 | LNU369 | barley\|10v1\|BQ664541 | 3564 | 691 | 96.4 | globlastp |
| 2119 | LNU369 | barley\|10v2\|BQ664541_P1 | 3565 | 691 | 95.9 | globlastp |
| 2120 | LNU369 | brachypodium\|09v1\|TMPLBQ664541T1_P1 | 3566 | 691 | 95.9 | globlastp |
| 2121 | LNU369 | millet\|09v1\|EVO454PM068764 | 3567 | 691 | 91.67 | glotblastn |
| 2122 | LNU369 | sugarcane\|10v1\|CA088432 | 3568 | 691 | 89.29 | glotblastn |
| 2123 | LNU369 | sorghum\|09v1\|SB03G044420 | 3569 | 691 | 88.1 | glotblastn |
| 2124 | LNU369 | fescue\|gb161\|DT686802_P1 | 3570 | 691 | 86.7 | globlastp |
| 2125 | LNU369 | maize\|gb170\|EG299620 | 3571 | 691 | 85.12 | glotblastn |
| 2126 | LNU369 | foxtail_millet\|10v2\|FXTRMSLX00024110D1_P1 | 3572 | 691 | 85 | globlastp |
| 2127 | LNU380 | brachypodium\|09v1\|SRR031795S0001004_T1 | 3573 | 695 | 90.62 | glotblastn |
| 2128 | LNU380 | oat\|10v2\|GR352653_P1 | 3574 | 695 | 84.9 | globlastp |
| 2129 | LNU380 | rice\|gb170\|OS05G40770 | 3575 | 695 | 82.96 | glotblastn |
| 2130 | LNU380 | maize\|10v1\|BQ280303_T1 | 3576 | 695 | 81.11 | glotblastn |
| 2131 | LNU380 | maize\|gb170\|BQ280303 | 3577 | 695 | 81.11 | glotblastn |
| 2132 | LNU380 | sorghum\|09v1\|SB09G023780 | 3578 | 695 | 80.93 | glotblastn |
| 2133 | LNU401 | maize\|gb170\|AI396396 | 3579 | 696 | 92.7 | globlastp |
| 2134 | LNU407 | wheat\|gb164\|CA709529 | 3580 | 697 | 96.31 | glotblastn |
| 2135 | LNU407 | foxtail_millet\|10v2\|FXTRMSLX00545432D1_T1 | 3581 | 697 | 84.84 | glotblastn |
| 2136 | LNU407 | millet\|10v1\|EVO454PM021192_T1 | 3582 | 697 | 82.79 | glotblastn |
| 2137 | LNU407 | millet\|09v1\|EVO454PM021192 | 3583 | 697 | 82.79 | glotblastn |
| 2138 | LNU407 | sorghum\|09v1\|SB09G023570 | 3584 | 697 | 80.33 | glotblastn |
| 2139 | LNU409 | wheat\|10v2\|CA651811_T1 | 3585 | 698 | 96.45 | glotblastn |
| 2140 | LNU409 | wheat\|gb164\|CA651811 | 3585 | 698 | 96.45 | glotblastn |
| 2141 | LNU409 | brachypodium\|09v1\|SRR031797S0045274_T1 | 3586 | 698 | 89.36 | glotblastn |
| 2142 | LNU409 | sorghum\|09v1\|SB09G017200 | 3587 | 698 | 87.94 | glotblastn |
| 2143 | LNU409 | rice\|gb170\|OS05G28830 | 3588 | 698 | 80.99 | glotblastn |
| 2144 | LNU410 | barley\|10v1\|BF624533 | 3589 | 699 | 96.7 | globlastp |
| 2145 | LNU410 | barley\|10v2\|BF624533_P1 | 3589 | 699 | 96.7 | globlastp |
| 2146 | LNU414 | barley\|10v1\|BE413415 | 3590 | 700 | 90.91 | glotblastn |
| 2147 | LNU414 | foxtail_millet\|10v2\|SICRP039145_T1 | 3591 | 700 | 82.64 | glotblastn |
| 2148 | LNU414 | switchgrass\|gb167\|FE635772 | 3592 | 700 | 82.64 | glotblastn |
| 2149 | LNU417 | millet\|09v1\|EVO454PM015064 | 3593 | 702 | 84.11 | glotblastn |
| 2150 | LNU417 | millet\|09v1\|EVO454PM040968 | 3594 | 702 | 83.3 | globlastp |
| 2151 | LNU453 | sorghum\|09v1\|SB10G027370 | 3595 | 703 | 81.46 | glotblastn |
| 2152 | LNU457 | solanum_phureja\|09v1\|SPHBQ512773 | 3596 | 704 | 96.34 | glotblastn |
| 2153 | LNU457 | potato\|10v1\|GFXAY165021X1_T1 | 3597 | 704 | 84.82 | glotblastn |
| 2154 | LNU457 | monkeyflower\|10v1\|MGJGI019441_T1 | 3598 | 704 | 80.63 | glotblastn |
| 2155 | LNU466 | millet\|10v1\|EVO454PM011905_T1 | 3599 | 705 | 89.7 | glotblastn |
| 2156 | LNU466 | millet\|09v1\|EVO454PM011905 | 3600 | 705 | 88.84 | glotblastn |
| 2157 | LNU466 | sorghum\|09v1\|SB08G019390 | 3601 | 705 | 88.84 | glotblastn |
| 2158 | LNU466 | sugarcane\|10v1\|CA066125 | 3602 | 705 | 88.41 | glotblastn |
| 2159 | LNU466 | oat\|10v2\|GR353248_T1 | 3603 | 705 | 86.38 | glotblastn |
| 2160 | LNU466 | foxtail_millet\|10v2\|SICRP027225_T1 | 3604 | 705 | 84.98 | glotblastn |
| 2161 | LNU466 | maize\|10v1\|AW179506_T1 | 3605 | 705 | 83.05 | glotblastn |
| 2162 | LNU466 | maize\|gb170\|AW179506 | 3605 | 705 | 83.05 | glotblastn |
| 2163 | LNU466 | switchgrass\|gb167\|FE654167 | 3606 | 705 | 81.97 | glotblastn |
| 2164 | LNU466 | pseudoroegneria\|gb167\|FF351252 | 3607 | 705 | 80.93 | glotblastn |
| 2165 | LNU466 | fescue\|gb161\|DT679702_T1 | 3608 | 705 | 80 | glotblastn |
| 2166 | LNU474 | bean\|gb167\|CV536461_T1 | 3609 | 707 | 98.36 | glotblastn |
| 2167 | LNU474 | cowpea\|gb166\|FC462110_T1 | 3610 | 707 | 98.36 | glotblastn |
| 2168 | LNU474 | liquorice\|gb171\|FS241287_T1 | 3611 | 707 | 90.16 | glotblastn |
| 2169 | LNU474 | lotus\|09v1\|LLBW600621_T1 | 3612 | 707 | 90.16 | glotblastn |
| 2170 | LNU474 | peanut\|10v1\|ES719423_T1 | 3613 | 707 | 88.52 | glotblastn |
| 2171 | LNU474 | prunus\|10v1\|DY636612_T1 | 3614 | 707 | 86.89 | glotblastn |
| 2172 | LNU474 | prunus\|gb167\|DY636612 | 3615 | 707 | 86.89 | glotblastn |
| 2173 | LNU474 | apple\|gb171\|DT003448_T1 | 3616 | 707 | 83.61 | glotblastn |
| 2174 | LNU474 | clover\|gb162\|BB909259_T1 | 3617 | 707 | 83.61 | glotblastn |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2175 | LNU474 | nasturtium\|10v1\|SRR032559S0001264_T1 | 3618 | 707 | 83.61 | glotblastn |
| 2176 | LNU474 | petunia\|gb171\|FN012889_T1 | 3619 | 707 | 83.61 | glotblastn |
| 2177 | LNU474 | clementine\|11v1\|CF505635_T1 | 3620 | 707 | 81.97 | glotblastn |
| 2178 | LNU474 | oak\|10v1\|FP043396_T1 | 3621 | 707 | 81.97 | glotblastn |
| 2179 | LNU474 | orange\|11v1\|CF505635_T1 | 3622 | 707 | 81.97 | glotblastn |
| 2180 | LNU474 | canola\|10v1\|DY002167_T1 | 3623 | 707 | 81.97 | glotblastn |
| 2181 | LNU474 | castorbean\|09v1\|EG665732_T1 | 3624 | 707 | 81.97 | glotblastn |
| 2182 | LNU474 | citrus\|gb166\|CF505635_T1 | 3625 | 707 | 81.97 | glotblastn |
| 2183 | LNU474 | cucumber\|09v1\|CSCRP015980_T1 | 3626 | 707 | 81.97 | glotblastn |
| 2184 | LNU474 | thellungiella\|gb167\|BY828100 | 3627 | 707 | 81.97 | glotblastn |
| 2185 | LNU474 | arabidopsis_lyrata\|09v1\|JGIAL011182_T1 | 3628 | 707 | 80.33 | glotblastn |
| 2186 | LNU474 | arabidopsis\|10v1\|AT3G24520_T1 | 3629 | 707 | 80.33 | glotblastn |
| 2187 | LNU474 | chestnut\|gb170\|SRR006300S0039964_T1 | 3630 | 707 | 80.33 | glotblastn |
| 2188 | LNU474 | grape\|gb160\|CB920522_T1 | 3631 | 707 | 80.33 | glotblastn |
| 2189 | LNU474 | strawberry\|11v1\|CX309755_T1 | 3632 | 707 | 80.33 | glotblastn |
| 2190 | LNU474 | strawberry\|gb164\|EX668883 | 3633 | 707 | 80.33 | glotblastn |
| 2191 | LNU487 | barley\|10v2\|BE558461_T1 | 3634 | 708 | 97.73 | glotblastn |
| 2192 | LNU500 | grape\|gb160\|CB915642_P1 | 3635 | 711 | 86.8 | globlastp |
| 2193 | LNU500 | grape\|gb160\|CB972116_T1 | 3636 | 711 | 86.4 | glotblastn |
| 2194 | LNU500 | radish\|gb164\|EV547025 | 3637 | 711 | 85.9 | globlastp |
| 2195 | LNU500 | orobanche\|10v1\|SRR023189S0037471_P1 | 3638 | 711 | 85.1 | globlastp |
| 2196 | LNU500 | clementine\|11v1\|CX073917_T1 | 3639 | 711 | 85.09 | glotblastn |
| 2197 | LNU500 | ipomoea_nil\|10v1\|CJ757665_P1 | 3640 | 711 | 84.9 | globlastp |
| 2198 | LNU500 | b_juncea\|10v2\|CK991428_T1 | 3641 | 711 | 84.65 | glotblastn |
| 2199 | LNU500 | cacao\|10v1\|CU499397_T1 | 3642 | 711 | 84.65 | glotblastn |
| 2200 | LNU500 | pigeonpea\|10v1\|SRR054580S0019557_T1 | 3643 | 711 | 84.65 | glotblastn |
| 2201 | LNU500 | cotton\|10v2\|SRR032367S0333890_T1 | 3644 | 711 | 84.65 | glotblastn |
| 2202 | LNU500 | spurge\|gb161\|DV119836 | 3645 | 711 | 84.4 | globlastp |
| 2203 | LNU500 | arabidopsis\|10v1\|AT5G11880_T1 | 3646 | 711 | 84.21 | glotblastn |
| 2204 | LNU500 | artemisia\|10v1\|EY080298_T1 | 3647 | 711 | 84.21 | glotblastn |
| 2205 | LNU500 | artemisia\|10v1\|EY080299_T1 | 3648 | 711 | 84.21 | glotblastn |
| 2206 | LNU500 | cleome_gynandra\|10v1\|SRR015532S0016904_T1 | 3649 | 711 | 84.21 | glotblastn |
| 2207 | LNU500 | soybean\|11v1\|GLYMA13G20390_T1 | 3650 | 711 | 84.21 | glotblastn |
| 2208 | LNU500 | soybean\|gb168\|AL372335 | 3650 | 711 | 84.21 | glotblastn |
| 2209 | LNU500 | radish\|gb164\|EX769006 | 3651 | 711 | 83.93 | glotblastn |
| 2210 | LNU500 | amaranthus\|10v1\|SRR039411S0005472_T1 | 3652 | 711 | 83.77 | glotblastn |
| 2211 | LNU500 | arabidopsis_lyrata\|09v1\|JGIAL020888_T1 | 3653 | 711 | 83.77 | glotblastn |
| 2212 | LNU500 | artemisia\|10v1\|EY072335_T1 | 3654 | 711 | 83.77 | glotblastn |
| 2213 | LNU500 | canola\|10v1\|CD822749_T1 | 3655 | 711 | 83.77 | glotblastn |
| 2214 | LNU500 | cleome_spinosa\|10v1\|SRR015531S0019032_T1 | 3656 | 711 | 83.33 | glotblastn |
| 2215 | LNU500 | cowpea\|gb166\|FC461450_T1 | 3657 | 711 | 83.33 | glotblastn |
| 2216 | LNU500 | momordica\|10v1\|SRR071315S0003699_T1 | 3658 | 711 | 83.04 | glotblastn |
| 2217 | LNU500 | cynara\|gb167\|GE579895_T1 | 3659 | 711 | 82.89 | glotblastn |
| 2218 | LNU500 | sunflower\|10v1\|CX947049_T1 | 3660 | 711 | 82.89 | glotblastn |
| 2219 | LNU500 | clover\|gb162\|BB905074_P1 | 3661 | 711 | 82.3 | globlastp |
| 2220 | LNU500 | aristolochia\|10v1\|SRR039082S0276748_T1 | 3662 | 711 | 82.02 | glotblastn |
| 2221 | LNU500 | papaya\|gb165\|EX238932_T1 | 3663 | 711 | 82.02 | glotblastn |
| 2222 | LNU500 | prunus\|gb167\|BU041335 | 3664 | 711 | 82.02 | glotblastn |
| 2223 | LNU500 | lotus\|09v1\|LLCB826869_P1 | 3665 | 711 | 81.8 | globlastp |
| 2224 | LNU500 | strawberry\|11v1\|GT150985_T1 | 3666 | 711 | 81.58 | glotblastn |
| 2225 | LNU500 | apple\|gb171\|CN877675_T1 | 3667 | 711 | 81.58 | glotblastn |
| 2226 | LNU500 | peanut\|10v1\|EG029135_T1 | 3668 | 711 | 81.14 | glotblastn |
| 2227 | LNU500 | peanut\|gb171\|EG029135 | 3669 | 711 | 81.14 | glotblastn |
| 2228 | LNU500 | radish\|gb164\|EW714733 | 3670 | 711 | 80.5 | globlastp |
| 2229 | LNU506 | solanum_phureja\|09v1\|SPHAI490778 | 3671 | 713 | 92.7 | globlastp |
| 2230 | LNU310 | solanum_phureja\|09v1\|SPHBG133786 | 3672 | 721 | 97 | globlastp |
| 2231 | LNU310 | potato\|10v1\|BI177611_P1 | 3673 | 721 | 96.3 | globlastp |
| 2232 | LNU310 | eggplant\|10v1\|FS048892_P1 | 3674 | 721 | 93.3 | globlastp |
| 2233 | LNU323 | solanum_phureja\|09v1\|SPHBG626676 | 3675 | 722 | 86.72 | glotblastn |
| 2234 | LNU323 | potato\|10v1\|CV502122_P1 | 3676 | 722 | 86.7 | globlastp |
| 2235 | LNU323 | solanum_phureja\|09v1\|SPHBG631554 | 3677 | 722 | 85.16 | glotblastn |
| 2236 | LNU326 | potato\|10v1\|BG589666_P1 | 3678 | 724 | 95.3 | globlastp |
| 2237 | LNU326 | solanum_phureja\|09v1\|SPHBG126891 | 3679 | 724 | 94.7 | globlastp |
| 2238 | LNU326 | eggplant\|10v1\|FS016668_P1 | 3680 | 724 | 86.3 | globlastp |
| 2239 | LNU326 | pepper\|gb171\|AA840658_P1 | 3681 | 724 | 86.1 | globlastp |
| 2240 | LNU326 | tobacco\|gb162\|AJ718732 | 3682 | 724 | 82.66 | glotblastn |
| 2241 | LNU326 | nicotiana_benthamiana\|gb162\|CN743291_T1 | 3683 | 724 | 80.79 | glotblastn |
| 2242 | LNU329 | potato\|10v1\|BG589552_P1 | 3684 | 726 | 94.6 | globlastp |
| 2243 | LNU329 | solanum_phureja\|09v1\|SPHBG791244 | 3685 | 726 | 94.6 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2244 | LNU329 | pepper\|gb171\|CA518152_P1 | 3686 | 726 | 86.3 | globlastp |
| 2245 | LNU329 | petunia\|gb171\|DW177095_T1 | 3687 | 726 | 81.65 | glotblastn |
| 2246 | LNU331 | nicotiana_benthamiana\|gb162\|CK290936_P1 | 3688 | 727 | 89.6 | globlastp |
| 2247 | LNU335 | oat\|10v2\|CN814905_P1 | 3689 | 728 | 83 | globlastp |
| 2248 | LNU350 | barley\|10v1\|BE216626 | 3690 | 732 | 94.7 | globlastp |
| 2249 | LNU350 | barley\|10v2\|BE216626_P1 | 3690 | 732 | 94.7 | globlastp |
| 2250 | LNU350 | brachypodium\|09v1\|GT819129_P1 | 3691 | 732 | 86.4 | globlastp |
| 2251 | LNU350 | sorghum\|09v1\|SB05G003700 | 3692 | 732 | 86.1 | globlastp |
| 2252 | LNU350 | sugarcane\|10v1\|CA073962 | 3693 | 732 | 85.2 | globlastp |
| 2253 | LNU360 | wheat\|10v2\|BQ905138_P1 | 3694 | 733 | 84.2 | globlastp |
| 2254 | LNU360 | wheat\|gb164\|BQ905138 | 3694 | 733 | 84.2 | globlastp |
| 2255 | LNU360 | barley\|10v1\|BE421126 | 3695 | 733 | 83.3 | globlastp |
| 2256 | LNU360 | barley\|10v2\|BE421126_P1 | 3695 | 733 | 83.3 | globlastp |
| 2257 | LNU360 | wheat\|10v2\|BF478587_P1 | 3696 | 733 | 83.3 | globlastp |
| 2258 | LNU360 | wheat\|gb164\|BF478587 | 3696 | 733 | 83.3 | globlastp |
| 2259 | LNU360 | wheat\|10v2\|BE418197_P1 | 3697 | 733 | 83.3 | globlastp |
| 2260 | LNU360 | wheat\|gb164\|BE418197 | 3697 | 733 | 83.3 | globlastp |
| 2261 | LNU360 | pseudoroegneria\|gb167\|FF341642 | 3698 | 733 | 82.9 | globlastp |
| 2262 | LNU368 | wheat\|10v2\|BE400013_P1 | 3699 | 735 | 96 | globlastp |
| 2263 | LNU368 | leymus\|gb166\|EG394955_P1 | 3700 | 735 | 94.4 | globlastp |
| 2264 | LNU368 | wheat\|gb164\|BE400013 | 3701 | 735 | 89.7 | globlastp |
| 2265 | LNU368 | barley\|10v1\|BE421103 | 3702 | 735 | 89.1 | globlastp |
| 2266 | LNU368 | barley\|10v2\|BE421103_P1 | 3702 | 735 | 89.1 | globlastp |
| 2267 | LNU368 | pseudoroegneria\|gb167\|FF346438 | 3703 | 735 | 86.8 | globlastp |
| 2268 | LNU372 | leymus\|gb166\|EG379844_P1 | 3704 | 737 | 88.6 | globlastp |
| 2269 | LNU384 | solanum_phureja\|09v1\|SPHAI482780 | 3705 | 741 | 94.9 | globlastp |
| 2270 | LNU384 | tobacco\|gb162\|EB444563 | 3706 | 741 | 80.1 | globlastp |
| 2271 | LNU397 | sugarcane\|10v1\|CA114434 | 3707 | 745 | 91.6 | globlastp |
| 2272 | LNU397 | maize\|10v1\|AI691183_P1 | 3708 | 745 | 91.1 | globlastp |
| 2273 | LNU397 | maize\|gb170\|AI691183 | 3708 | 745 | 91.1 | globlastp |
| 2274 | LNU401 | switchgrass\|gb167\|FE645149_P1 | 3709 | 746 | 80.7 | globlastp |
| 2275 | LNU407 | wheat\|10v2\|BQ245199_P1 | 3710 | 749 | 97.3 | globlastp |
| 2276 | LNU407 | brachypodium\|09v1\|DV473592_P1 | 3711 | 749 | 89.9 | globlastp |
| 2277 | LNU407 | sorghum\|09v1\|SB03G038110 | 3712 | 749 | 86 | globlastp |
| 2278 | LNU407 | rice\|gb170\|OS01G60330 | 3713 | 749 | 84.8 | globlastp |
| 2279 | LNU407 | maize\|10v1\|DN559520_P1 | 3714 | 749 | 83.9 | globlastp |
| 2280 | LNU407 | maize\|gb170\|DN559520 | 3714 | 749 | 83.9 | globlastp |
| 2281 | LNU407 | maize\|10v1\|AI621549_P1 | 3715 | 749 | 83.2 | globlastp |
| 2282 | LNU416 | b_rapa\|gb162\|BG543823_P1 | 754 | 754 | 100 | globlastp |
| 2283 | LNU416 | canola\|10v1\|CD827516_P1 | 754 | 754 | 100 | globlastp |
| 2284 | LNU416 | b_oleracea\|gb161\|AM396074_P1 | 3716 | 754 | 95.9 | globlastp |
| 2285 | LNU416 | canola\|10v1\|EV117448_T1 | 3717 | 754 | 86.59 | glotblastn |
| 2286 | LNU416 | canola\|10v1\|CD818961_P1 | 3718 | 754 | 85.7 | globlastp |
| 2287 | LNU416 | b_oleracea\|gb161\|DQ059298_P1 | 3719 | 754 | 85.1 | globlastp |
| 2288 | LNU416 | canola\|10v1\|CD834758_P1 | 3720 | 754 | 81 | globlastp |
| 2289 | LNU419 | solanum_phureja\|09v1\|SPHBG132251 | 3721 | 755 | 99.5 | globlastp |
| 2290 | LNU419 | potato\|10v1\|BE922576_P1 | 3722 | 755 | 99.2 | globlastp |
| 2291 | LNU419 | solanum_phureja\|09v1\|SPHBE922576 | 3723 | 755 | 97.9 | globlastp |
| 2292 | LNU419 | tobacco\|gb162\|AB004307 | 3724 | 755 | 95.2 | globlastp |
| 2293 | LNU419 | nicotiana_benthamiana\|gb162\|CK295383_P1 | 3725 | 755 | 94.7 | globlastp |
| 2294 | LNU419 | eggplant\|10v1\|FS003533_P1 | 3726 | 755 | 93.9 | globlastp |
| 2295 | LNU419 | pepper\|gb171\|AF108885_P1 | 3727 | 755 | 89.3 | globlastp |
| 2296 | LNU419 | cucumber\|09v1\|AM714300_P1 | 3728 | 755 | 83.6 | globlastp |
| 2297 | LNU419 | bean\|gb167\|CA901472_P1 | 3729 | 755 | 83.6 | globlastp |
| 2298 | LNU419 | cowpea\|gb166\|FF390066_P1 | 3730 | 755 | 83.6 | globlastp |
| 2299 | LNU419 | melon\|10v1\|AM714300_P1 | 3731 | 755 | 83.4 | globlastp |
| 2300 | LNU419 | eucalyptus\|11v1\|CT981021_P1 | 3732 | 755 | 83.3 | globlastp |
| 2301 | LNU419 | momordica\|10v1\|SRR071315S0000520_P1 | 3733 | 755 | 83.3 | globlastp |
| 2302 | LNU419 | melon\|gb165\|AM714300 | 3734 | 755 | 83.1 | globlastp |
| 2303 | LNU419 | pigeonpea\|10v1\|SRR054580S0001030_P1 | 3735 | 755 | 82.8 | globlastp |
| 2304 | LNU419 | peanut\|10v1\|CD038560_P1 | 3736 | 755 | 82.5 | globlastp |
| 2305 | LNU419 | soybean\|11v1\|GLYMA15G13680_P1 | 3737 | 755 | 82.5 | globlastp |
| 2306 | LNU419 | soybean\|gb168\|BE352683 | 3737 | 755 | 82.5 | globlastp |
| 2307 | LNU419 | orange\|11v1\|CF504082_P1 | 3738 | 755 | 82.3 | globlastp |
| 2308 | LNU419 | peanut\|10v1\|GO326838_P1 | 3739 | 755 | 82.2 | globlastp |
| 2309 | LNU419 | prunus\|10v1\|CN488554_P1 | 3740 | 755 | 82 | globlastp |
| 2310 | LNU419 | cassava\|09v1\|DV441828_P1 | 3741 | 755 | 82 | globlastp |
| 2311 | LNU419 | castorbean\|09v1\|EE256160_P1 | 3742 | 755 | 82 | globlastp |

TABLE 2-continued

Homologues of the identified genes/polypeptides for increasing nitrogen use efficiency,
fertilizer use efficiency, yield, seed yield, growth rate, vigor, biomass, oil content, fiber yield,
fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2312 | LNU419 | oak\|10v1\|FN696815__P1 | 3743 | 755 | 81.7 | globlastp |
| 2313 | LNU419 | cassava\|09v1\|CK650384__P1 | 3744 | 755 | 81.7 | globlastp |
| 2314 | LNU419 | soybean\|11v1\|GLYMA09G02800__P1 | 3745 | 755 | 81.7 | globlastp |
| 2315 | LNU419 | soybean\|gb168\|AW171758 | 3745 | 755 | 81.7 | globlastp |
| 2316 | LNU419 | apple\|gb171\|CN488554__P1 | 3746 | 755 | 81.5 | globlastp |
| 2317 | LNU419 | kiwi\|gb166\|FG409924__P1 | 3747 | 755 | 81.4 | globlastp |
| 2318 | LNU419 | aristolochia\|10v1\|FD759327__P1 | 3748 | 755 | 81.2 | globlastp |
| 2319 | LNU419 | nasturtium\|10v1\|GH170410__T1 | 3749 | 755 | 80.95 | glotblastn |
| 2320 | LNU419 | cotton\|10v1\|BF269486 | 3750 | 755 | 80.6 | globlastp |
| 2321 | LNU419 | tragopogon\|10v1\|SRR020205S0004523 | 3751 | 755 | 80.6 | globlastp |
| 2322 | LNU419 | aquilegia\|10v2\|DR925602__P1 | 3752 | 755 | 80.4 | globlastp |
| 2323 | LNU419 | poplar\|10v1\|BI072464__P1 | 3753 | 755 | 80.4 | globlastp |
| 2324 | LNU419 | prunus\|gb167\|CV044964 | 3754 | 755 | 80.37 | glotblastn |
| 2325 | LNU419 | artemisia\|10v1\|EY066317__T1 | 3755 | 755 | 80.16 | glotblastn |
| 2326 | LNU419 | orobanche\|10v1\|SRR023189S0003219__P1 | 3756 | 755 | 80.1 | globlastp |
| 2327 | LNU419 | cotton\|10v2\|BF275008__P1 | 3757 | 755 | 80.1 | globlastp |
| 2328 | LNU439 | maize\|gb170\|AW574419 | 3758 | 757 | 87.8 | globlastp |
| 2329 | LNU442 | solanum_phureja\|09v1\|SPHAW735755 | 3759 | 758 | 94.5 | globlastp |
| 2330 | LNU444 | cacao\|10v1\|CA795284__P1 | 3760 | 759 | 87.8 | globlastp |
| 2331 | LNU444 | cacao\|gb167\|CA795284 | 3760 | 759 | 87.8 | globlastp |
| 2332 | LNU444 | poplar\|10v1\|AI162462__P1 | 3761 | 759 | 85.8 | globlastp |
| 2333 | LNU444 | oak\|10v1\|FP024990__P1 | 3762 | 759 | 84.6 | globlastp |
| 2334 | LNU444 | oak\|10v1\|FP025793__P1 | 3762 | 759 | 84.6 | globlastp |
| 2335 | LNU444 | papaya\|gb165\|EX260629__P1 | 3763 | 759 | 84.5 | globlastp |
| 2336 | LNU444 | cassava\|09v1\|CK641349__P1 | 3764 | 759 | 83.8 | globlastp |
| 2337 | LNU444 | flax\|09v1\|EU829138__P1 | 3765 | 759 | 83.6 | globlastp |
| 2338 | LNU444 | flax\|09v1\|CV478267__P1 | 3766 | 759 | 82.7 | globlastp |
| 2339 | LNU444 | nasturtium\|10v1\|SRR032558S0005447__P1 | 3767 | 759 | 81.9 | globlastp |
| 2340 | LNU444 | bruguiera\|gb166\|BP939110__P1 | 3768 | 759 | 80.5 | globlastp |
| 2341 | LNU444 | prunus\|10v1\|CN491505__P1 | 3769 | 759 | 80.4 | globlastp |
| 2342 | LNU444 | chickpea\|09v2\|EL585362__P1 | 3770 | 759 | 80.1 | globlastp |
| 2343 | LNU450 | cacao\|10v1\|CU471751__P1 | 3771 | 763 | 93 | globlastp |
| 2344 | LNU450 | cassava\|09v1\|JGICASSAVA878VALIDM1__P1 | 3772 | 763 | 86.1 | globlastp |
| 2345 | LNU450 | castorbean\|09v1\|XM002510536__P1 | 3773 | 763 | 83.1 | globlastp |
| 2346 | LNU450 | grape\|gb160\|CB007771__P1 | 3774 | 763 | 82.8 | globlastp |
| 2347 | LNU450 | orange\|11v1\|CX546774__P1 | 3775 | 763 | 81.9 | globlastp |
| 2348 | LNU450 | clementine\|11v1\|CX546774__P1 | 3776 | 763 | 81.4 | globlastp |
| 2349 | LNU450 | tea\|10v1\|CV699613 | 3777 | 763 | 81.4 | globlastp |
| 2350 | LNU450 | prunus\|10v1\|CB823756__P1 | 3778 | 763 | 80.3 | globlastp |
| 2351 | LNU450 | eucalyptus\|11v1\|CD670135__P1 | 3779 | 763 | 80 | globlastp |
| 2352 | LNU461 | solanum_phureja\|09v1\|SPHAI483350 | 3780 | 766 | 96.8 | globlastp |
| 2353 | LNU465 | maize\|gb170\|LLEY954018 | 3781 | 768 | 81.1 | globlastp |
| 2354 | LNU468 | eggplant\|10v1\|FS007833__P1 | 3782 | 769 | 94.2 | globlastp |
| 2355 | LNU470 | wheat\|10v2\|CJ925970__P1 | 3783 | 770 | 94.4 | globlastp |
| 2356 | LNU470 | oat\|10v2\|GR345351__P1 | 3784 | 770 | 84.9 | globlastp |
| 2357 | LNU470 | oat\|10v1\|GR345351 | 3784 | 770 | 84.9 | globlastp |
| 2358 | LNU471 | sugarcane\|10v1\|CA095155__P1 | 3785 | 771 | 80.1 | globlastp |
| 2359 | LNU472 | brachypodium\|09v1\|SRR031796S0007593__P1 | 3786 | 772 | 88.6 | globlastp |
| 2360 | LNU472 | rice\|gb170\|OS04G58380 | 3787 | 772 | 85 | globlastp |
| 2361 | LNU472 | switchgrass\|gb167\|FL771162 | 3788 | 772 | 83.8 | globlastp |
| 2362 | LNU472 | maize\|10v1\|AW927938__P1 | 3789 | 772 | 81.4 | globlastp |
| 2363 | LNU472 | maize\|gb170\|AW927938 | 3789 | 772 | 81.4 | globlastp |
| 2364 | LNU472 | sugarcane\|10v1\|CA231840 | 3790 | 772 | 80.7 | globlastp |
| 2365 | LNU474 | soybean\|11v1\|GLYMA07G09520__P1 | 3791 | 773 | 99.7 | globlastp |
| 2366 | LNU474 | soybean\|gb168\|BE347442 | 3792 | 773 | 88.8 | globlastp |
| 2367 | LNU474 | soybean\|11v1\|GLYMA09G32300__P1 | 3793 | 773 | 88.5 | globlastp |
| 2368 | LNU476 | maize\|10v1\|AW461103__P1 | 3794 | 774 | 92.5 | globlastp |
| 2369 | LNU476 | maize\|gb170\|AW461103 | 3794 | 774 | 92.5 | globlastp |
| 2370 | LNU476 | sugarcane\|10v1\|CA067184 | 3795 | 774 | 90.4 | globlastp |
| 2371 | LNU476 | sorghum\|09v1\|SB02G036750 | 3796 | 774 | 89.8 | globlastp |
| 2372 | LNU476 | foxtail_millet\|10v2\|OXFXTRMSLX00112582D1T1__P1 | 3797 | 774 | 85.5 | globlastp |
| 2373 | LNU476 | millet\|10v1\|CD725707__T1 | 3798 | 774 | 84.29 | glotblastn |
| 2374 | LNU476 | switchgrass\|gb167\|DN148685 | 3799 | 774 | 82.2 | globlastp |
| 2375 | LNU495 | maize\|10v1\|AI622661__P1 | 3800 | 777 | 92.1 | globlastp |
| 2376 | LNU495 | maize\|10v1\|BG321733__P1 | 3801 | 777 | 90.6 | globlastp |
| 2377 | LNU495 | brachypodium\|09v1\|GT758308__P1 | 3802 | 777 | 84.3 | globlastp |
| 2378 | LNU495 | barley\|10v2\|BJ451039__P1 | 3803 | 777 | 83 | globlastp |
| 2379 | LNU499 | wheat\|gb164\|BE497147 | 3804 | 779 | 92.8 | globlastp |
| 2380 | LNU504 | arabidopsis_lyrata\|09v1\|JGIAL012450__T1 | 3805 | 780 | 91.49 | glotblastn |
| 2381 | LNU507 | barley\|10v2\|BF629582__P1 | 3806 | 781 | 97.8 | globlastp |

TABLE 2-continued

Homologues of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Polyn. SEQ ID NO: | Hom. to Gene Name | cluster name | Polyp. SEQ ID NO: | Hom. to SEQ ID NO: | % global identity | Algor. |
|---|---|---|---|---|---|---|
| 2382 | LNU507 | wheat\|10v2\|BE401116_P1 | 3807 | 781 | 90 | globlastp |
| 2383 | LNU507 | wheat\|gb164\|BE401116 | 3807 | 781 | 90 | globlastp |
| 2384 | LNU507 | wheat\|gb164\|BE425320 | 3808 | 781 | 89.6 | globlastp |
| 2385 | LNU507 | leymus\|gb166\|CN466143_P1 | 3809 | 781 | 89.6 | globlastp |
| 2386 | LNU507 | wheat\|10v2\|BE425320_P1 | 3808 | 781 | 89.6 | globlastp |
| 2387 | LNU507 | wheat\|gb164\|BE426025 | 3810 | 781 | 88.93 | glotblastn |
| 2388 | LNU507 | wheat\|gb164\|BE414564 | 3811 | 781 | 83.9 | globlastp |
| 2389 | LNU507 | wheat\|10v2\|BE414564_P1 | 3812 | 781 | 82.9 | globlastp |
| 2390 | LNU507 | wheat\|10v2\|BE399826_P1 | 3813 | 781 | 82.5 | globlastp |
| 2391 | LNU507 | wheat\|gb164\|BE399826 | 3813 | 781 | 82.5 | globlastp |
| 2392 | LNU517 | soybean\|11v1\|GLYMA16G08470_P1 | 3814 | 783 | 92.7 | globlastp |
| 2393 | LNU517 | soybean\|gb168\|BF643214 | 3814 | 783 | 92.7 | globlastp |
| 2394 | LNU519 | sorghum\|09v1\|SB04G038440 | 3815 | 784 | 92.5 | globlastp |
| 2395 | LNU519 | rice\|gb170\|OS02G58510 | 3816 | 784 | 84.9 | globlastp |
| 2396 | LNU519 | switchgrass\|gb167\|FL698539 | 3817 | 784 | 82.2 | globlastp |
| 2397 | LNU519 | brachypodium\|09v1\|GT761258_P1 | 3818 | 784 | 81.1 | globlastp |

Table 2: Provided are the homologous polypeptides and polynucleotides of the genes identified in Table 1 and of their cloned genes, which can increase nitrogen use efficiency, fertilizer use efficiency, yield, seed yield, growth rate, vigor, biomass, oil content, fiber yield, fiber quality, fiber length, abiotic stress tolerance and/or water use efficiency of a plant. Homology was calculated as % of identity over the aligned sequences. The query sequences were polypeptide sequences SEQ ID NOs: 470-716 and 717-784 and the subject sequences are polypeptide sequences or polynucleotide sequences which were dynamically translated in all six reading frames identified in the database based on greater than 80% identity to the query polypeptide sequences.
"Polyp." = polypeptide;
"Polyn."—Polynucleotide.
Algor. = Algorithm.
"globlastp"—global homology using blastp;
"glotblastn"—global homology using tblastn.
"Hom."—homologous.

The output of the functional genomics approach described herein is a set of genes highly predicted to improve nitrogen use efficiency, fertilizer use efficiency, yield, seed yield, growth rate, vigor, biomass, oil content, fiber yield, fiber length, fiber quality, abiotic stress tolerance and/or water use efficiency of a plant by increasing their expression.

Although each gene is predicted to have its own impact, modifying the mode of expression of more than one gene or gene product (RNA, polypeptide) is expected to provide an additive or synergistic effect on the desired trait (e.g., nitrogen use efficiency, fertilizer use efficiency, yield, growth rate, vigor, biomass, oil content, abiotic stress tolerance and/or water use efficiency of a plant). Altering the expression of each gene described here alone or of a set of genes together increases the overall yield and/or other agronomic important traits, hence expects to increase agricultural productivity.

Example 3

Production of *Arabidopsis* Transcriptom and High Throughput Correlation Analysis Using 44K *Arabidopsis* Oligonucleotide Micro-Array In order to produce a high throughput correlation analysis comparing between plant phenotype and gene expression level, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* Tissues—

Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 3 below.

TABLE 3

*Arabidopsis* transcriptom expression sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

*Arabidopsis* Yield Components and Vigor Related Parameters Under Different Nitrogen Fertilization Levels Assessment—

10 *Arabidopsis* accessions in 2 repetitive plots each containing 8 plants per plot were grown in a greenhouse. The growing protocol used was as follows: surface sterilized seeds were sown in Eppendorf tubes containing 0.5×

Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 4, herein below.

TABLE 4

*Arabidopsis* correlated parameters (vectors)

| Correlated parameter with | Correlation Id |
|---|---|
| N 1.5 mM; Rosette Area at day 8 [$cm^2$] | 1 |
| N 1.5 mM; Rosette Area at day 10 [$cm^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [$cm^2$] | 6 |
| N 1.5 mM; RGR of Rosette Area at day 3 [$cm^2$/day] | 7 |
| N 1.5 mM; t50 Flowering [day] | 8 |
| N 1.5 mM; Dry Weight [gr./plant] | 9 |
| N 1.5 mM; Seed Yield [gr./plant] | 10 |
| N 1.5 mM; Harvest Index | 11 |
| N 1.5 mM; 1000 Seeds weight [gr.] | 12 |
| N 1.5 mM; seed yield/rosette area at day 10 [gr./$cm^2$] | 13 |
| N 1.5 mM; seed yield/leaf blade [gr./$cm^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr.] | 17 |
| N 1.5 mM; DW/N level [gr./SPAD unit] | 18 |
| N 1.5 mM; seed yield/N level [gr./SPAD unit] | 19 |
| N 6 mM; Rosette Area at day 8 [$cm^2$] | 20 |
| N 6 mM; Rosette Area at day 10 [$cm^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [$cm^2$/gr.] | 26 |
| N 6 mM; t50 Flowering [day] | 27 |
| N 6 mM; Dry Weight [gr./plant] | 28 |
| N 6 mM; Seed Yield [gr./plant] | 29 |
| N 6 mM; Harvest Index | 30 |
| N 6 mM; 1000 Seeds weight [gr.] | 31 |
| N 6 mM; seed yield/rosette area day at day 10 [gr./$cm^2$] | 32 |
| N 6 mM; seed yield/leaf blade [gr./$cm^2$] | 33 |
| N 6 mM; N level/FW | 34 |
| N 6 mM; DW/N level [gr./SPAD unit] | 35 |
| N 6 mM; N level/DW (SPAD unit/gr. plant) | 36 |
| N 6 mM; Seed yield/N unit [gr./SPAD unit] | 37 |

"N" = Nitrogen at the noted concentrations;
"cm" = centimeter;
"mM" = millimolar;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = plant dry weight;
"N level/DW" = plant Nitrogen level measured in SPAD unit per plant biomass [gr.];
"DW/N level" = plant biomass per plant [gr.]/SPAD unit;
RGR = relative growth rate;

Assessment of NUE, Yield Components and Vigor-Related Parameters—

Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf Analysis—

Using the digital analysis leaves data was calculated, including leaf number, leaf blade area, Rosette diameter and area.

Relative Growth Area Rate:

The relative growth rate of the rosette and the leaves was calculated according to Formulas V and VI:

Relative growth rate rosette area=Regression coefficient of rosette area along time course     Formula V Relative growth rate of leaves area=Regression coefficient of leaves area along time course     Formula VI Seed Yield and 1000 Seeds Weight—

At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry Weight and Seed Yield—

At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—

The harvest index was calculated using Formula IV as described above.

$T_{50}$ Days to Flowering—

Each of the repeats was monitored for flowering date. Days of flowering was calculated from sowing date till 50% of the plots flowered.

Plant Nitrogen Level—

The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaves. Three measurements per leaf were taken per plot. Based on this measurement, parameters such as the ratio between seed yield per nitrogen unit [seed yield/N level=seed yield per plant [gr]/SPAD unit], plant DW per nitrogen unit [DW/N level=plant biomass per plant [g]/SPAD unit], and nitrogen level per gram of biomass [N level/DW=SPAD unit/plant biomass per plant (gr)] were calculated.

Percent of Seed Yield Reduction—

Measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 37 parameters as described above. The average for each of the measured parameters was calculated using the JMP software and values are summarized in Table 5 below. Subsequent correlation analysis between the various transcriptom sets (Table 3) and the measured parameters was conducted (Table 6 below). Following are the results integrated to the database.

TABLE 5

Measured parameters in *Arabidopsis* accessions

| Ecotype/ Treatment | Line-1 | Line-2 | Line-3 | Line-4 | Line-5 | Line-6 | Line-7 | Line-8 | Line-9 | Line-10 |
| --- | --- | --- | --- | --- | --- | --- | --- | --- | --- | --- |
| N 1.5 mM; Rosette Area at day 8 | 0.760 | 0.709 | 1.061 | 1.157 | 0.996 | 1.000 | 0.910 | 0.942 | 1.118 | 0.638 |
| N 1.5 mM; Rosette Area at day 10 | 1.430 | 1.325 | 1.766 | 1.971 | 1.754 | 1.832 | 1.818 | 1.636 | 1.996 | 1.150 |
| N 1.5 mM; Plot Coverage % at day 8 | 3.221 | 3.003 | 4.497 | 4.902 | 4.220 | 4.238 | 3.858 | 3.990 | 4.738 | 2.705 |
| N 1.5 mM; Plot Coverage % at day 10 | 6.058 | 5.614 | 7.484 | 8.351 | 7.432 | 7.764 | 7.702 | 6.933 | 8.458 | 4.871 |
| N 1.5 mM; Leaf Number at day 10 | 6.875 | 7.313 | 7.313 | 7.875 | 7.938 | 7.750 | 7.625 | 7.188 | 8.625 | 5.929 |
| N 1.5 mM; Leaf Blade Area at day 10 | 0.335 | 0.266 | 0.374 | 0.387 | 0.373 | 0.370 | 0.386 | 0.350 | 0.379 | 0.307 |
| N 1.5 mM; RGR of Rosette Area at day 3 | 0.631 | 0.793 | 0.502 | 0.491 | 0.605 | 0.720 | 0.825 | 0.646 | 0.668 | 0.636 |
| N 1.5 mM; t50 Flowering [day] | 15.967 | 20.968 | 14.836 | 24.708 | 23.566 | 23.698 | 18.059 | 19.488 | 23.568 | 21.888 |
| N 1.5 mM; Dry Weight [gr/plant] | 0.164 | 0.124 | 0.082 | 0.113 | 0.184 | 0.124 | 0.134 | 0.106 | 0.148 | 0.171 |
| N 1.5 mM; Seed Yield [gr/plant] | 0.032 | 0.025 | 0.023 | 0.010 | 0.006 | 0.009 | 0.032 | 0.019 | 0.012 | 0.014 |
| N 1.5 mM; Harvest Index | 0.192 | 0.203 | 0.295 | 0.085 | 0.031 | 0.071 | 0.241 | 0.179 | 0.081 | 0.079 |
| N 1.5 mM; 1000 Seeds weight[gr] | 0.016 | 0.016 | 0.018 | 0.014 | 0.018 | 0.022 | 0.015 | 0.014 | 0.022 | 0.019 |

TABLE 5-continued

Measured parameters in *Arabidopsis* accessions

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 1.5 mM; seed yield/rosette area day at day 10 | 0.022 | 0.019 | 0.014 | 0.005 | 0.003 | 0.005 | 0.018 | 0.013 | 0.007 | 0.012 |
| N 1.5 mM; seed yield/leaf blade | 0.095 | 0.095 | 0.063 | 0.026 | 0.015 | 0.024 | 0.084 | 0.059 | 0.034 | 0.044 |
| N 1.5 mM; % Seed yield reduction compared to 6 mM | 72.559 | 84.701 | 78.784 | 87.996 | 91.820 | 92.622 | 76.710 | 81.938 | 91.301 | 85.757 |
| N 1.5 mM; % Biomass reduction compared to 6 mM | 60.746 | 76.706 | 78.560 | 78.140 | 62.972 | 78.641 | 73.192 | 83.068 | 77.190 | 70.120 |
| N 1.5 mM; Spad/FW | 45.590 | | | 42.108 | 28.151 | | 53.111 | | | 67.000 |
| N1.5 mM; SPAD/DW | 167.300 | | | 241.061 | 157.823 | | 194.977 | | | 169.343 |
| N 1.5 mM; DW/SPAD | 0.006 | | | 0.004 | 0.006 | | 0.005 | | | 0.006 |
| N 1.5 mM; seed yield/spad | 0.001 | | | 0.000 | 0.000 | | 0.001 | | | 0.000 |
| N 6 mM; Rosette Area at day 8 | 0.759 | 0.857 | 1.477 | 1.278 | 1.224 | 1.095 | 1.236 | 1.094 | 1.410 | 0.891 |
| N 6 mM; Rosette Area at day 10 | 1.406 | 1.570 | 2.673 | 2.418 | 2.207 | 2.142 | 2.474 | 1.965 | 2.721 | 1.642 |
| N 6 mM; Plot Coverage % at day 8 | 3.216 | 3.631 | 6.259 | 5.413 | 5.187 | 4.641 | 5.236 | 4.634 | 5.974 | 3.774 |
| N 6 mM; Plot Coverage % at day 10 | 5.957 | 6.654 | 11.324 | 10.244 | 9.352 | 9.076 | 10.485 | 8.327 | 11.528 | 6.958 |
| N 6 mM; Leaf Number at day 10 | 6.250 | 7.313 | 8.063 | 8.750 | 8.063 | 8.750 | 8.375 | 7.125 | 9.438 | 6.313 |
| N 6 mM; Leaf Blade Area at day 10 | 0.342 | 0.315 | 0.523 | 0.449 | 0.430 | 0.430 | 0.497 | 0.428 | 0.509 | 0.405 |
| N 6 mM; RGR of Rosette Area at day 3 | 0.689 | 1.024 | 0.614 | 0.601 | 0.477 | 0.651 | 0.676 | 0.584 | 0.613 | 0.515 |
| N 6 mM; t50 Flowering [day] | 16.371 | 20.500 | 14.635 | 24.000 | 23.378 | 23.595 | 15.033 | 19.750 | 22.887 | 18.804 |
| N 6 mM; Dry Weight [gr/plant] | 0.419 | 0.531 | 0.382 | 0.518 | 0.496 | 0.579 | 0.501 | 0.628 | 0.649 | 0.573 |
| N 6 mM; Seed Yield [gr/plant] | 0.116 | 0.165 | 0.108 | 0.082 | 0.068 | 0.119 | 0.139 | 0.107 | 0.138 | 0.095 |
| N 6 mM; Harvest Index | 0.280 | 0.309 | 0.284 | 0.158 | 0.136 | 0.206 | 0.276 | 0.171 | 0.212 | 0.166 |
| N 6 mM; 1000 Seeds weight[gr] | 0.015 | 0.017 | 0.018 | 0.012 | 0.016 | 0.016 | 0.015 | 0.014 | 0.017 | 0.016 |
| N 6 mM; seed yield/rosette area day at day 10 | 0.082 | 0.106 | 0.041 | 0.034 | 0.031 | 0.056 | 0.057 | 0.055 | 0.051 | 0.058 |

TABLE 5-continued

Measured parameters in *Arabidopsis* accessions

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 6 mM; seed yield/leaf blade | 0.339 | 0.526 | 0.207 | 0.183 | 0.158 | 0.277 | 0.281 | 0.252 | 0.271 | 0.235 |
| N 6 mM; Spad / FW | 22.489 | | | 28.268 | 17.641 | | 33.323 | | | 39.003 |
| N 6 mM; DW/SPAD (biomass/N unit) | 0.019 | | | 0.018 | 0.028 | | 0.015 | | | 0.015 |
| N 6 mM; spad/DW (gN/g plant) | 53.705 | | | 54.625 | 35.548 | | 66.479 | | | 68.054 |
| N 6 mM; Seed yield/N unit | 0.004 | | | 0.003 | 0.002 | | 0.005 | | | 0.003 |

Table 5. Provided are the measured parameters under various treatments in various ecotypes (*Arabidopsis* accessions).

TABLE 6

Correlation between the expression level of selected LNU genes of some embodiments of the invention in various tissues and the phenotypic performance under normal or low nitrogen fertilization conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LNU512 | 0.79 | 0.0063 | B | 12 | LNU306 | 0.74 | 0.0150 | B | 11 |
| LNU382 | 0.80 | 0.0053 | B | 12 | LNU424 | 0.90 | 0.0004 | A | 27 |
| LNU382 | 0.71 | 0.0218 | A | 5 | LNU424 | 0.88 | 0.0008 | A | 8 |
| LNU308 | 0.79 | 0.0065 | A | 31 | LNU424 | 0.86 | 0.0012 | A | 15 |
| LNU308 | 0.83 | 0.0052 | D | 31 | LNU424 | 0.78 | 0.0125 | D | 5 |
| LNU308 | 0.81 | 0.0046 | C | 31 | | | | | |

Table 6. "Corr. Set ID"—correlation set ID according to the correlated parameters Table above.

Example 4

Production of Rice Transcriptom Using 44K Rice Oligonucleotide Micro-Array

In order to produce differential expression analysis of rice plants subjected to nitrogen limiting conditions compared to normal (non-limiting) nitrogen conditions, the present inventors have utilized a Rice oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 rice genes and transcripts.

Experimental Procedures

Rice Plants Grown Under Different Nitrogen Fertilization Levels Assessment—

Five rice accessions were grown in 3 repetitive plots, each containing 10 plants, at a net house under semi-hydroponics conditions. Briefly, the growing protocol was as follows: Rice seeds were sown in trays filled with a mix of vermiculite and peat in a 1:1 ratio. Constant nitrogen limiting conditions were achieved by irrigating the plants with a solution containing 0.8 mM inorganic nitrogen in the form of $KNO_3$, supplemented with 1 mM $KH_2PO_4$, 1 mM $MgSO_4$, 3.6 mM $K_2SO_4$ and microelements, while normal nitrogen levels were achieved by applying a solution of 8 mM inorganic nitrogen also in the form of $KNO_3$ with 1 mM $KH_2PO_4$, 1 mM $MgSO_4$, and microelements.

Analyzed Rice Tissues—

All 5 selected rice varieties were pooled in 1 batch per each treatment. Two tissues [leaves and roots] growing at two different nitrogen fertilization levels, 0.8 mM Nitrogen (nitrogen limiting conditions) or 8 mM Nitrogen (normal nitrogen conditions) were sampled and RNA was extracted as described above. For convenience, each micro-array expression information tissue type has received a Set ID as summarized in Table 7 below.

TABLE 7

Rice transcriptom expression sets

| Expression Set | Set ID |
|---|---|
| Leaves at 0.8 mM Nitrogen fertilization | A |
| Leaves at 8 mM Nitrogen fertilization | B |
| Roots at 0.8 mM Nitrogen fertilization | C |
| Roots at 8 mM Nitrogen fertilization | D |

Experimental Results

Gene up-regulation under reduced nitrogen fertilization levels indicates the involvement of the genes in NUE improvement.

Example 5

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* Tissues—

Five tissues at different developmental stages including root, leaf, flower at anthesis, seed at 5 days after flowering (DAF) and seed at 12 DAF, representing different plant characteristics, were sampled and RNA was extracted as described above. Each micro-array expression information tissue type has received a Set ID as summarized in Table 8 below.

TABLE 8

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Provided are the identification (ID) letters of each of the *Arabidopsis* expression sets (A-E). DAF = days after flowering.

Yield Components and Vigor Related Parameters Assessment—

Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital Imaging in Tissue Culture—

A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital Imaging in Greenhouse—

The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root Analysis—

During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula VII.

Relative growth rate of root coverage=Regression coefficient of root coverage along time course    Formula VII Vegetative Growth Rate Analysis—

Was calculated according to Formula VIII. The analysis was ended with the appearance of overlapping plants.

Relative vegetative growth rate area=Regression coefficient of vegetative area along time course    Formula VIII For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in Siliques Analysis—

On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds Average Weight—

At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil Percentage in Seeds—

At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN UltraOxford Instrument) and its MultiQuant software package.

Silique Length Analysis—

On day 50 from sowing, 30 siliques from different plants in each plot were sampled in block A. The chosen siliques were green-yellow in color and were collected from the bottom parts of a grown plant's stem. A digital photograph was taken to determine silique's length.

Dry Weight and Seed Yield—

On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil Yield—

The oil yield was calculated using Formula IX.

Seed Oil yield=Seed yield per plant(gr.)*Oil % in seed    Formula IX

Harvest Index (Seed)—

The harvest index was calculated using Formula IV (described above).

Experimental Results

Nine different *Arabidopsis* ecotypes were grown and characterized for 18 parameters (named as vectors).

TABLE 9

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr.) at bolting stage | 4 |
| Dry matter per plant (gr.) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr.) | 11 |
| Oil % per seed | 12 |
| Seeds per silique | 13 |
| Silique length (cm) | 14 |
| Seed yield per plant (gr.) | 15 |
| Oil yield per plant (mg) | 16 |
| Harvest Index | 17 |
| Leaf width/length | 18 |

Provided are the *Arabidopsis* correlated parameters (correlation ID Nos. 1-18).
Abbreviations:
cm = centimeter(s);
gr. = gram(s);
mg = milligram(s).

The characterized values are summarized in Tables 10 and 11 below.

TABLE 10

Measured parameters in *Arabidopsis* ecotypes

| Ecotype/Parameter ID | 15 | 16 | 12 | 11 | 5 | 17 | 10 | 13 | 14 |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 10. Provided are the values of each of the parameters measured in *Arabidopsis* ecotypes: 15 = Seed yield per plant (gr.); 16 = oil yield per plant (mg); 12 = oil % per seed; 11 = 1000 seed weight (gr.); 5 = dry matter per plant (gr.); 17 = harvest index; 10 = total leaf area per plant (cm); 13 = seeds per silique; 14 = Silique length (cm).

TABLE 11

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |

TABLE 11-continued

Additional measured parameters in *Arabidopsis* ecotypes

| Eco-type | 6 | 3 | 2 | 1 | 4 | 9 | 8 | 18 | 7 |
|---|---|---|---|---|---|---|---|---|---|
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shak-dara | 0.471 | 0.782 | 1.251 | 7.041 | 3.710 | 4.149 | 1.668 | 0.307 | 0.409 |

Table 11. Provided are the values of each of the parameters measured in *Arabidopsis* ecotypes: 6 = Vegetative growth rate (cm²/day) until 8 true leaves; 3 = relative root growth (cm/day) (day 13); 2 = Root length day 7 (cm); 1 = Root length day 13 (cm); 4 = fresh weight per plant (gr.) at bolting stage; 9. = Lamima length (cm); 8 = Lamina width (cm); 18 = Leaf width/length; 7 = Blade circularity.

Table 12 provides the correlation analyses.

TABLE 12

Correlation between the expression level of selected LNU genes of some embodiments of the invention in various tissues and the phenotypic performance under normal or low nitrogen fertilization conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LNU308 | 0.76 | 0.0271 | B | 17 | LNU306 | 0.73 | 0.039 | A | 1 |
| LNU308 | 0.83 | 0.0116 | A | 17 | LNU424 | 0.84 | 0.009 | B | 15 |
| LNU504 | 0.73 | 0.0397 | C | 12 | LNU424 | 0.83 | 0.0114 | B | 16 |
| LNU504 | 0.72 | 0.0454 | B | 9 | LNU424 | 0.86 | 0.0065 | A | 1 |
| LNU504 | 0.86 | 0.0066 | E | 15 | LNU424 | 0.72 | 0.0443 | A | 2 |
| LNU504 | 0.77 | 0.0259 | E | 16 | LNU424 | 0.80 | 0.0311 | D | 11 |
| LNU306 | 0.87 | 0.0045 | C | 13 | | | | | |

Table 12. "Corr. Set ID"—correlation set ID according to the correlated parameters Table above.

TABLE 13

Barley transcriptom expression sets

| Expression Set | Set ID |
|---|---|
| Meristem | A |
| Flower | B |
| Booting spike | C |
| Stem | D |
| Flag leaf | E |

Table 13

Example 6

Production of Barley Transcriptom and High Throughput Correlation Analysis Using 44K Barley Oligonucleotide Micro-Array In order to produce a high throughput correlation analysis comparing between plant phenotype and gene expression level under normal conditions, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley Tissues—

Five tissues at different developmental stages [meristem, flower, booting spike, stem and flag leaf], representing different plant characteristics, were sampled and RNA was extracted as described above. Each micro-array expression information tissue type has received a Set ID as summarized in Table 13 below.

Barley Yield Components and Vigor Related Parameters Assessment—

25 Barley accessions in 4 repetitive blocks (named A, B, C, and D), each containing 4 plants per plot were grown at net house. Plants were phenotyped on a daily basis following the standard descriptor of barley (Table 14, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 14

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 14

Grains Per Spike—
At the end of the experiment (50% of the spikes were dry) all spikes from plots within blocks A-D were collected. The total number of grains from 5 spikes that were manually threshed was counted. The average grain per spike is calculated by dividing the total grain number by the number of spikes.

Grain Average Size (cm)—
At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain Average Weight (mgr)—
At the end of the experiment (50% of the spikes were dry) all spikes from plots within blocks A-D were collected. The total grains from 5 spikes that were manually threshed were counted and weight. The average weight was calculated by dividing the total weight by the total grain number.

Grain Yield Per Spike (gr)—
At the end of the experiment (50% of the spikes were dry) all spikes from plots within blocks A-D were collected. The total grains from spikes that were manually threshed were weight. The grain yield was calculated by dividing the total weight by the spike number.

Spike Length Analysis—
At the end of the experiment (50% of the spikes were dry) all spikes from plots within blocks A-D were collected. The five chosen spikes per plant were measured using measuring tape excluding the awns.

Spike Number Analysis—
At the end of the experiment (50% of the spikes were dry) all spikes from plots within blocks A-D were collected. The spikes per plant were counted.

Growth Habit Scoring—
At the growth stage 10 (booting), each of the plants was scored for its growth habit nature. The scale that was used was 1 for prostate nature till 9 for erect.

Hairiness of Basal Leaves—
At the growth stage 5 (leaf sheath strongly erect; end of tillering), each of the plants was scored for its hairiness nature of the leaf before the last. The scale that was used was 1 for prostate nature till 9 for erect.

Plant Height—
At the harvest stage (50% of spikes were dry) each of the plants was measured for its height using measuring tape. Height was measured from ground level to top of the longest spike excluding awns.

Days to Flowering—
Each of the plants was monitored for flowering date. Days of flowering was calculated from sowing date till flowering date.

Stem Pigmentation—
At the growth stage 10 (booting), each of the plants was scored for its stem color. The scale that was used was 1 for green till 5 for full purple.

Vegetative Dry Weight and Spike Yield—
At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for Barley)—
The harvest index is calculated using Formula X.

Harvest Index=Average spike dry weight per plant/ (Average vegetative dry weight per plant+Average spike dry weight per plant)  Formula X

TABLE 15

Barley correlated parameters (vectors)

| Correlation set | Correlation ID |
|---|---|
| Grains per spike (numbers) | 1 |
| Grains size (mm2) | 2 |
| Grain weight (miligrams) | 3 |
| Grain Yield per spike (gr/spike) | 4 |

TABLE 15-continued

| Barley correlated parameters (vectors) | |
|---|---|
| Correlation set | Correlation ID |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |
| Stem pigmentation (scoring 1-5) | 11 |
| Vegetative dry weight (gram) | 12 |
| Harvest Index (ratio) | 13 |

Table 15

Experimental Results 13 different Barley accessions were grown and characterized for 13 parameters as described above. The average for each of the measured parameter was calculated using the JMP software and values are summarized in Tables 16 and 17 below. Subsequent correlation analysis between the various transcriptom sets (Table 13) and the measured parameters (Tables 16 and 17), was conducted (Table 18). Follow, results were integrated to the database.

TABLE 16

Measured parameters of correlation IDs in Barley accessions

| Accession/Parameter | 6 | 10 | 3 | 5 | 2 | 1 | 7 |
|---|---|---|---|---|---|---|---|
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada park | 37.42 | 65.15 | 28.76 | 11.83 | 0.24 | 17.27 | 1.92 |
| Havarim stream | 61.92 | 58.92 | 17.87 | 9.90 | 0.17 | 17.73 | 3.17 |
| Jordan est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale Efraim | ND | 52.80 | 25.22 | 8.86 | 0.22 | 13.47 | 3.60 |

TABLE 16-continued

Measured parameters of correlation IDs in Barley accessions

| Accession/Parameter | 6 | 10 | 3 | 5 | 2 | 1 | 7 |
|---|---|---|---|---|---|---|---|
| Mt Arbel | 40.63 | 60.88 | 34.99 | 11.22 | 0.28 | 14.07 | 3.50 |
| Mt Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot Kdumim | 50.60 | 60.40 | 37.13 | 10.18 | 0.27 | 14.36 | 2.47 |
| Oren canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 16. Provided are the values of each of the parameters measured in Barley accessions according to the following correlation identifications (Correlation Ids): 6 = Spikes per plant; 10 = Days to flowering; 3 = Grain weight; 5 = Spike length; 2 = Grains Size; 1 = Grains per spike; 7 = Growth habit.

TABLE 17

Barley accessions, additional measured parameters

| Accession/Parameter | 8 | 9 | 4 | 11 | 12 | 13 |
|---|---|---|---|---|---|---|
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada park | 1.69 | 138.77 | 2.58 | 1.69 | 68.49 | 0.40 |
| Havarim stream | 1.08 | 114.58 | 1.57 | 1.75 | 53.39 | 0.44 |
| Jordan est | 1.42 | 127.75 | 3.03 | 2.33 | 68.30 | 0.43 |
| Klil | 1.69 | 129.38 | 2.52 | 2.31 | 74.17 | 0.40 |
| Maale Efraim | 1.30 | 103.89 | 1.55 | 1.70 | 35.35 | 0.52 |
| Mt Arbel | 1.19 | 121.63 | 2.62 | 2.19 | 58.33 | 0.48 |
| Mt Harif | 1.00 | 126.80 | 2.30 | 2.30 | 62.23 | 0.44 |
| Neomi | 1.17 | 99.83 | 1.68 | 1.83 | 38.32 | 0.49 |
| Neot Kdumim | 1.60 | 121.40 | 2.68 | 3.07 | 68.31 | 0.45 |
| Oren canyon | 1.08 | 118.42 | 2.35 | 1.58 | 56.15 | ND |
| Yeruham | 1.17 | 117.17 | 1.67 | 2.17 | 42.68 | ND |

Table 17. Provided are the values of each of the parameters measured in Barley accessions according to the following correlation identifications (Correlation Ids): 8 = Hairiness of basal leaves; 9 = Plant height; 4 = Grain yield per spike; 11 = Stem pigmentation; 12 = Vegetative dry weight; 13 = Harvest Index.

TABLE 18

Correlation between the expression level of selected LNU genes of some embodiments of the invention in various tissues and the phenotypic performance under normal fertilization conditions across barley accessions

| Gene Name | R | P value | Exp. Set | Corr. Set ID | Gene Name | R | P value | Exp. Set | Corr. Set ID |
|---|---|---|---|---|---|---|---|---|---|
| LNU407 | 0.81 | 0.0087 | C | 2 | LNU408 | 0.75 | 0.0308 | B | 10 |
| LNU407 | 0.80 | 0.0032 | C | 2 | LNU436 | 0.75 | 0.0311 | B | 1 |
| LNU407 | 0.75 | 0.0078 | C | 3 | LNU436 | 0.74 | 0.0144 | B | 1 |
| LNU407 | 0.75 | 0.0211 | C | 3 | LNU467 | 0.76 | 0.0289 | B | 1 |
| LNU435 | 0.84 | 0.0049 | C | 2 | LNU447 | 0.87 | 0.0054 | B | 8 |
| LNU435 | 0.75 | 0.0191 | C | 3 | LNU447 | 0.75 | 0.0119 | B | 8 |
| LNU435 | 0.71 | 0.0138 | C | 2 | LNU297 | 0.85 | 0.0072 | A | 6 |
| LNU456 | 0.71 | 0.0470 | C | 6 | LNU297 | 0.75 | 0.0075 | A | 6 |
| LNU305 | 0.87 | 0.0051 | B | 10 | LNU436 | 0.77 | 0.0148 | A | 1 |
| LNU305 | 0.81 | 0.0138 | B | 9 | LNU436 | 0.76 | 0.0071 | A | 1 |
| LNU305 | 0.81 | 0.0048 | B | 9 | LNU448 | 0.74 | 0.0348 | A | 6 |
| LNU305 | 0.77 | 0.0242 | B | 5 | LNU438 | 0.85 | 0.0071 | A | 6 |
| LNU305 | 0.76 | 0.0111 | B | 5 | LNU467 | 0.77 | 0.0054 | A | 6 |

TABLE 18-continued

Correlation between the expression level of selected LNU genes of some embodiments of the invention in various tissues and the phenotypic performance under normal fertilization conditions across barley accessions

| Gene Name | R | P value | Exp. Set | Corr. Set ID | Gene Name | R | P value | Exp. Set | Corr. Set ID |
|---|---|---|---|---|---|---|---|---|---|
| LNU305 | 0.75 | 0.0125 | B | 10 | LNU467 | 0.75 | 0.0332 | A | 6 |
| LNU435 | 0.81 | 0.0159 | B | 7 | LNU447 | 0.79 | 0.0106 | A | 8 |
| LNU435 | 0.75 | 0.0119 | B | 7 | LNU447 | 0.79 | 0.0036 | A | 4 |
| LNU408 | 0.79 | 0.0186 | B | 12 | LNU447 | 0.77 | 0.0160 | A | 4 |
| LNU408 | 0.79 | 0.0188 | B | 4 | LNU447 | 0.73 | 0.0107 | A | 8 |

Table 18. "Con. Set ID"—correlation set ID according to the correlated parameters Table above.

Example 7

Production of *Sorghum* Transcriptom and High Throughput Correlation Analysis with Yield, NUE, and ABST Related Parameters Measured in Fields Using 44K *Sorghum* Oligonucleotide Micro-Arrays In order to produce a high throughput correlation analysis between plant phenotype and gene expression level, the present inventors utilized a sorghum oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotypes Grown Under Low Nitrogen, Regular Growth and Severe Drought Conditions Experimental Procedures 17 *Sorghum* varieties were grown in 3 repetitive plots, in field. Briefly, the growing protocol was as follows:

1. Regular Growth Conditions:

*Sorghum* plants were grown in the field using commercial fertilization and irrigation protocols.

2. Low Nitrogen Fertilization Conditions:

*Sorghum* plants were fertilized with 50% less amount of nitrogen in the field than the amount of nitrogen applied in the regular growth treatment. All the fertilizer was applied before flowering.

3. Drought Stress

*Sorghum* seeds were sown in soil and grown under normal condition until around 35 days from sowing, around stage V8 (eight green leaves are fully expanded, booting not started yet). At this point, irrigation was stopped, and severe drought stress was developed.

Analyzed *Sorghum* Tissues—

All 10 selected *Sorghum* hybrids were sample per each treatment. Plant tissues [Flag leaf, Flower meristem and Flower] growing under low nitrogen, severe drought stress and plants grown under normal conditions were sampled and RNA was extracted as described above. Each micro-array expression information tissue type has received a Set ID as summarized in Table 19 below.

TABLE 19

Sorghum transcriptom expression sets in field experiments

| Expression Set | Set ID |
|---|---|
| sorghum field/flag leaf/Drought | A |
| sorghum field/flag leaf/Low N | B |
| sorghum field/flag leaf/Normal | C |
| sorghum field/flower meristem/Drought | D |
| sorghum field/flower meristem/Low N | E |
| sorghum field/flower meristem/Normal | F |
| sorghum field/flower/Drought | G |
| sorghum field/flower/Low N | H |
| sorghum field/flower/Normal | J |

Table 19
Provided are the sorghum transcriptom expression sets.
Flag leaf = the leaf below the flower;
Flower meristem = Apical meristem following panicle initiation;
Flower = the flower at the anthesis day.

The following parameters were collected using digital imaging system:

Average Grain Area ($cm^2$)—

At the end of the growing period the grains were separated from the Plant 'Head'. A sample of ~200 grains were weight, photographed and images were processed using the below described image processing system. The grain area was measured from those images and was divided by the number of grains.

Average Grain Length (cm)—

At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head Average Area ($cm^2$)

At the end of the growing period 5 'Heads' were, photographed and images were processed using the below described image processing system. The 'Head' area was measured from those images and was divided by the number of 'Heads'.

Head Average Length (cm)

At the end of the growing period 5 'Heads' were, photographed and images were processed using the below described image processing system. The 'Head' length (longest axis) was measured from those images and was divided by the number of 'Heads'.

The image processing system was used, which consists of a personal desktop computer (Intel P4 3.0 GHz processor)

and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight Per Head (gr.)—

At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head Per Plant Gram—

At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant Height—

Plants were characterized for height during growing period at 5 time points. In each measure, plants were measured for their height using a measuring tape. Height was measured from ground level to top of the longest leaf.

Plant Leaf Number—

Plants were characterized for leaf number during growing period at 5 time points. In each measure, plants were measured for their leaf number by counting all the leaves of 3 selected plants per plot.

Relative Growth Rate

Was calculated using Formulas XI and XII.

Relative growth rate of plant height=Regression
coefficient of plant height along time course    Formula XI Relative growth rate of plant leaf
number=Regression coefficient of plant leaf
number along time course    Formula XII

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative Dry Weight and Heads—

At the end of the experiment (when Inflorescence were dry) all Inflorescence and vegetative material from plots within blocks A-C were collected. The biomass and Heads weight of each plot was separated, measured and divided by the number of Heads.

Dry weight=total weight of the vegetative portion above ground (excluding roots) after drying at 70° C. in oven for 48 hours;

Harvest Index (HI) (*Sorghum*)

The harvest index was calculated using Formula XIII.

Harvest Index=Average grain dry weight per Head/
(Average vegetative dry weight per Head+Average Head dry weight)    Formula XIII FW Heads/(FW Heads+FW Plants)—

The total fresh weight of heads and their respective plant biomass was measured at the harvest day. The heads weight was divided by the sum of weights of heads and plants.

Experimental Results 17 different sorghum hybrids were grown and characterized for different parameters (Table 20). The average for each of the measured parameter was calculated using the JMP software (Tables 21-25) and a subsequent correlation analysis was performed (Table 26). Results were then integrated to the database.

TABLE 20

Sorghum correlated parameters (vectors)

| Correlation set | Correlation ID |
| --- | --- |
| [Grain yield/SPAD 64 DPS], Low N | 1 |
| [Grain yield/SPAD 64 DPS], Normal | 2 |
| [Grain Yield + plant biomass/SPAD 64 DPS], Low N | 3 |
| [Grain Yield + plant biomass/SPAD 64 DPS], Normal | 4 |
| [Plant biomass (FW)/SPAD 64 DPS], Drought | 5 |
| [Plant biomass (FW)/SPAD 64 DPS], Low N | 6 |
| [Plant biomass (FW)/SPAD 64 DPS], Normal | 7 |
| Average Grain Area (cm2), Drought | 8 |
| Average Grain Area (cm2), Low N | 9 |
| Average Grain Area (cm2), Normal | 10 |
| Final Plant Height (cm), Drought | 11 |
| Final Plant Height (cm), Low N | 12 |
| Final Plant Height (cm), Normal | 13 |
| FW—Head/Plant gr. (based on 5 plants), Low N | 14 |
| FW—Head/Plant gr. (based on 5 plants), Normal | 15 |
| FW—Head/Plant gr. (based on plot), Drought | 16 |
| FW—Head/Plant gr. (based on plot), Low N | 17 |
| FW—Head/Plant gr. (based on plot), Normal | 18 |
| FW Heads/(FW Heads + FW Plants)(all plot), Drought | 19 |
| FW Heads/(FW Heads + FW Plants)(all plot), Low N | 20 |
| FW Heads/(FW Heads + FW Plants)(all plot), Normal | 21 |
| FW/Plant gr. (based on plot), Drought | 22 |
| FW/Plant gr. (based on plot), Low N | 23 |
| FW/Plant gr. (based on plot), Normal | 24 |
| Head Average Area (cm2), Drought | 25 |
| Head Average Area (cm2), Low N | 26 |
| Head Average Area (cm2), Normal | 27 |
| Head Average Length (cm), Drought | 28 |
| Head Average Length (cm), Low N | 29 |
| Head Average Length (cm), Normal | 30 |
| Head Average Perimeter (cm), Drought | 31 |
| Head Average Perimeter (cm), Low N | 32 |
| Head Average Perimeter (cm), Normal | 33 |
| Head Average Width (cm), Drought | 34 |
| Head Average Width (cm), Low N | 35 |
| Head Average Width (cm), Normal | 36 |
| Leaf SPAD 64 DPS (Days Post Sowing), Drought | 37 |
| Leaf SPAD 64 DPS (Days Post Sowing), Low N | 38 |
| Leaf SPAD 64 DPS (Days Post Sowing), Normal | 39 |
| Lower Ratio Average Grain Area, Low N | 40 |
| Lower Ratio Average Grain Area, Normal | 41 |
| Lower Ratio Average Grain Length, Low N | 42 |
| Lower Ratio Average Grain Length, Normal | 43 |
| Lower Ratio Average Grain Perimeter, Low N | 44 |
| Lower Ratio Average Grain Perimeter, Normal | 45 |
| Lower Ratio Average Grain Width, Low N | 46 |
| Lower Ratio Average Grain Width, Normal | 47 |
| Total grain weight/Head (based on plot) gr., Low N | 48 |
| Total grain weight/Head gr. (based on 5 heads), Low N | 49 |
| Total grain weight/Head gr. (based on 5 heads), Normal | 50 |
| Total grain weight/Head gr. (based on plot), Normal | 51 |
| Total grain weight/Head gr.,(based on plot), Drought | 52 |
| Upper Ratio Average Grain Area, Drought | 53 |
| Upper Ratio Average Grain Area, Low N | 54 |
| Upper Ratio Average Grain Area, Normal | 55 |

Table 20
Provided are the Sorghum correlated parameters (vectors).
"gr." = grams;
"SPAD" = chlorophyll levels;
"FW" = Plant Fresh weight;
"DW" = Plant Dry weight;
"normal" = standard growth conditions;
"DPS" = days post sowing;
"Low N" = Low Nitrogen.

TABLE 21

Measured parameters in *Sorghum* accessions under normal conditions

| Seed ID/ Correlation ID | 2 | 4 | 7 | 10 | 13 | 15 | 18 | 21 | 24 | 27 | 30 |
|---|---|---|---|---|---|---|---|---|---|---|---|
| 20 | 3.78 | 4.5 | 0.724 | 0.105 | 95.2 | 406 | 175 | 0.51 | 163 | 120 | 25.6 |
| 21 | 7.74 | 8.17 | 0.433 | 0.112 | 79.2 | 518 | 223 | 0.51 | 213 | 168 | 26.8 |
| 22 | 7.01 | 7.87 | 0.858 | 0.131 | 198 | 148 | 56.4 | 0.115 | 335 | 85.1 | 21 |
| 24 | 10.1 | 10.7 | 0.583 | 0.129 | 234 | 423 | 112 | 0.263 | 313 | 157 | 26.8 |
| 25 | 7.65 | 8.34 | 0.693 | 0.139 | 189 | 92 | 67.3 | 0.12 | 462 | 104 | 23.1 |
| 26 | 3.34 | 4.4 | 1.05 | 0.141 | 195 | 101 | 66.9 | 0.177 | 318 | 102 | 21.8 |
| 27 | 3.05 | 3.73 | 0.687 | 0.11 | 117 | 424 | 126 | 0.459 | 151 | 169 | 31.3 |
| 28 | 3.9 | 4.83 | 0.929 | 0.113 | 92.8 | 386 | 108 | 0.432 | 138 | 109 | 23.2 |
| 29 | 2.83 | 3.67 | 0.841 | 0.102 | 113 | 410 | 124 | 0.425 | 168 | 135 | 25.7 |
| 30 | 2.18 | 2.89 | 0.716 | 0.118 | 97.5 | 329 | 103 | 0.442 | 129 | 169 | 28.8 |
| 31 | 2.19 | 2.91 | 0.721 | 0.121 | 98 | 391 | 82.3 | 0.458 | 97.6 | 156 | 28.1 |
| 32 | 2.41 | 3.12 | 0.705 | 0.111 | 100 | 436 | 77.6 | 0.447 | 99.3 | 112 | 23 |
| 33 | 3.58 | 4.75 | 1.17 | 0.117 | 106 | 430 | 91.2 | 0.447 | 112 | 155 | 28.1 |
| 34 | 2.9 | 3.69 | 0.792 | 0.108 | 151 | 441 | 150 | 0.513 | 157 | 172 | 30 |
| 35 | 3 | 3.85 | 0.849 | 0.105 | 117 | 416 | 109 | 0.46 | 131 | 169 | 30.5 |
| 36 | 4.85 | 5.83 | 0.984 | 0.11 | 124 | 430 | 108 | 0.442 | 136 | 163 | 27.2 |
| 37 | | | | 0.105 | 126 | 428 | 131 | 0.386 | 209 | 170 | 29.3 |

Table 21: Provided are the values of each of the parameters (as described above) measured in *Sorghum* accessions (Seed ID) under normal conditions. Growth conditions are specified in the experimental procedure section.

TABLE 22

Additional measured parameters in *Sorghum* accessions under normal growth conditions

| Seed ID/ Corr. ID | 33 | 36 | 39 | 41 | 43 | 45 | 47 | 50 | 51 | 55 |
|---|---|---|---|---|---|---|---|---|---|---|
| 20 | 61.2 | 5.97 | 43 | 0.825 | 0.914 | 0.914 | 0.908 | 47.4 | 31.1 | 1.22 |
| 21 | 67.9 | 7.92 | 0 | 0.74 | 0.884 | 0.869 | 0.833 | 46.3 | 26.4 | 1.3 |
| 22 | 56.3 | 4.87 | 43.3 | 0.778 | 0.921 | 0.913 | 0.85 | 28.4 | 18.7 | 1.13 |
| 24 | 65.4 | 7.43 | 44.7 | 0.802 | 0.908 | 0.948 | 0.874 | 70.4 | 38.4 | 1.14 |
| 25 | 67.5 | 5.58 | 45.8 | 0.697 | 0.89 | 0.902 | 0.788 | 32.1 | 26.7 | 1.16 |
| 26 | 67.5 | 5.88 | 41.6 | 0.699 | 0.877 | 0.915 | 0.799 | 49.2 | 28.8 | 1.15 |
| 27 | 74.4 | 6.78 | 45.2 | 0.827 | 0.913 | 0.913 | 0.904 | 63.5 | 47.7 | 1.19 |
| 28 | 56.2 | 5.99 | 45.1 | 0.805 | 0.903 | 0.91 | 0.893 | 44.5 | 31 | 1.23 |
| 29 | 61.6 | 6.62 | 43 | 0.841 | 0.92 | 0.918 | 0.915 | 56.6 | 40 | 1.25 |
| 30 | 71.4 | 7.42 | 45.6 | 0.788 | 0.923 | 0.93 | 0.854 | 60 | 38.4 | 1.24 |
| 31 | 68.6 | 6.98 | 44.8 | 0.765 | 0.893 | 0.911 | 0.863 | 45.5 | 32.1 | 1.32 |
| 32 | 56.4 | 6.19 | 45.3 | 0.803 | 0.913 | 0.916 | 0.885 | 58.2 | 32.7 | 1.22 |
| 33 | 67.8 | 7.02 | 46.5 | 0.806 | 0.907 | 0.904 | 0.898 | 70.6 | 32.8 | 1.18 |
| 34 | 71.5 | 7.18 | 44 | 0.821 | 0.911 | 0.912 | 0.905 | 70.1 | 51.5 | 1.18 |
| 35 | 78.9 | 7 | 45.1 | 0.814 | 0.904 | 0.905 | 0.91 | 54 | 35.7 | 1.22 |
| 36 | 67 | 7.39 | 45.1 | 0.818 | 0.903 | 0.909 | 0.902 | 59.9 | 38.3 | 1.25 |
| 37 | 74.1 | 7.35 | 43.1 | 0.817 | 0.913 | 0.905 | 0.899 | 52.6 | 42.4 | 1.22 |

Table 22: Provided are the values of each of the parameters (as described above) measured in *Sorghum* accessions (Seed ID) under normal conditions. Growth conditions are specified in the experimental procedure section.

TABLE 23

Measured parameters in *Sorghum* accessions under Low nitrogen conditions

| Seed ID | Corr. ID | | | | | | | | | | |
|---|---|---|---|---|---|---|---|---|---|---|---|
| | 1 | 3 | 6 | 9 | 12 | 14 | 17 | 20 | 23 | 26 | 29 |
| 20 | 0.677 | 6.02 | 5.34 | 0.105 | 104 | 388 | 215 | 0.505 | 205 | 96.2 | 23.2 |
| 21 | 0.784 | 5.91 | 5.12 | 0.111 | 80.9 | 429 | 205 | 0.506 | 200 | 215 | 25.6 |
| 22 | 0.458 | 8.5 | 8.04 | 0.136 | 205 | 298 | 73.5 | 0.166 | 341 | 98.6 | 20.9 |
| 24 | 0.871 | 6.75 | 5.88 | 0.121 | 125 | 280 | 123 | 0.391 | 241 | 183 | 28.4 |
| 25 | 0.584 | 13.1 | 12.5 | 0.141 | 225 | 208 | 153 | 0.21 | 538 | 120 | 24.3 |
| 26 | 0.557 | 9.57 | 9.02 | 0.134 | 208 | 304 | 93.2 | 0.192 | 359 | 110 | 22.6 |
| 27 | 1.17 | 4.67 | 3.5 | 0.119 | 121 | 436 | 134 | 0.476 | 149 | 172 | 32.1 |
| 28 | 0.634 | 3.61 | 2.98 | 0.117 | 100 | 376 | 77.4 | 0.375 | 129 | 84.8 | 20.4 |
| 29 | 1.31 | 5.89 | 4.58 | 0.116 | 121 | 475 | 130 | 0.42 | 179 | 156 | 26.7 |
| 30 | 0.862 | 3.77 | 2.91 | 0.129 | 94.5 | 438 | 99.8 | 0.441 | 124 | 137 | 26.3 |

TABLE 23-continued

Measured parameters in *Sorghum* accessions under Low nitrogen conditions

| | Corr. ID | | | | | | | | | | |
|---|---|---|---|---|---|---|---|---|---|---|---|
| Seed ID | 1 | 3 | 6 | 9 | 12 | 14 | 17 | 20 | 23 | 26 | 29 |
| 31 | 0.735 | 3.26 | 2.53 | 0.131 | 110 | 383 | 76.9 | 0.429 | 101 | 138 | 25.4 |
| 32 | 0.607 | 3.61 | 3 | 0.12 | 115 | 375 | 84.2 | 0.387 | 132 | 96.5 | 23.1 |
| 33 | 0.648 | 3.24 | 2.59 | 0.116 | 105 | 425 | 92.2 | 0.438 | 118 | 158 | 27.9 |
| 34 | 1.14 | 5.1 | 3.96 | 0.115 | 174 | 434 | 139 | 0.439 | 177 | 164 | 28.9 |
| 35 | 0.87 | 4.25 | 3.38 | 0.107 | 116 | 409 | 113 | 0.442 | 144 | 138 | 27.6 |
| 36 | 0.91 | 3.81 | 2.9 | 0.121 | 139 | 378 | 95.5 | 0.43 | 127 | 135 | 25.5 |
| 37 | 0.894 | 4.76 | 3.86 | 0.109 | 144 | 432 | 129 | 0.417 | 180 | 166 | 30.3 |

Table 23: Provided are the values of each of the parameters (as described above) measured in *Sorghum* accessions (Seed ID) under low nitrogen conditions. Growth conditions are specified in the experimental procedure section.

TABLE 24

Additional measured parameters in *Sorghum* accessions under low nitrogen growth conditions

| | Corr. ID | | | | | | | | | |
|---|---|---|---|---|---|---|---|---|---|---|
| Seed ID | 32 | 35 | 38 | 40 | 42 | 44 | 46 | 48 | 49 | 54 |
| 20 | 56.3 | 5.26 | 38.3 | 0.815 | 0.91 | 0.901 | 0.901 | 25.9 | 50.3 | 1.18 |
| 21 | 79.2 | 10.4 | 39 | 0.77 | 0.9 | 0.884 | 0.852 | 30.6 | 50.9 | 1.31 |
| 22 | 53.2 | 5.93 | 42.3 | 0.81 | 0.921 | 0.915 | 0.893 | 19.4 | 36.1 | 1.11 |
| 24 | 76.2 | 8.25 | 40.9 | 0.793 | 0.898 | 0.897 | 0.88 | 35.6 | 73.1 | 1.21 |
| 25 | 67.3 | 6.19 | 43.1 | 0.78 | 0.908 | 0.919 | 0.863 | 25.2 | 37.9 | 1.19 |
| 26 | 59.5 | 6.12 | 39.9 | 0.799 | 0.926 | 0.918 | 0.871 | 22.2 | 36.4 | 1.18 |
| 27 | 79.3 | 6.8 | 42.7 | 0.834 | 0.918 | 0.916 | 0.91 | 50 | 71.7 | 1.16 |
| 28 | 51.5 | 5.25 | 43.3 | 0.788 | 0.89 | 0.891 | 0.888 | 27.5 | 35 | 1.23 |
| 29 | 69.9 | 7.52 | 39 | 0.806 | 0.901 | 0.898 | 0.899 | 51.1 | 76.7 | 1.17 |
| 30 | 66.2 | 6.59 | 42.7 | 0.772 | 0.909 | 0.907 | 0.857 | 36.8 | 57.6 | 1.22 |
| 31 | 67.4 | 6.85 | 40.1 | 0.741 | 0.886 | 0.895 | 0.842 | 29.4 | 42.9 | 1.24 |
| 32 | 57.9 | 5.32 | 44 | 0.804 | 0.897 | 0.903 | 0.897 | 26.7 | 36.5 | 1.19 |
| 33 | 70.6 | 7.25 | 45.4 | 0.788 | 0.894 | 0.896 | 0.887 | 29.4 | 68.6 | 1.23 |
| 34 | 73.8 | 7.19 | 44.8 | 0.823 | 0.911 | 0.914 | 0.908 | 51.1 | 71.8 | 1.16 |
| 35 | 66.9 | 6.27 | 42.6 | 0.801 | 0.888 | 0.894 | 0.899 | 37 | 49.3 | 1.34 |
| 36 | 65.4 | 6.57 | 43.8 | 0.809 | 0.892 | 0.896 | 0.902 | 39.9 | 43.9 | 1.21 |
| 37 | 76 | 6.82 | 46.7 | 0.807 | 0.901 | 0.897 | 0.897 | 41.8 | 52.1 | 1.21 |

Table 24: Provided are the values of each of the parameters (as described above) measured in *Sorghum* accessions (Seed ID) under low nitrogen conditions. Growth conditions are specified in the experimental procedure section.

TABLE 25

Measured parameters in *Sorghum* accessions under drought conditions

| | Correlation ID | | | | | | | | | | | | |
|---|---|---|---|---|---|---|---|---|---|---|---|---|---|
| Seed ID | 5 | 8 | 11 | 16 | 19 | 22 | 25 | 28 | 31 | 34 | 37 | 52 | 53 |
| 20 | 5.13 | 0.10 | 89 | 155 | 0.42 | 208 | 83 | 21.6 | 52.8 | 4.83 | 40.6 | 22.1 | 1.31 |
| 21 | 3.38 | 0.12 | 76 | 122 | 0.47 | 138 | 108 | 21.9 | 64.5 | 6.31 | 40.9 | 16.8 | 1.19 |
| 22 | 5.67 | 0.11 | 92 | 131 | 0.42 | 255 | 89 | 21.6 | 56.6 | 5.16 | 45 | 9.19 | 1.29 |
| 24 | 9.51 | 0.09 | 94 | 241 | 0.37 | 402 | 136 | 22.0 | 64.4 | 7.78 | 42.3 | 104 | 1.46 |
| 25 | 5.16 | 0.09 | 151 | 69 | 0.23 | 234 | 91 | 21.0 | 53.2 | 5.28 | 45.2 | 3.24 | 1.21 |
| 26 | 9.66 | 0.11 | 111 | 186 | 0.31 | 392 | 124 | 28.6 | 71.7 | 5.49 | 40.6 | 22 | 1.21 |
| 27 | 1.99 | | 99 | 62 | 0.41 | 89 | 86 | 21.3 | 55.6 | 5.04 | 44.8 | 9.97 | |
| 28 | 1.12 | | 84 | 39 | 0.44 | 51 | 85 | 20.8 | 53.0 | 5.07 | 45.1 | 18.6 | |
| 29 | 2.14 | | 99 | 59 | 0.40 | 87 | 113 | 24.7 | 69.8 | 5.77 | 40.6 | 29.3 | |
| 30 | 2.65 | | 92 | 76 | 0.44 | 120 | 101 | 24.3 | 65.1 | 5.37 | 45.4 | 10.5 | |
| 31 | 0.87 | | 82 | 34 | 0.47 | 37 | 80 | 21.9 | 55.3 | 4.66 | 42.6 | 14.8 | |
| 32 | 1.09 | | 99 | 42 | 0.47 | 48 | 127 | 25.0 | 69.1 | 6.35 | 44.2 | 12.9 | |
| 33 | 0.99 | | 87 | 42 | 0.48 | 44 | 86 | 19.5 | 53.3 | 5.58 | 44.6 | 18.2 | |
| 34 | 5.46 | | 100 | 132 | 0.35 | 232 | 92 | 20.4 | 56.3 | 5.76 | 42.4 | 11.6 | |

TABLE 25-continued

Measured parameters in *Sorghum* accessions under drought conditions

| Seed ID | 5 | 8 | 11 | 16 | 19 | 22 | 25 | 28 | 31 | 34 | 37 | 52 | 53 |
|---|---|---|---|---|---|---|---|---|---|---|---|---|---|
| 35 | 2.68 | | 83 | 61 | 0.35 | 116 | 78 | 16.8 | 49.1 | 5.86 | 43.2 | 18.6 | |
| 36 | 3.05 | | 84 | 44 | 0.23 | 123 | 77 | 18.9 | 51.9 | 5.1 | 40.3 | 16.4 | |
| 37 | 8.40 | | 92 | 185 | 0.33 | 342 | | | | | 40.8 | | |

Table 25: Provided are the values of each of the parameters (as described above) measured in *Sorghum* accessions (Seed ID) under drought conditions. Growth conditions are specified in the experimental procedure section.

TABLE 26

Correlation between the expression level of selected LNU genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LNU316 | 0.7795 | 0.0079 | 10 | F | LNU316 | 0.9108 | 0.0002 | 48 | B |
| LNU316 | 0.7755 | 0.0084 | 29 | H | LNU401 | 0.9089 | 0.0003 | 2 | F |
| LNU316 | 0.7699 | 0.0092 | 9 | E | LNU477 | 0.9069 | 0.0003 | 6 | E |
| LNU316 | 0.7675 | 0.0095 | 44 | H | LNU421 | 0.9065 | 0.0003 | 30 | C |
| LNU316 | 0.7963 | 0.0058 | 22 | G | LNU401 | 0.9035 | 0.0003 | 4 | F |
| LNU316 | 0.7351 | 0.0154 | 30 | J | LNU473 | 0.9005 | 0.0004 | 23 | E |
| LNU316 | 0.7309 | 0.0163 | 42 | H | LNU421 | 0.8970 | 0.0004 | 13 | F |
| LNU319 | 0.7256 | 0.0175 | 20 | H | LNU480 | 0.8965 | 0.0004 | 22 | D |
| LNU319 | 0.7173 | 0.0195 | 35 | H | LNU480 | 0.8961 | 0.0004 | 5 | D |
| LNU324 | 0.8312 | 0.0029 | 6 | E | LNU439 | 0.8943 | 0.0011 | 2 | C |
| LNU324 | 0.8294 | 0.0030 | 3 | E | LNU316 | 0.8906 | 0.0005 | 12 | B |
| LNU324 | 0.8068 | 0.0048 | 5 | D | LNU481 | 0.8898 | 0.0013 | 2 | C |
| LNU324 | 0.7641 | 0.0101 | 13 | F | LNU401 | 0.8894 | 0.0006 | 18 | F |
| LNU324 | 0.8216 | 0.0035 | 16 | D | LNU473 | 0.8853 | 0.0007 | 6 | E |
| LNU324 | 0.7512 | 0.0123 | 20 | E | LNU421 | 0.8825 | 0.0007 | 27 | C |
| LNU324 | 0.8178 | 0.0038 | 22 | D | LNU421 | 0.8823 | 0.0007 | 33 | C |
| LNU324 | 0.8534 | 0.0017 | 23 | E | LNU314 | 0.8822 | 0.0007 | 51 | F |
| LNU324 | 0.7055 | 0.0226 | 51 | F | LNU401 | 0.8811 | 0.0008 | 24 | F |
| LNU346 | 0.7275 | 0.0171 | 6 | B | LNU393 | 0.8811 | 0.0008 | 24 | F |
| LNU346 | 0.7022 | 0.0236 | 3 | B | LNU477 | 0.8785 | 0.0008 | 23 | E |
| LNU346 | 0.7742 | 0.0086 | 5 | D | LNU477 | 0.8784 | 0.0008 | 3 | E |
| LNU346 | 0.8008 | 0.0054 | 20 | B | LNU431 | 0.8763 | 0.0009 | 1 | B |
| LNU346 | 0.7521 | 0.0121 | 13 | F | LNU465 | 0.8756 | 0.0009 | 13 | J |
| LNU346 | 0.8440 | 0.0021 | 16 | D | LNU401 | 0.8713 | 0.0010 | 15 | F |
| LNU346 | 0.7834 | 0.0073 | 17 | B | LNU473 | 0.8666 | 0.0012 | 17 | E |
| LNU346 | 0.7058 | 0.0226 | 14 | E | LNU324 | 0.8647 | 0.0012 | 17 | E |
| LNU346 | 0.7361 | 0.0152 | 20 | H | LNU477 | 0.8608 | 0.0014 | 17 | E |
| LNU346 | 0.7797 | 0.0078 | 22 | D | LNU439 | 0.8595 | 0.0014 | 15 | C |
| LNU346 | 0.7049 | 0.0228 | 23 | E | LNU481 | 0.8579 | 0.0015 | 13 | J |
| LNU346 | 0.7254 | 0.0176 | 26 | E | LNU481 | 0.8566 | 0.0032 | 4 | C |
| LNU346 | 0.7488 | 0.0127 | 51 | F | LNU393 | 0.8557 | 0.0016 | 35 | B |
| LNU346 | 0.7046 | 0.0229 | 32 | E | LNU479 | 0.8544 | 0.0016 | 51 | F |
| LNU347 | 0.7303 | 0.0165 | 11 | A | LNU303 | 0.8543 | 0.0016 | 12 | B |
| LNU347 | 0.8358 | 0.0026 | 30 | C | LNU313 | 0.8538 | 0.0017 | 1 | E |
| LNU347 | 0.8189 | 0.0038 | 10 | F | LNU316 | 0.8484 | 0.0019 | 1 | B |
| LNU347 | 0.8401 | 0.0023 | 12 | B | LNU393 | 0.8335 | 0.0027 | 1 | E |
| LNU347 | 0.7613 | 0.0105 | 9 | E | LNU421 | 0.8292 | 0.0030 | 1 | B |
| LNU347 | 0.7598 | 0.0108 | 33 | C | LNU420 | 0.8292 | 0.0030 | 1 | H |
| LNU347 | 0.7113 | 0.0211 | 50 | C | LNU292 | 0.8235 | 0.0034 | 1 | E |
| LNU347 | 0.7336 | 0.0157 | 51 | C | LNU421 | 0.8106 | 0.0044 | 1 | E |
| LNU377 | 0.7291 | 0.0167 | 13 | J | LNU439 | 0.8095 | 0.0045 | 1 | B |
| LNU379 | 0.7141 | 0.0204 | 9 | E | LNU292 | 0.8478 | 0.0019 | 48 | E |
| LNU381 | 0.7525 | 0.0120 | 1 | B | LNU292 | 0.7539 | 0.0118 | 14 | E |
| LNU381 | 0.7736 | 0.0144 | 2 | C | LNU303 | 0.7108 | 0.0212 | 5 | G |
| LNU381 | 0.7785 | 0.0135 | 4 | C | LNU303 | 0.7450 | 0.0134 | 16 | G |
| LNU381 | 0.7712 | 0.0090 | 12 | B | LNU303 | 0.7079 | 0.0220 | 22 | G |
| LNU381 | 0.7720 | 0.0089 | 37 | D | LNU303 | 0.8385 | 0.0024 | 35 | H |
| LNU381 | 0.7700 | 0.0092 | 48 | B | LNU303 | 0.8195 | 0.0037 | 26 | H |
| LNU381 | 0.7079 | 0.0220 | 55 | F | LNU303 | 0.7418 | 0.0141 | 54 | H |
| LNU387 | 0.7569 | 0.0113 | 6 | E | LNU303 | 0.7122 | 0.0208 | 32 | H |
| LNU387 | 0.7037 | 0.0344 | 2 | C | LNU303 | 0.7290 | 0.0168 | 1 | B |
| LNU387 | 0.7709 | 0.0150 | 4 | C | LNU303 | 0.7531 | 0.0119 | 48 | B |
| LNU387 | 0.7072 | 0.0222 | 3 | E | LNU303 | 0.7299 | 0.0166 | 5 | D |
| LNU387 | 0.7881 | 0.0068 | 17 | E | LNU303 | 0.7970 | 0.0058 | 16 | D |
| LNU387 | 0.7259 | 0.0175 | 54 | B | LNU303 | 0.7340 | 0.0157 | 22 | D |
| LNU387 | 0.7611 | 0.0106 | 18 | F | LNU303 | 0.8268 | 0.0032 | 20 | E |
| LNU387 | 0.7209 | 0.0186 | 24 | F | LNU303 | 0.7030 | 0.0233 | 3 | E |

TABLE 26-continued

Correlation between the expression level of selected LNU genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LNU387 | 0.7100 | 0.0214 | 20 | E | LNU303 | 0.7765 | 0.0082 | 17 | E |
| LNU387 | 0.7037 | 0.0231 | 21 | F | LNU313 | 0.7466 | 0.0131 | 1 | H |
| LNU393 | 0.7575 | 0.0112 | 1 | H | LNU313 | 0.7972 | 0.0057 | 48 | E |
| LNU393 | 0.8155 | 0.0040 | 49 | E | LNU313 | 0.7315 | 0.0162 | 15 | J |
| LNU393 | 0.7837 | 0.0073 | 26 | B | LNU314 | 0.7785 | 0.0080 | 1 | E |
| LNU393 | 0.7392 | 0.0146 | 14 | B | LNU314 | 0.7696 | 0.0092 | 1 | H |
| LNU393 | 0.7501 | 0.0125 | 42 | H | LNU314 | 0.8318 | 0.0028 | 48 | E |
| LNU393 | 0.7266 | 0.0173 | 14 | E | LNU314 | 0.7249 | 0.0177 | 11 | D |
| LNU393 | 0.7456 | 0.0133 | 48 | E | LNU314 | 0.7899 | 0.0066 | 29 | E |
| LNU393 | 0.7301 | 0.0165 | 49 | H | LNU314 | 0.7849 | 0.0072 | 30 | J |
| LNU393 | 0.7909 | 0.0064 | 18 | F | LNU314 | 0.7197 | 0.0189 | 42 | E |
| LNU393 | 0.7242 | 0.0179 | 32 | E | LNU314 | 0.7117 | 0.0210 | 48 | H |
| LNU393 | 0.7182 | 0.0193 | 44 | H | LNU314 | 0.7235 | 0.0180 | 51 | J |
| LNU393 | 0.7180 | 0.0194 | 30 | C | LNU316 | 0.7780 | 0.0081 | 5 | G |
| LNU434 | 0.8400 | 0.0046 | 2 | C | LNU434 | 0.8500 | 0.0040 | 4 | C |

Table 26:
"Corr. Set ID"—correlation set ID according to the correlated parameters Table above.

Example 8

Production of *Sorghum* Transcriptom and High Throughput Correlation Analysis with Yield, NUE, and ABST Related Parameters Measured in Semi-Hydroponics Conditions Using 44K *Sorghum* Oligonucleotide Micro-Arrays

*Sorghum* Vigor Related Parameters Under Low Nitrogen, 100 mM NaCl, Low Temperature (10±2° C.) and Normal Growth Conditions—

Ten *Sorghum* hybrids were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.2 mM N) or at Normal growth solution (Full Hoagland containing 16 mM N solution, at 28±2° C.). Plants were grown at 28±2° C.

Full Hoagland solution consists of: $KNO_3$-0.808 grams/liter, $MgSO_4$-0.12 grams/liter, $KH_2PO_4$-0.172 grams/liter and 0.01% (volume/volume) of 'Super coratin' micro elements (Iron-EDDHA [ethylenediamine-N,N'-bis(2-hydroxyphenylacetic acid)]-40.5 grams/liter; Mn-20.2 grams/liter; Zn 10.1 grams/liter; Co 1.5 grams/liter; and Mo 1.1 grams/liter), solution's pH should be 6.5-6.8].

Analyzed *Sorghum* Tissues—

All 10 selected *Sorghum* hybrids were sampled per each treatment. Three tissues [leaves, meristems and roots] growing at 100 mM NaCl, low temperature (10±2° C.), low Nitrogen (1.2 mM N) or under Normal conditions were sampled and RNA was extracted as described above. Each micro-array expression information tissue type has received a Set ID as summarized in Table 27 below.

TABLE 27

Sorghum transcriptom expression sets under semi hydroponics conditions

| Expression set | Set Id |
|---|---|
| Sorghum roots under Low Nitrogen | A |
| Sorghum leaves under Low Nitrogen | B |
| Sorghum meristems under Low Nitrogen | C |
| Sorghum roots under Normal Growth | D |
| Sorghum leaves under Normal Growth | E |
| Sorghum meristems under Normal Growth | F |
| Sorghum roots under 100 mM NaCl | G |
| Sorghum leaves under 100 mM NaCl | H |
| Sorghum meristems under 100 mM NaCl | I |
| Sorghum roots under cold | J |
| Sorghum leaves under cold | K |
| Sorghum meristems under cold | L |

Table 27
Provided are the Sorghum transcriptom expression sets.
Cold conditions = 10 ± 2° C.;
NaCl = 100 mM NaCl;
low nitrogen = 1.2 mM Nitrogen;
Normal conditions = 16 mM Nitrogen.

Experimental Results 10 different *Sorghum* hybrids were grown and characterized for various biomass and nitrogen use efficiency (NUE) parameters as described in Table 28, below. The average for each of the measured parameter was calculated using the JMP software and values are summarized in Table 28-32 below. Subsequent correlation analysis was performed (Table 33). Results were then integrated to the database.

TABLE 28

Sorghum correlated parameters (vectors)

| Correlation set | Correlation ID |
|---|---|
| DW Root/Plant—100 mM NaCl | 1 |
| DW Root/Plant—Cold | 2 |

TABLE 28-continued

| Sorghum correlated parameters (vectors) | |
|---|---|
| Correlation set | Correlation ID |
| DW Root/Plant—Low Nitrogen | 3 |
| DW Root/Plant—Normal | 4 |
| DW Shoot/Plant—100 mM NaCl | 5 |
| DW Shoot/Plant—Cold | 6 |
| DW Shoot/Plant—Low Nitrogen | 7 |
| DW Shoot/Plant—Normal | 8 |
| Leaf Number TP1—100 mM NaCl | 9 |
| Leaf Number TP1—Cold | 10 |
| Leaf Number TP1—Low Nitrogen | 11 |
| Leaf Number TP1—Normal | 12 |
| Leaf Number TP2—100 mM NaCl | 13 |
| Leaf Number TP2—Cold | 14 |
| Leaf Number TP2—Low Nitrogen | 15 |
| Leaf Number TP2—Normal | 16 |
| Leaf Number TP3—100 mM NaCl | 17 |
| Leaf Number TP3—Cold | 18 |
| Leaf Number TP3—Low Nitrogen | 19 |
| Leaf Number TP3—Normal | 20 |
| Shoot/Root—Normal | 21 |
| NUE per roots—Normal | 22 |
| NUE per shoots—Normal | 23 |
| NUE per total biomass—Normal | 24 |
| NUE per roots biomass—Low N | 25 |
| NUE per shoots biomass—Low N | 26 |
| NUE per total biomass—Low N | 27 |
| Percent of reduction of root biomass compared to normal—Low N | 28 |
| Percent of reduction of shoot biomass compared to normal—Low N | 29 |
| Percent of reduction of total biomass compared to normal—Low N | 30 |
| Plant Height TP1—100 mM NaCl | 31 |
| Plant Height TP1—Cold | 32 |
| Plant Height TP1—Low N | 33 |
| Plant Height TP1—Normal | 34 |
| Plant Height TP2—100 mM NaCl | 35 |
| Plant Height TP2—Cold | 36 |
| Plant Height TP2—Low N | 37 |
| Plant Height TP2—Normal | 38 |
| Plant Height TP3—100 mM NaCl | 39 |
| Plant Height TP3—Low N | 40 |
| RGR Leaf Num Normal | 41 |
| Root Biomass DW [gr.]/SPAD—100 mM NaCl | 42 |
| Root Biomass DW [gr.]/SPAD—Cold | 43 |
| Root Biomass DW [gr.]/SPAD—Low N | 44 |
| Root Biomass DW [gr.]/SPAD—Normal | 45 |
| Shoot Biomass DW [gr.]/SPAD—100 mM NaCl | 46 |
| Shoot Biomass DW [gr.]/SPAD—Cold | 47 |
| Shoot Biomass DW [gr.]/SPAD—Low N | 48 |
| Shoot Biomass DW [gr]/SPAD—Normal | 49 |
| Shoot/Root—Low N | 50 |
| SPAD—100 mM NaCl | 51 |
| SPAD—Cold | 52 |
| SPAD—Low Nitrogen | 53 |
| SPAD—Normal | 54 |
| SPAD 100—mM NaCl | 55 |
| Total Biomass DW [gr.]/SPAD—100 mM NaCl | 56 |
| Total Biomass DW [gr.]/SPAD—Cold | 57 |
| Total Biomass DW [gr.]/SPAD—Low N | 58 |
| Total Biomass DW [gr.]/SPAD—Normal | 59 |

Table 28

Provided are the Sorghum correlated parameters.

Cold conditions = 10 ± 2° C.;

NaCl = 100 mM NaCl;

Low nitrogen = 1.2 mM Nitrogen;

Normal conditions = 16 mM Nitrogen

*TP-1-2-3 refers to time points 1, 2 and 3.

TABLE 29

*Sorghum* accessions, measured parameters under low nitrogen growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 3 | 0.04 | 0.11 | 0.20 | 0.10 | 0.08 | 0.09 | 0.13 | 0.09 | 0.09 | 0.09 |
| 7 | 0.08 | 0.19 | 0.33 | 0.16 | 0.16 | 0.16 | 0.26 | 0.20 | 0.13 | 0.18 |
| 11 | 3.0 | 3.1 | 3.9 | 3.5 | 3.2 | 3.1 | 3.1 | 3.3 | 3.1 | 3.1 |
| 15 | 4.0 | 4.6 | 5.0 | 4.7 | 4.6 | 4.7 | 5.0 | 4.9 | 4.7 | 4.6 |
| 19 | 3.9 | 4.3 | 4.7 | 4.2 | 4.3 | 4.6 | 4.6 | 4.7 | 4.0 | 4.1 |
| 27 | 27.5 | 64.1 | 115.0 | 58.0 | 52.2 | 35.1 | 84.6 | 63.7 | 47.0 | 60.0 |
| 50 | 1.9 | 1.7 | 1.7 | 1.6 | 2.1 | 1.8 | 2.1 | 2.1 | 1.5 | 2.0 |
| 25 | 9.7 | 23.5 | 43.9 | 22.6 | 16.9 | 12.4 | 28.2 | 20.5 | 18.8 | 20.1 |
| 26 | 17.9 | 40.6 | 71.4 | 35.4 | 35.3 | 22.7 | 56.4 | 43.2 | 28.3 | 39.9 |
| 28 | 84.5 | 81.0 | 117.0 | 101.0 | 72.5 | 71.8 | 93.5 | 76.1 | 86.8 | 80.5 |
| 29 | 81.6 | 79.2 | 105.0 | 103.0 | 83.7 | 83.2 | 108.0 | 81.4 | 70.3 | 75.9 |
| 30 | 82.6 | 79.8 | 109.0 | 102.0 | 79.7 | 78.8 | 102.0 | 79.6 | 76.1 | 77.4 |
| 53 | 6.89 | 6.57 | 6.31 | 7.45 | 6.89 | 5.87 | 6.15 | 6.05 | 7.68 | 6.74 |
| 33 | 6.73 | 9.77 | 12.70 | 8.67 | 9.77 | 9.23 | 10.30 | 10.10 | 7.93 | 8.23 |
| 37 | 13.3 | 20.6 | 23.7 | 18.0 | 19.3 | 19.2 | 21.9 | 22.1 | 18.2 | 21.0 |
| 40 | 22.2 | 31.1 | 34.7 | 30.0 | 30.8 | 29.9 | 30.9 | 32.4 | 29.4 | 30.7 |
| 44 | 0.002 | 0.004 | 0.007 | 0.003 | 0.003 | 0.003 | 0.005 | 0.003 | 0.003 | 0.003 |
| 48 | 0.003 | 0.007 | 0.011 | 0.005 | 0.005 | 0.006 | 0.009 | 0.007 | 0.004 | 0.007 |
| 53 | 26.9 | 28.0 | 29.6 | 31.5 | 29.6 | 26.8 | 28.5 | 28.2 | 30.5 | 27.6 |
| 58 | 0.005 | 0.011 | 0.018 | 0.008 | 0.008 | 0.009 | 0.014 | 0.010 | 0.007 | 0.010 |

Table 29: Provided are the values of each of the parameters (as described above) measured in *Sorghum* accessions (Seed ID) under low nitrogen conditions. Growth conditions are specified in the experimental procedure section.

TABLE 30

*Sorghum* accessions, measured parameters under 100 mM NaCl growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 1 | 0.05 | 0.10 | 0.12 | 0.07 | 0.08 | 0.08 | 0.14 | 0.10 | 0.17 | 0.14 |
| 5 | 0.09 | 0.19 | 0.20 | 0.14 | 0.13 | 0.13 | 0.15 | 0.19 | 0.10 | 0.12 |
| 9 | 3.0 | 3.1 | 3.4 | 3.1 | 3.3 | 3.1 | 3.1 | 3.3 | 3.0 | 3.1 |
| 13 | 4.0 | 4.4 | 4.9 | 4.6 | 4.5 | 4.5 | 4.5 | 4.8 | 4.3 | 4.2 |
| 17 | 4.0 | 4.1 | 4.6 | 4.4 | 4.1 | 4.3 | 4.1 | 4.5 | 3.8 | 4.2 |
| 51 | 8.2 | 8.5 | 6.1 | 7.0 | 8.5 | 6.9 | 7.8 | 7.1 | 8.6 | 8.2 |
| 31 | 7.9 | 9.5 | 10.9 | 7.9 | 9.7 | 8.5 | 8.9 | 10.4 | 7.0 | 7.8 |
| 35 | 14.2 | 16.3 | 20.4 | 13.3 | 15.9 | 16.5 | 15.5 | 18.9 | 13.7 | 15.8 |
| 39 | 21.8 | 23.2 | 30.4 | 22.8 | 23.7 | 23.3 | 22.5 | 26.8 | 20.3 | 23.6 |
| 42 | 0.002 | 0.003 | 0.004 | 0.002 | 0.002 | 0.003 | 0.004 | 0.003 | 0.005 | 0.004 |
| 46 | 0.003 | 0.005 | 0.007 | 0.004 | 0.004 | 0.004 | 0.005 | 0.006 | 0.003 | 0.004 |
| 55 | 32.7 | 35.1 | 28.0 | 30.9 | 34.5 | 30.0 | 32.1 | 31.9 | 32.5 | 34.3 |
| 56 | 0.004 | 0.008 | 0.012 | 0.007 | 0.006 | 0.007 | 0.009 | 0.009 | 0.008 | 0.008 |

Table 30: Provided are the values of each of the parameters (as described above) measured in *Sorghum* accessions (Seed ID) under 100 mM NaCl growth conditions. Growth conditions are specified in the experimental procedure section.

TABLE 31

*Sorghum* accessions, measured parameters under cold growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 2 | 0.068 | 0.108 | 0.163 | 0.094 | 0.084 | 0.114 | 0.137 | 0.127 | 0.108 | 0.139 |
| 6 | 0.078 | 0.154 | 0.189 | 0.112 | 0.130 | 0.165 | 0.152 | 0.150 | 0.112 | 0.141 |
| 10 | 3.0 | 3.0 | 3.5 | 3.2 | 3.4 | 3.2 | 3.1 | 3.1 | 3.1 | 3.0 |
| 14 | 3.9 | 4.1 | 4.6 | 4.2 | 4.3 | 4.2 | 4.2 | 4.3 | 4.2 | 4.0 |
| 18 | 4.7 | 5.3 | 5.4 | 5.5 | 5.3 | 5.1 | 4.5 | 5.4 | 5.4 | 5.2 |
| 52 | 6.1 | 5.7 | 5.0 | 5.9 | 5.3 | 5.9 | 7.2 | 5.3 | 5.9 | 5.7 |
| 32 | 6.5 | 8.8 | 10.4 | 6.8 | 9.0 | 9.0 | 8.0 | 9.2 | 6.5 | 7.2 |
| 36 | 11.2 | 15.9 | 18.4 | 12.2 | 16.0 | 14.6 | 14.6 | 17.3 | 13.4 | 13.9 |
| 43 | 0.002 | 0.004 | 0.006 | 0.003 | 0.003 | 0.004 | 0.004 | 0.004 | 0.003 | 0.005 |
| 47 | 0.003 | 0.005 | 0.007 | 0.003 | 0.005 | 0.006 | 0.005 | 0.005 | 0.004 | 0.005 |

TABLE 31-continued

Sorghum accessions, measured parameters under cold growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 52 | 28.6 | 30.3 | 27.0 | 32.3 | 28.3 | 29.9 | 32.5 | 28.6 | 31.7 | 29.6 |
| 57 | 0.005 | 0.009 | 0.013 | 0.006 | 0.008 | 0.009 | 0.009 | 0.010 | 0.007 | 0.009 |

Table 31: Provided are the values of each of the parameters (as described above) measured in Sorghum accessions (Seed ID) under cold growth conditions. Growth conditions are specified in the experimental procedure section.

TABLE 32

Sorghum accessions, measured parameters under regular growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 4 | 0.05 | 0.13 | 0.17 | 0.10 | 0.11 | 0.12 | 0.14 | 0.12 | 0.10 | 0.12 |
| 8 | 0.10 | 0.24 | 0.31 | 0.16 | 0.19 | 0.19 | 0.24 | 0.24 | 0.19 | 0.24 |
| 12 | 3.0 | 3.1 | 3.8 | 3.2 | 3.2 | 3.2 | 3.1 | 3.4 | 3.0 | 3.0 |
| 16 | 4.2 | 4.5 | 4.8 | 4.6 | 4.5 | 5.0 | 4.6 | 4.9 | 4.5 | 4.6 |
| 20 | 5.3 | 5.9 | 6.2 | 5.8 | 5.8 | 5.7 | 5.7 | 6.0 | 5.6 | 6.1 |
| 54 | 5.0 | 5.0 | 4.8 | 5.0 | 4.3 | 4.3 | 5.4 | 4.3 | 5.9 | 5.5 |
| 21 | 2.0 | 1.9 | 1.9 | 1.6 | 1.8 | 1.6 | 1.8 | 2.0 | 1.9 | 2.2 |
| 22 | 0.9 | 2.2 | 2.8 | 1.7 | 1.8 | 2.0 | 2.3 | 2.0 | 1.1 | 1.9 |
| 23 | 1.7 | 3.9 | 5.1 | 2.6 | 3.2 | 3.1 | 4.0 | 4.0 | 2.0 | 4.0 |
| 24 | 2.5 | 6.1 | 8.0 | 4.3 | 4.9 | 5.0 | 6.2 | 6.0 | 3.1 | 5.9 |
| 34 | 7.5 | 9.3 | 12.9 | 8.6 | 8.9 | 8.5 | 10.7 | 10.3 | 7.9 | 8.8 |
| 38 | 15.0 | 18.2 | 22.1 | 17.6 | 18.1 | 18.5 | 22.8 | 22.0 | 20.0 | 21.8 |
| 41 | 0.16 | 0.19 | 0.16 | 0.17 | 0.17 | 0.17 | 0.17 | 0.17 | 0.17 | 0.20 |
| 45 | 0.002 | 0.005 | 0.006 | 0.004 | 0.004 | 0.005 | 0.005 | 0.005 | 0.003 | 0.003 |
| 49 | 0.004 | 0.008 | 0.011 | 0.005 | 0.008 | 0.008 | 0.008 | 0.010 | 0.006 | 0.007 |
| 54 | 26.7 | 29.3 | 29.9 | 29.1 | 25.0 | 24.6 | 30.8 | 25.5 | 32.9 | 33.5 |
| 59 | 0.006 | 0.013 | 0.016 | 0.009 | 0.012 | 0.013 | 0.012 | 0.014 | 0.009 | 0.011 |

Table 32: Provided are the values of each of the parameters (as described above) measured in Sorghum accessions (Seed ID) under regular growth conditions. Growth conditions are specified in the experimental procedure section.

TABLE 33

Correlation between the expression level of selected LNU genes of some embodiments of the invention in various tissues and the phenotypic performance under low nitrogen, normal, cold or salinity stress conditions across Sorghum accessions

| Gene name | R | P | Exp. set | Corr. ID | Gene name | R | P | Exp. set | Corr. ID |
|---|---|---|---|---|---|---|---|---|---|
| LNU433 | 0.76 | 0.0459 | A | 30 | LNU291 | 0.76 | 0.0183 | I | 1 |
| LNU313 | 0.70 | 0.0340 | C | 53 | LNU479 | 0.76 | 0.0166 | I | 1 |
| LNU480 | 0.72 | 0.0299 | I | 51 | LNU401 | 0.74 | 0.0239 | I | 1 |
| LNU396 | 0.71 | 0.0327 | L | 52 | LNU393 | 0.72 | 0.0271 | I | 1 |
| LNU465 | 0.76 | 0.0105 | J | 52 | LNU422 | 0.78 | 0.0123 | I | 1 |
| LNU316 | 0.75 | 0.0122 | J | 52 | LNU346 | 0.81 | 0.0082 | I | 1 |
| LNU432 | 0.75 | 0.0191 | F | 54 | LNU393 | 0.71 | 0.0312 | L | 2 |
| LNU477 | 0.78 | 0.0141 | D | 54 | LNU422 | 0.71 | 0.0308 | L | 2 |
| LNU432 | 0.72 | 0.0284 | D | 54 | LNU481 | 0.79 | 0.0070 | J | 2 |
| LNU480 | 0.78 | 0.0134 | L | 32 | LNU291 | 0.75 | 0.0197 | C | 3 |
| LNU473 | 0.80 | 0.0091 | L | 32 | LNU479 | 0.92 | 0.0004 | C | 3 |
| LNU393 | 0.75 | 0.0194 | L | 32 | LNU491 | 0.86 | 0.0029 | C | 3 |
| LNU422 | 0.83 | 0.0057 | L | 32 | LNU393 | 0.82 | 0.0066 | C | 3 |
| LNU501 | 0.72 | 0.0289 | L | 32 | LNU422 | 0.91 | 0.0007 | C | 3 |
| LNU479 | 0.82 | 0.0065 | C | 33 | LNU346 | 0.81 | 0.0081 | C | 3 |
| LNU491 | 0.86 | 0.0030 | C | 33 | LNU431 | 0.84 | 0.0050 | C | 3 |
| LNU422 | 0.78 | 0.0131 | C | 33 | LNU481 | 0.81 | 0.0265 | A | 3 |
| LNU431 | 0.86 | 0.0027 | C | 33 | LNU291 | 0.74 | 0.0236 | C | 7 |
| LNU439 | 0.74 | 0.0232 | F | 34 | LNU479 | 0.91 | 0.0006 | C | 7 |
| LNU479 | 0.73 | 0.0252 | D | 34 | LNU491 | 0.76 | 0.0184 | C | 7 |
| LNU395 | 0.71 | 0.0334 | D | 34 | LNU393 | 0.74 | 0.0222 | C | 7 |
| LNU422 | 0.74 | 0.0215 | D | 34 | LNU422 | 0.82 | 0.0068 | C | 7 |
| LNU431 | 0.77 | 0.0162 | D | 34 | LNU346 | 0.74 | 0.0219 | C | 7 |
| LNU480 | 0.79 | 0.0117 | L | 36 | LNU431 | 0.92 | 0.0005 | C | 7 |
| LNU387 | 0.74 | 0.0223 | L | 36 | LNU473 | 0.77 | 0.0434 | A | 7 |
| LNU473 | 0.72 | 0.0303 | L | 36 | LNU291 | 0.73 | 0.0270 | L | 6 |

TABLE 33-continued

Correlation between the expression level of selected LNU genes of some embodiments of the invention in various tissues and the phenotypic performance under low nitrogen, normal, cold or salinity stress conditions across *Sorghum* accessions

| Gene name | R | P | Exp. set | Corr. ID | Gene name | R | P | Exp. set | Corr. ID |
|---|---|---|---|---|---|---|---|---|---|
| LNU393 | 0.73 | 0.0261 | L | 36 | LNU480 | 0.71 | 0.0326 | L | 6 |
| LNU422 | 0.83 | 0.0056 | L | 36 | LNU393 | 0.79 | 0.0110 | L | 6 |
| LNU479 | 0.81 | 0.0087 | C | 37 | LNU422 | 0.85 | 0.0034 | L | 6 |
| LNU422 | 0.71 | 0.0329 | C | 37 | LNU473 | 0.73 | 0.0248 | L | 10 |
| LNU431 | 0.80 | 0.0094 | C | 37 | LNU393 | 0.73 | 0.0259 | L | 10 |
| LNU473 | 0.78 | 0.0378 | A | 37 | LNU433 | 0.79 | 0.0113 | L | 10 |
| LNU397 | 0.76 | 0.0184 | F | 38 | LNU291 | 0.76 | 0.0168 | C | 11 |
| LNU346 | 0.72 | 0.0275 | D | 38 | LNU479 | 0.82 | 0.0073 | C | 11 |
| LNU397 | 0.71 | 0.0308 | I | 39 | LNU491 | 0.84 | 0.0050 | C | 11 |
| LNU291 | 0.75 | 0.0192 | C | 40 | LNU477 | 0.77 | 0.0448 | A | 11 |
| LNU479 | 0.83 | 0.0053 | C | 40 | LNU393 | 0.90 | 0.0059 | A | 11 |
| LNU491 | 0.80 | 0.0094 | C | 40 | LNU291 | 0.73 | 0.0265 | F | 12 |
| LNU422 | 0.75 | 0.0211 | C | 40 | LNU291 | 0.83 | 0.0054 | D | 12 |
| LNU431 | 0.73 | 0.0241 | C | 40 | LNU395 | 0.75 | 0.0210 | D | 12 |
| LNU422 | 0.78 | 0.0366 | A | 40 | LNU431 | 0.80 | 0.0089 | D | 12 |
| LNU291 | 0.73 | 0.0248 | I | 42 | LNU291 | 0.85 | 0.0041 | L | 14 |
| LNU479 | 0.78 | 0.0130 | I | 42 | LNU480 | 0.91 | 0.0007 | L | 14 |
| LNU401 | 0.72 | 0.0298 | I | 42 | LNU473 | 0.87 | 0.0025 | L | 14 |
| LNU422 | 0.71 | 0.0331 | I | 42 | LNU393 | 0.92 | 0.0005 | L | 14 |
| LNU346 | 0.81 | 0.0075 | I | 42 | LNU422 | 0.89 | 0.0012 | L | 14 |
| LNU291 | 0.76 | 0.0170 | L | 43 | LNU491 | 0.74 | 0.0150 | J | 14 |
| LNU393 | 0.78 | 0.0127 | L | 43 | LNU291 | 0.73 | 0.0264 | C | 15 |
| LNU422 | 0.78 | 0.0128 | L | 43 | LNU479 | 0.80 | 0.0091 | C | 15 |
| LNU491 | 0.75 | 0.0124 | J | 43 | LNU431 | 0.75 | 0.0199 | C | 15 |
| LNU481 | 0.81 | 0.0043 | J | 43 | LNU422 | 0.89 | 0.0080 | A | 15 |
| LNU291 | 0.72 | 0.0293 | C | 44 | LNU480 | 0.72 | 0.0293 | L | 18 |
| LNU479 | 0.90 | 0.0009 | C | 44 | LNU479 | 0.77 | 0.0143 | C | 19 |
| LNU491 | 0.84 | 0.0047 | C | 44 | LNU431 | 0.80 | 0.0092 | C | 19 |
| LNU393 | 0.83 | 0.0061 | C | 44 | LNU441 | 0.79 | 0.0326 | A | 19 |
| LNU422 | 0.90 | 0.0009 | C | 44 | LNU291 | 0.75 | 0.0204 | C | 27 |
| LNU346 | 0.80 | 0.0103 | C | 44 | LNU479 | 0.82 | 0.0067 | C | 27 |
| LNU431 | 0.85 | 0.0039 | C | 44 | LNU491 | 0.81 | 0.0088 | C | 27 |
| LNU481 | 0.76 | 0.0485 | A | 44 | LNU393 | 0.78 | 0.0129 | C | 27 |
| LNU291 | 0.79 | 0.0117 | L | 47 | LNU422 | 0.86 | 0.0027 | C | 27 |
| LNU480 | 0.71 | 0.0310 | L | 47 | LNU346 | 0.78 | 0.0137 | C | 27 |
| LNU393 | 0.83 | 0.0057 | L | 47 | LNU431 | 0.90 | 0.0010 | C | 27 |
| LNU422 | 0.89 | 0.0013 | L | 47 | LNU387 | 0.90 | 0.0060 | A | 27 |
| LNU479 | 0.87 | 0.0021 | C | 48 | LNU473 | 0.81 | 0.0275 | A | 27 |
| LNU491 | 0.71 | 0.0317 | C | 48 | LNU495 | 0.84 | 0.0181 | A | 50 |
| LNU393 | 0.72 | 0.0272 | C | 48 | LNU501 | 0.79 | 0.0337 | A | 50 |
| LNU422 | 0.79 | 0.0114 | C | 48 | LNU291 | 0.75 | 0.0197 | C | 25 |
| LNU346 | 0.71 | 0.0314 | C | 48 | LNU479 | 0.92 | 0.0004 | C | 25 |
| LNU431 | 0.91 | 0.0007 | C | 48 | LNU491 | 0.86 | 0.0029 | C | 25 |
| LNU473 | 0.78 | 0.0391 | A | 48 | LNU393 | 0.82 | 0.0066 | C | 25 |
| LNU396 | 0.85 | 0.0039 | L | 52 | LNU422 | 0.91 | 0.0007 | C | 25 |
| LNU316 | 0.87 | 0.0024 | L | 52 | LNU346 | 0.81 | 0.0081 | C | 25 |
| LNU396 | 0.79 | 0.0063 | J | 52 | LNU431 | 0.84 | 0.0050 | C | 25 |
| LNU316 | 0.89 | 0.0006 | J | 52 | LNU313 | 0.80 | 0.0306 | A | 25 |
| LNU477 | 0.70 | 0.0354 | C | 53 | LNU481 | 0.84 | 0.0170 | A | 25 |
| LNU479 | 0.81 | 0.0257 | A | 53 | LNU387 | 0.84 | 0.0167 | A | 25 |
| LNU415 | 0.83 | 0.0223 | A | 53 | LNU421 | 0.76 | 0.0465 | A | 25 |
| LNU393 | 0.86 | 0.0139 | A | 53 | LNU314 | 0.76 | 0.0471 | A | 25 |
| LNU324 | 0.78 | 0.0373 | A | 53 | LNU291 | 0.74 | 0.0236 | C | 26 |
| LNU346 | 0.78 | 0.0401 | A | 53 | LNU479 | 0.91 | 0.0006 | C | 26 |
| LNU473 | 0.76 | 0.0173 | I | 51 | LNU491 | 0.76 | 0.0184 | C | 26 |
| LNU479 | 0.82 | 0.0065 | I | 56 | LNU393 | 0.74 | 0.0222 | C | 26 |
| LNU397 | 0.73 | 0.0262 | I | 56 | LNU422 | 0.82 | 0.0068 | C | 26 |
| LNU291 | 0.80 | 0.0100 | L | 57 | LNU346 | 0.74 | 0.0219 | C | 26 |
| LNU393 | 0.83 | 0.0057 | L | 57 | LNU431 | 0.92 | 0.0005 | C | 26 |
| LNU422 | 0.86 | 0.0027 | L | 57 | LNU387 | 0.90 | 0.0063 | A | 26 |
| LNU491 | 0.74 | 0.0150 | J | 57 | LNU473 | 0.85 | 0.0165 | A | 26 |
| LNU481 | 0.73 | 0.0161 | J | 57 | LNU479 | 0.79 | 0.0106 | C | 28 |
| LNU291 | 0.71 | 0.0312 | C | 58 | LNU393 | 0.74 | 0.0224 | C | 28 |
| LNU479 | 0.90 | 0.0011 | C | 58 | LNU346 | 0.74 | 0.0234 | C | 28 |
| LNU491 | 0.77 | 0.0156 | C | 58 | LNU313 | 0.82 | 0.0238 | A | 28 |
| LNU393 | 0.77 | 0.0148 | C | 58 | LNU291 | 0.73 | 0.0263 | C | 29 |
| LNU422 | 0.84 | 0.0045 | C | 58 | LNU479 | 0.75 | 0.0192 | C | 29 |
| LNU346 | 0.75 | 0.0193 | C | 58 | LNU291 | 0.76 | 0.0170 | C | 30 |

TABLE 33-continued

Correlation between the expression level of selected LNU genes of some embodiments of the invention in various tissues and the phenotypic performance under low nitrogen, normal, cold or salinity stress conditions across *Sorghum* accessions

| Gene name | R | P | Exp. set | Corr. ID | Gene name | R | P | Exp. set | Corr. ID |
|---|---|---|---|---|---|---|---|---|---|
| LNU431 | 0.90 | 0.0010 | C | 58 | LNU479 | 0.82 | 0.0068 | C | 30 |
| LNU473 | 0.76 | 0.0458 | A | 58 | LNU346 | 0.72 | 0.0285 | C | 30 |

Table 33.
"Corr. Set ID"—correlation set ID according to the correlated parameters Table above.
"Exp. Set" = Expression set.

Example 9

Production of Maize Transcriptom and High Throughput Correlation Analysis with Yield and NUE Related Parameters Using 44K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with NUE and yield components or vigor related parameters, the 12 different maize hybrids were analyzed. Among them, 10 hybrids encompassing the observed variance were selected for RNA expression analysis. The correlation between the RNA levels and the HI characterized parameters was analyzed using Pearson correlation test [Hypertext Transfer Protocol://World Wide Web (dot) davidmlane (dot) com/hyperstat/A34739 (dot) html].

Analyzed Maize Tissues—

All 10 selected maize hybrids were sample per each treatment. Five types of plant tissues [flag leaf indicated in Table 34 as leaf, flower meristem, grain, Ear, and internode] growing under Normal conditions were sampled and RNA was extracted as described above. Each micro-array expression information tissue type has received a Set ID as summarized in Table 34 below.

TABLE 34

| Maize transcriptom expression sets | |
|---|---|
| Expression Set | Set ID |
| Maize field/Normal/flower meristem | A |
| Maize field/Normal/Ear | B |
| Maize field/Normal/Grain Distal | C |
| Maize field/Normal/Grain Basal | D |

TABLE 34-continued

| Maize transcriptom expression sets | |
|---|---|
| Expression Set | Set ID |
| Maize field/Normal/Internode | E |
| Maize field/Normal/Leaf | F |

Table 34
Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected using digital imaging system:

Grain Area ($cm^2$)—

At the end of the growing period the grains were separated from the ear. A sample of ~200 grains were weight, photographed and images were processed using the below described image processing system. The grain area was measured from those images and was divided by the number of grains.

Grain Length and Grain Width (cm)—

At the end of the growing period the grains were separated from the ear. A sample of ~200 grains were weight, photographed and images were processed using the below described image processing system. The sum of grain lengths/or width (longest axis) was measured from those images and was divided by the number of grains.

Ear Area ($cm^2$)—

At the end of the growing period 5 ears were, photographed and images were processed using the below described image processing system. The Ear area was measured from those images and was divided by the number of Ears.

Ear Length and Ear Width (cm)

At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight Per Plant (gr.)—

At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—

At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—

Plants were characterized for height at harvesting. In each measure, 6 plants were measured for their height using a measuring tape. Height was measured from ground level to top of the plant below the tassel. Ear height was measured from the ground level to the place were the main ear is located Leaf Number Per Plant—

Plants were characterized for leaf number during growing period at 5 time points. In each measure, plants were measured for their leaf number by counting all the leaves of 3 selected plants per plot.

Relative Growth Rate

Was calculated using Formulas XI and XII (described above).

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS)

Dry Weight Per Plant—

At the end of the experiment (when Inflorescence were dry) all vegetative material from plots within blocks A-C were collected.

Dry weight=total weight of the vegetative portion above ground (excluding roots) after drying at 70° C. in oven for 48 hours;

Harvest Index (HI) (Maize)—

The harvest index was calculated using Formula XIV.

Harvest Index=Average grain dry weight per Ear/ (Average vegetative dry weight per Ear+Average Ear dry weight)    Formula XIV Percent Filled Ear [%]—

It was calculated as the percentage of the Ear area with grains out of the total ear.

Cob Diameter [cm]—

The diameter of the cob without grains was measured using a ruler.

Kernel Row Number Per Ear—

The number of rows in each ear was counted.

Experimental Results 12 different maize hybrids were grown and characterized for different parameters: The average for each of the measured parameter was calculated using the JMP software (Tables 35-37) and a subsequent correlation analysis was performed (Tables 38-39). Results were then integrated to the database.

TABLE 35

Maize correlated parameters (vectors)

| Correlation set | Correlation ID |
|---|---|
| SPAD 54DPS [SPAD units] | 1 |
| SPAD 46DPS [SPAD units] | 2 |
| Growth Rate Leaf Num | 3 |
| Plant Height per Plot [cm] | 4 |
| Ear Height [cm] | 5 |
| Leaf Number per Plant [number] | 6 |
| Ear Length [cm] | 7 |
| Percent Filled Ear [%] | 8 |
| Cob Diameter [mm] | 9 |
| Kernel Row Number per Ear [number] | 10 |
| DW per Plant [gr] | 11 |
| Ear FW per Plant [gr] | 12 |
| Normalized Grain Weight per plant [gr] | 13 |
| Ears FW per plot [gr] | 14 |
| Normalized Grain Weight per plot [gr] | 15 |
| Ear Area [cm2] | 16 |
| Ear Width [cm] | 17 |
| Grain Area [cm2] | 18 |
| Grain Length [cm] | 19 |
| Grain Width [cm] | 20 |

Table 35 SPAD 46DPS and SPAD 54DPS: Chlorophyl level after 46 and 54 days after sowing (DPS).

TABLE 36

Measured parameters in Maize accessions under normal conditions

| | Seed ID | | | | | | | | | | |
|---|---|---|---|---|---|---|---|---|---|---|---|
| | 1 | 2 | 3 | 4 | 5 | 6 | 7 | 8 | 9 | 10 | 11 |
| Line 1 | 54.8 | 55.3 | 0.306 | 287 | 135 | 11.9 | 20.9 | 80.4 | 28.7 | 16.2 | 656 |
| Line 2 | 54.3 | 51.7 | 0.283 | 278 | 135 | 12 | 19.7 | 80.6 | 29 | 16.2 | 658 |
| Line 3 | 57.2 | 56.4 | 0.221 | 270 | 116 | 8.4 | 19.1 | 94.3 | 23.8 | 15 | 472 |
| Line 4 | 56 | 53.5 | 0.281 | 275 | 132 | 11.7 | 20.5 | 82.1 | 28.1 | 16.2 | 641 |
| Line 5 | 59.7 | 55.2 | 0.269 | 238 | 114 | 11.8 | 21.3 | 92.7 | 25.7 | 15.9 | 581 |
| Line 6 | 59.1 | 59.4 | 0.244 | 225 | 94.3 | 12.3 | 18.2 | 82.8 | 25.8 | 15.2 | 569 |
| Line 7 | 58 | 58.5 | 0.244 | 264 | 121 | 12.4 | 19 | 73.2 | 26.4 | 16 | 511 |
| Line 8 | 60.4 | 55.9 | 0.266 | 252 | 108 | 12.2 | 18.6 | 81.1 | 25.2 | 14.8 | 544 |
| Line 9 | 54.8 | 53 | | | | | | | | | |
| Line 10 | 53.3 | 50 | | | | | | | | | |
| Line 11 | 61.1 | 59.7 | 0.301 | 278 | 112 | 12.6 | 21.7 | 91.6 | 26.7 | 15.4 | 522 |
| Line 12 | 51.4 | 53.9 | 0.194 | 164 | 60.4 | 9.28 | 16.7 | 81 | 14.3 | 574 | 141 |

Table 36. Provided are the values of each of the parameters (as described above) measured in maize accessions (Seed ID) under regular growth conditions. Growth conditions are specified in the experimental procedure section.

TABLE 37

Additional measured parameters in Maize accessions under regular growth conditions

| | Seed ID | | | | | | | | |
|---|---|---|---|---|---|---|---|---|---|
| | 12 | 13 | 14 | 15 | 16 | 17 | 18 | 19 | 20 |
| Line 1 | 272 | 157 | 280 | 140 | 91.6 | 5.73 | 0.806 | 1.23 | 0.824 |
| Line 2 | 246 | 141 | 278 | 154 | 85.1 | 5.58 | 0.753 | 1.17 | 0.81 |
| Line 3 | 190 | 129 | 190 | 121 | 77.9 | 5.1 | 0.674 | 1.07 | 0.794 |
| Line 4 | 262 | 154 | 288 | 152 | 90.5 | 5.67 | 0.755 | 1.18 | 0.803 |
| Line 5 | 264 | 177 | 248 | 159 | 96 | 5.53 | 0.766 | 1.2 | 0.803 |
| Line 6 | 178 | 120 | 176 | 117 | 72.4 | 5.23 | 0.713 | 1.12 | 0.803 |
| Line 7 | 189 | 120 | 192 | 123 | 74 | 5.22 | 0.714 | 1.14 | 0.791 |
| Line 8 | 197 | 134 | 205 | 131 | 76.5 | 5.33 | 0.753 | 1.13 | 0.837 |
| Line 9 | | | | | | | | | |
| Line 10 | | | | | | | | | |
| Line 11 | 261 | 173 | 264 | 171 | 95.4 | 5.58 | 0.762 | 1.18 | 0.812 |
| Line 12 | 54.3 | 143 | 40.8 | 55.2 | 4.12 | 0.796 | 0.921 | 0.675 | |

Table 37. Provided are the values of each of the parameters (as described above) measured in maize accessions (Seed ID) under regular growth conditions. Growth conditions are specified in the experimental procedure section.

TABLE 38

Correlation between the expression level of selected LNU genes of some embodiments of the invention in various tissues and the phenotypic performance under normal across maize accessions

| Gene Name | R | P | Exp. set | Corr. ID | Gene Name | R | P | Exp. set | Corr. ID |
|---|---|---|---|---|---|---|---|---|---|
| LNU348 | 0.7900 | 0.0196 | C | 3 | LNU394 | 0.8881 | 0.0076 | B | 14 |
| LNU348 | 0.7286 | 0.0404 | C | 18 | LNU394 | 0.8830 | 0.0084 | B | 19 |
| LNU348 | 0.7222 | 0.0430 | C | 17 | LNU394 | 0.8753 | 0.0099 | B | 13 |
| LNU394 | 0.8524 | 0.0035 | E | 8 | LNU394 | 0.8628 | 0.0124 | B | 16 |
| LNU394 | 0.7673 | 0.0158 | E | 6 | LNU394 | 0.8616 | 0.0127 | B | 17 |
| LNU394 | 0.7621 | 0.0170 | E | 15 | LNU394 | 0.8568 | 0.0138 | B | 15 |
| LNU299 | 0.8148 | 0.0075 | E | 6 | LNU394 | 0.7824 | 0.0376 | B | 18 |
| LNU300 | 0.7810 | 0.0130 | E | 6 | LNU361 | 0.8667 | 0.0116 | B | 10 |
| LNU307 | 0.9065 | 0.0008 | E | 8 | LNU361 | 0.8514 | 0.0151 | B | 19 |
| LNU307 | 0.8849 | 0.0015 | E | 15 | LNU361 | 0.8239 | 0.0227 | B | 17 |
| LNU307 | 0.8768 | 0.0019 | E | 13 | LNU361 | 0.7833 | 0.0372 | B | 8 |
| LNU307 | 0.8745 | 0.0020 | E | 20 | LNU361 | 0.7763 | 0.0401 | B | 18 |
| LNU307 | 0.8402 | 0.0046 | E | 16 | LNU361 | 0.7697 | 0.0430 | B | 6 |
| LNU307 | 0.8205 | 0.0067 | E | 18 | LNU299 | 0.8970 | 0.0062 | B | 3 |
| LNU307 | 0.8051 | 0.0088 | E | 17 | LNU299 | 0.8346 | 0.0195 | B | 6 |
| LNU307 | 0.7843 | 0.0123 | E | 4 | LNU299 | 0.8064 | 0.0285 | B | 17 |
| LNU307 | 0.7528 | 0.0192 | E | 19 | LNU299 | 0.7773 | 0.0397 | B | 19 |
| LNU307 | 0.7262 | 0.0267 | E | 5 | LNU299 | 0.7740 | 0.0411 | B | 8 |
| LNU301 | 0.7753 | 0.0141 | E | 6 | LNU299 | 0.7657 | 0.0448 | B | 20 |
| LNU317 | 0.8504 | 0.0037 | E | 19 | LNU360 | 0.8629 | 0.0124 | B | 20 |
| LNU317 | 0.8352 | 0.0051 | E | 3 | LNU300 | 0.9181 | 0.0035 | B | 15 |
| LNU317 | 0.8118 | 0.0079 | E | 7 | LNU300 | 0.8850 | 0.0081 | B | 13 |
| LNU317 | 0.8006 | 0.0095 | E | 6 | LNU300 | 0.8730 | 0.0103 | B | 8 |
| LNU317 | 0.7927 | 0.0108 | E | 18 | LNU300 | 0.8529 | 0.0147 | B | 4 |
| LNU317 | 0.7747 | 0.0142 | E | 17 | LNU300 | 0.8041 | 0.0293 | B | 5 |
| LNU317 | 0.7506 | 0.0198 | E | 13 | LNU300 | 0.8018 | 0.0301 | B | 16 |
| LNU317 | 0.7433 | 0.0217 | E | 4 | LNU300 | 0.8007 | 0.0305 | B | 3 |
| LNU317 | 0.7043 | 0.0342 | E | 12 | LNU300 | 0.7952 | 0.0325 | B | 6 |
| LNU394 | 0.8756 | 0.0098 | E | 10 | LNU300 | 0.7952 | 0.0325 | B | 20 |
| LNU394 | 0.8714 | 0.0106 | E | 19 | LNU359 | 0.9025 | 0.0054 | B | 19 |
| LNU394 | 0.8557 | 0.0140 | E | 3 | LNU359 | 0.9020 | 0.0055 | B | 17 |
| LNU394 | 0.8451 | 0.0167 | E | 7 | LNU359 | 0.9006 | 0.0057 | B | 20 |
| LNU394 | 0.8200 | 0.0239 | E | 17 | LNU359 | 0.8219 | 0.0233 | B | 15 |
| LNU394 | 0.8099 | 0.0273 | E | 13 | LNU359 | 0.7847 | 0.0367 | B | 13 |
| LNU394 | 0.8079 | 0.0279 | E | 12 | LNU307 | 0.8759 | 0.0097 | B | 5 |
| LNU394 | 0.7847 | 0.0366 | E | 15 | LNU307 | 0.8742 | 0.0101 | B | 17 |
| LNU394 | 0.7610 | 0.0469 | E | 16 | LNU307 | 0.8602 | 0.0130 | B | 15 |
| LNU394 | 0.7560 | 0.0493 | E | 18 | LNU307 | 0.8592 | 0.0132 | B | 4 |
| LNU394 | 0.7545 | 0.0500 | E | 6 | LNU307 | 0.8460 | 0.0164 | B | 19 |
| LNU361 | 0.9074 | 0.0048 | E | 3 | LNU307 | 0.8299 | 0.0209 | B | 6 |
| LNU360 | 0.8408 | 0.0178 | E | 4 | LNU307 | 0.8151 | 0.0255 | B | 13 |
| LNU360 | 0.8050 | 0.0289 | E | 5 | LNU460 | 0.9092 | 0.0045 | B | 6 |
| LNU300 | 0.7717 | 0.0421 | E | 8 | LNU460 | 0.9050 | 0.0051 | B | 20 |
| LNU300 | 0.7696 | 0.0430 | E | 6 | LNU460 | 0.8531 | 0.0147 | B | 8 |
| LNU300 | 0.7675 | 0.0440 | E | 18 | LNU460 | 0.8499 | 0.0154 | B | 18 |
| LNU300 | 0.7663 | 0.0445 | E | 19 | LNU460 | 0.7765 | 0.0401 | B | 19 |
| LNU476 | 0.8604 | 0.0130 | E | 10 | LNU460 | 0.7754 | 0.0405 | B | 17 |
| LNU307 | 0.8902 | 0.0072 | E | 18 | LNU460 | 0.7733 | 0.0414 | B | 15 |
| LNU307 | 0.8670 | 0.0115 | E | 8 | LNU418 | 0.8317 | 0.0203 | B | 10 |
| LNU307 | 0.8499 | 0.0154 | E | 5 | LNU469 | 0.8725 | 0.0104 | B | 14 |
| LNU307 | 0.8324 | 0.0202 | E | 4 | LNU469 | 0.8678 | 0.0113 | B | 12 |
| LNU307 | 0.8128 | 0.0262 | E | 17 | LNU469 | 0.8634 | 0.0123 | B | 16 |
| LNU307 | 0.8021 | 0.0300 | E | 15 | LNU469 | 0.8140 | 0.0259 | B | 7 |

TABLE 38-continued

Correlation between the expression level of selected LNU genes of some embodiments of the invention in various tissues and the phenotypic performance under normal across maize accessions

| Gene Name | R | P | Exp. set | Corr. ID | Gene Name | R | P | Exp. set | Corr. ID |
|---|---|---|---|---|---|---|---|---|---|
| LNU307 | 0.7789 | 0.0390 | E | 19 | LNU469 | 0.7969 | 0.0319 | B | 5 |
| LNU307 | 0.7744 | 0.0409 | E | 6 | LNU301 | 0.8989 | 0.0059 | B | 8 |
| LNU332 | 0.9109 | 0.0043 | E | 4 | LNU471 | 0.8820 | 0.0086 | B | 20 |
| LNU332 | 0.8808 | 0.0088 | E | 5 | LNU471 | 0.8585 | 0.0134 | B | 8 |
| LNU332 | 0.8349 | 0.0194 | E | 3 | LNU471 | 0.8071 | 0.0282 | B | 18 |
| LNU332 | 0.8297 | 0.0209 | E | 14 | LNU471 | 0.8037 | 0.0294 | B | 6 |
| LNU332 | 0.8057 | 0.0287 | E | 17 | LNU317 | 0.8799 | 0.0090 | B | 14 |
| LNU332 | 0.7983 | 0.0314 | E | 15 | LNU317 | 0.7948 | 0.0327 | B | 12 |
| LNU332 | 0.7822 | 0.0377 | E | 18 | LNU317 | 0.7734 | 0.0414 | B | 7 |
| LNU459 | 0.7966 | 0.0320 | E | 20 | LNU371 | 0.8211 | 0.0235 | B | 6 |
| LNU519 | 0.8564 | 0.0139 | E | 8 | LNU371 | 0.8036 | 0.0295 | B | 3 |
| LNU519 | 0.7634 | 0.0458 | E | 20 | LNU371 | 0.7612 | 0.0468 | B | 19 |
| LNU519 | 0.7596 | 0.0476 | E | 6 | LNU311 | 0.8585 | 0.0134 | B | 10 |
| LNU317 | 0.8410 | 0.0177 | E | 3 | LNU311 | 0.8191 | 0.0242 | B | 17 |
| LNU371 | 0.7717 | 0.0421 | E | 6 | LNU311 | 0.7814 | 0.0380 | B | 19 |
| LNU394 | 0.7595 | 0.0288 | E | 7 | LNU361 | 0.8460 | 0.0081 | C | 9 |
| LNU299 | 0.7110 | 0.0480 | E | 8 | LNU361 | 0.8178 | 0.0131 | C | 11 |
| LNU476 | 0.7456 | 0.0337 | E | 6 | LNU361 | 0.8114 | 0.0145 | C | 3 |
| LNU317 | 0.7611 | 0.0283 | E | 10 | LNU361 | 0.7451 | 0.0339 | C | 17 |
| LNU317 | 0.7294 | 0.0400 | E | 19 | LNU361 | 0.7393 | 0.0361 | C | 18 |
| LNU371 | 0.8610 | 0.0060 | E | 6 | LNU299 | 0.8498 | 0.0076 | C | 9 |
| LNU394 | 0.7058 | 0.0226 | F | 7 | LNU299 | 0.8299 | 0.0108 | C | 4 |
| LNU299 | 0.7097 | 0.0215 | F | 4 | LNU299 | 0.7977 | 0.0177 | C | 5 |
| LNU300 | 0.7357 | 0.0153 | F | 6 | LNU299 | 0.7974 | 0.0178 | C | 3 |
| LNU476 | 0.7907 | 0.0065 | F | 13 | LNU299 | 0.7645 | 0.0271 | C | 11 |
| LNU476 | 0.7657 | 0.0098 | F | 15 | LNU299 | 0.7239 | 0.0423 | C | 14 |
| LNU476 | 0.7627 | 0.0103 | F | 16 | LNU299 | 0.7196 | 0.0442 | C | 17 |
| LNU307 | 0.9158 | 0.0002 | F | 20 | LNU360 | 0.8298 | 0.0108 | C | 9 |
| LNU307 | 0.8603 | 0.0014 | F | 18 | LNU360 | 0.7486 | 0.0326 | C | 11 |
| LNU307 | 0.8063 | 0.0048 | F | 5 | LNU360 | 0.7461 | 0.0335 | C | 3 |
| LNU307 | 0.7910 | 0.0064 | F | 19 | LNU359 | 0.8130 | 0.0141 | C | 9 |
| LNU307 | 0.7865 | 0.0070 | F | 4 | LNU359 | 0.7391 | 0.0362 | C | 3 |
| LNU307 | 0.7827 | 0.0074 | F | 17 | LNU359 | 0.7328 | 0.0387 | C | 11 |
| LNU307 | 0.7600 | 0.0107 | F | 15 | LNU476 | 0.8702 | 0.0049 | C | 18 |
| LNU307 | 0.7562 | 0.0114 | F | 6 | LNU476 | 0.8498 | 0.0075 | C | 3 |
| LNU307 | 0.7331 | 0.0159 | F | 13 | LNU476 | 0.7860 | 0.0207 | C | 19 |
| LNU307 | 0.7158 | 0.0199 | F | 8 | LNU476 | 0.7185 | 0.0447 | C | 17 |
| LNU459 | 0.7659 | 0.0098 | F | 6 | LNU332 | 0.8630 | 0.0058 | C | 9 |
| LNU459 | 0.7382 | 0.0148 | F | 20 | LNU332 | 0.8522 | 0.0072 | C | 11 |
| LNU459 | 0.7201 | 0.0188 | F | 5 | LNU332 | 0.8394 | 0.0092 | C | 3 |
| LNU317 | 0.7722 | 0.0089 | F | 13 | LNU332 | 0.7634 | 0.0275 | C | 17 |
| LNU317 | 0.7293 | 0.0167 | F | 7 | LNU332 | 0.7277 | 0.0407 | C | 18 |
| LNU317 | 0.7109 | 0.0212 | F | 16 | LNU332 | 0.7093 | 0.0488 | C | 14 |
| LNU394 | 0.8690 | 0.0111 | F | 3 | LNU460 | 0.7756 | 0.0237 | C | 9 |
| LNU394 | 0.8665 | 0.0116 | F | 7 | LNU460 | 0.7209 | 0.0436 | C | 3 |
| LNU394 | 0.8008 | 0.0305 | F | 12 | LNU418 | 0.8127 | 0.0142 | C | 5 |
| LNU394 | 0.7609 | 0.0470 | F | 14 | LNU418 | 0.7625 | 0.0278 | C | 4 |
| LNU360 | 0.7551 | 0.0497 | F | 16 | LNU301 | 0.8153 | 0.0137 | C | 9 |
| LNU300 | 0.8481 | 0.0159 | F | 19 | LNU301 | 0.7645 | 0.0272 | C | 4 |
| LNU300 | 0.8044 | 0.0291 | F | 18 | LNU301 | 0.7126 | 0.0473 | C | 5 |
| LNU300 | 0.8044 | 0.0292 | F | 17 | LNU471 | 0.9147 | 0.0015 | C | 17 |
| LNU300 | 0.7981 | 0.0314 | F | 13 | LNU471 | 0.8947 | 0.0027 | C | 11 |
| LNU300 | 0.7790 | 0.0390 | F | 15 | LNU471 | 0.8818 | 0.0038 | C | 18 |
| LNU300 | 0.7546 | 0.0499 | F | 8 | LNU471 | 0.8772 | 0.0042 | C | 19 |
| LNU307 | 0.9128 | 0.0041 | F | 8 | LNU471 | 0.8494 | 0.0076 | C | 9 |
| LNU307 | 0.8940 | 0.0066 | F | 18 | LNU471 | 0.8027 | 0.0165 | C | 12 |
| LNU307 | 0.8476 | 0.0160 | F | 17 | LNU471 | 0.7913 | 0.0193 | C | 14 |
| LNU307 | 0.8476 | 0.0160 | F | 6 | LNU471 | 0.7083 | 0.0493 | C | 10 |
| LNU307 | 0.8300 | 0.0208 | F | 19 | LNU339 | 0.8143 | 0.0139 | C | 9 |
| LNU307 | 0.7857 | 0.0362 | F | 5 | LNU339 | 0.7695 | 0.0256 | C | 11 |
| LNU307 | 0.7766 | 0.0400 | F | 15 | LNU339 | 0.7123 | 0.0474 | C | 3 |
| LNU307 | 0.7590 | 0.0479 | F | 1 | LNU519 | 0.7864 | 0.0206 | C | 11 |
| LNU469 | 0.8415 | 0.0176 | F | 16 | LNU519 | 0.7631 | 0.0276 | C | 9 |
| LNU469 | 0.8375 | 0.0187 | F | 12 | LNU519 | 0.7345 | 0.0380 | C | 3 |
| LNU469 | 0.8017 | 0.0301 | F | 10 | LNU371 | 0.8650 | 0.0055 | C | 4 |
| LNU469 | 0.7995 | 0.0309 | F | 7 | LNU371 | 0.8176 | 0.0132 | C | 5 |
| LNU469 | 0.7727 | 0.0417 | F | 13 | LNU311 | 0.8403 | 0.0090 | C | 9 |
| LNU469 | 0.7727 | 0.0417 | F | 19 | LNU311 | 0.7667 | 0.0264 | C | 11 |

TABLE 38-continued

Correlation between the expression level of selected LNU genes of some embodiments of the invention in various tissues and the phenotypic performance under normal across maize accessions

| Gene Name | R | P | Exp. set | Corr. ID | Gene Name | R | P | Exp. set | Corr. ID |
|---|---|---|---|---|---|---|---|---|---|
| LNU469 | 0.7557 | 0.0494 | F | 14 | LNU348 | 0.8430 | 0.0086 | C | 9 |
| LNU371 | 0.7611 | 0.0469 | F | 6 | LNU348 | 0.8036 | 0.0163 | C | 11 |
| LNU394 | 0.8917 | 0.0070 | B | 10 | | | | | |

Table 38.
"Corr. Set ID"—correlation set ID according to the correlated parameters Table above.

TABLE 39

Correlation between the expression level of selected LNU homologous genes of some embodiments of the invention in various tissues and the phenotypic performance under normal across maize accessions

| Gene Name | R | P | Exp. set | Corr. ID | Gene Name | R | P | Exp. set | Corr. ID |
|---|---|---|---|---|---|---|---|---|---|
| LNU309_H3 | 0.84 | 0.0050 | E | 6 | LNU431_H1 | 0.89 | 0.0078 | B | 20 |
| LNU309_H3 | 0.76 | 0.0165 | E | 19 | LNU431_H1 | 0.78 | 0.0371 | B | 18 |
| LNU309_H3 | 0.76 | 0.0182 | E | 3 | LNU431_H1 | 0.76 | 0.0464 | B | 8 |
| LNU309_H3 | 0.74 | 0.0221 | E | 18 | LNU417_H4 | 0.81 | 0.0159 | C | 9 |
| LNU494_H2 | 0.76 | 0.0459 | E | 19 | LNU417_H4 | 0.74 | 0.0365 | C | 1 |
| LNU309_H3 | 0.74 | 0.0138 | F | 5 | LNU417_H4 | 0.73 | 0.0391 | C | 3 |
| LNU309_H3 | 0.73 | 0.0173 | F | 14 | LNU431_H1 | 0.71 | 0.0486 | C | 3 |

Table 39.
"Corr. Set ID"—correlation set ID according to the correlated parameters Table above.
"Exp. set" = Expression set.

Example 10

Production of Tomato Transcriptom and High Throughput Correlation Analysis Using 44K Tomato Oligonucleotide Micro-Array In order to produce a high throughput correlation analysis between NUE related phenotypes and gene expression, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Low Nitrogen, Drought and Regular Growth Conditions Experimental Procedures:

Tomato varieties were grown in 3 repetitive blocks, each containing 6 plants per plot were grown at net house. Briefly, the growing protocol was as follows:

1. Regular Growth Conditions:
Tomato varieties were grown under normal conditions (4-6 Liters/m² of water per day and fertilized with NPK as recommended in protocols for commercial tomato production).

2. Low Nitrogen Fertilization Conditions:
Tomato varieties were grown under normal conditions (4-6 Liters/m² per day and fertilized with NPK as recommended in protocols for commercial tomato production) until flowering. At this time, Nitrogen fertilization was stopped.

3. Drought Stress:
Tomato variety was grown under normal conditions (4-6 Liters/m² per day) until flowering. At this time, irrigation was reduced to 50% compared to normal conditions. Plants were phenotyped on a daily basis following the standard descriptor of tomato (Table 40). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Table 41, herein below.

Analyzed Tomato Tissues—
Two tissues at different developmental stages [flower and leaf], representing different plant characteristics, were sampled and RNA was extracted as described above. For convenience, each micro-array expression information tissue type has received a Set ID as summarized in Table 40 below.

TABLE 40

Tomato transcriptom expression sets

| Expression Set | Set ID |
|---|---|
| Leaf grown under Normal Conditions | A |
| Leaf grown under 50% Irrigation | B |
| Flower grown under Normal Conditions | C |
| Flower grown under 50% Irrigation | D |
| Leaf grown under Low Nitrogen | E |
| Flower grown under Low Nitrogen | F |

Table 40 Provided are the identification (ID) letters of each of the tomato expression sets.

The average for each of the measured parameter was calculated using the JMP software and values are summarized in Tables 42-47 below. Subsequent correlation analysis was conducted (Table 48) with the correlation coefficient (R) and the p-values. Results were integrated to the database.

TABLE 41

Tomato correlated parameters (vectors)

| Correlation set | Correlation ID |
|---|---|
| average red fruit weight (Normal) [gr.] | 1 |
| average red fruit weight (NUE) [gr.] | 2 |
| average red fruit weight Drought [gr.] | 3 |
| flower cluster weight Drought/NUE | 4 |
| Fruit yield /Plant (Normal) [gr.] | 5 |
| Fruit Yield/Plant (Drought) [gr.] | 6 |
| Fruit Yield/Plant (NUE) [gr.] | 7 |
| FW ratio (Drought/Normal) | 8 |
| FW ratio (NUE/Normal) | 9 |
| FW/Plant (Normal) [gr.] | 10 |
| FW/Plant (NUE) [gr.] | 11 |
| FW/Plant Drought [gr.] | 12 |
| HI (Low N) | 13 |
| HI (Normal) | 14 |
| Leaflet Length [cm] (Low N) | 15 |
| Leaflet Length [cm] (Normal) | 16 |
| Leaflet Width (Low N) | 17 |
| Leaflet Width (Normal) | 18 |
| No flowers (Normal) [number] | 19 |
| No flowers (NUE) [number] | 20 |
| NUE [yield/SPAD] (Low N) | 21 |
| NUE [yield/SPAD] (Normal) | 22 |
| NUE2 biomass/SPAD] (Low N) | 23 |
| NUE2 biomass/SPAD] (Normal) | 24 |
| Num of flowers (Drought) [number] | 25 |
| Num. Flowers NUE/Normal | 26 |
| NUpE [biomass/SPAD] (Low N) | 27 |
| NUpE [biomass/SPAD] (Normal) | 28 |
| Ratio of Cluster Weight (NUE/Normal) | 29 |
| Ratio of Flower Cluster Weight (Drought/Normal) | 30 |
| Ratio of Fruit Yield (Drought/Normal) | 31 |
| Ratio of Fruits (Drought/NUE) | 32 |
| Ratio of Fruits (NUE/Normal) | 33 |
| Ratio of Number of Flowers (Drought/Normal) | 34 |
| Ratio of Number of Flowers (Drought/NUE) | 35 |
| Ratio of RWC (NUE/Normal) | 36 |
| Ratio of SPAD (NUE/Normal) | 37 |
| Ratio of SPAD 100% RWC (NUE/Normal) | 38 |
| red fruit weight Drought/Normal | 39 |
| RWC (Normal) [%] | 40 |
| RWC Drought [%] | 41 |
| RWC Drought/Normal | 42 |
| RWC NUE [%] | 43 |
| SLA [leaf area/plant biomass] (Low N) | 44 |
| SLA [leaf area/plant biomass] (Normal) | 45 |
| SPAD (Normal) [SPAD unit] | 46 |
| SPAD 100% RWC (Normal) [SPAD unit] | 47 |
| SPAD 100% RWC (NUE) [SPAD unit] | 48 |
| SPAD NUE [SPAD unit] | 49 |
| Total Leaf Area [cm2] (Low N) | 50 |
| Total Leaf Area [cm2] (Normal) | 51 |
| Weight clusters (flowers) (NUE) [gr.] | 52 |
| Weight flower clusters (Drought) [gr.] | 53 |
| Weight Flower clusters (Normal) [gr.] | 54 |
| Weight of 100 green fruits (Normal) | 55 |
| Weight of 100 green fruits (NUE) | 56 |
| Weight of 100 red fruits (Normal) | 57 |
| Weight of 100 red fruits (NUE) | 58 |
| Yield/SLA (Low N) | 59 |
| Yield/SLA (Normal) | 60 |
| Yield/total leaf area (Low N) | 61 |
| Yield/total leaf area (Normal) | 62 |

Table 41
Provided are the tomato correlated parameters,
RWC means relative water content,
NUpE—nitrogen uptake efficiency,
HI—harvest index (vegetative weight divided on yield),
SLA—specific leaf area (leaf area divided on leaf dry weight).

Fruit Yield (grams)—
At the end of the experiment [when 50% of the fruit were ripe (red)] all fruits from plots within blocks A-C were collected. The total fruits were counted and weighted. The average fruits weight was calculated by dividing the total fruit weight by the number of fruits.

Plant Fresh Weight (grams)—
At the end of the experiment [when 50% of the fruit were ripe (red)] all plants from plots within blocks A-C were collected. Fresh weight was measured (grams).

Inflorescence Weight (grams)—
At the end of the experiment [when 50% of the fruits were ripe (red)] two Inflorescence from plots within blocks A-C were collected. The Inflorescence weight (gr.) and number of flowers per inflorescence were counted.

SPAD—
Chlorophyll content was determined using a Minolta SPAD 502 chlorophyll meter and measurement was performed at time of flowering. SPAD meter readings were done on young fully developed leaf. Three measurements per leaf were taken per plot.

Water Use Efficiency (WUE)—
Can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content Experimental Results

TABLE 42

Measured parameters in Tomato accessions under drought conditions

| | Corr. ID | | | | | | |
|---|---|---|---|---|---|---|---|
| Seed ID | 41 | 42 | 25 | 53 | 34 | 35 | 30 | 4 |
| 612 | 72.1 | 0.99 | 16.7 | 0.37 | 2.94 | 0.88 | 0.32 | 0.69 |
| 613 | 74.5 | 0.97 | 6.5 | 0.41 | 0.34 | 1.22 | 1.19 | 1.11 |
| 614 | 65.3 | 1.02 | 15.7 | 0.33 | 2.47 | 1.74 | 0.47 | 1.06 |
| 616 | 72.2 | 1.08 | 20.3 | 0.29 | 2.65 | 1.56 | 0.01 | 0.82 |

TABLE 42-continued

Measured parameters in Tomato accessions under drought conditions

| | Corr. ID | | | | | | |
|---|---|---|---|---|---|---|---|
| Seed ID | 41 | 42 | 25 | 53 | 34 | 35 | 30 | 4 |
| 617 | 66.1 | 1.21 | 11.7 | 0.55 | 1.21 | 1.09 | 1.25 | 1.16 |
| 618 | 68.3 | 0.88 | 25.3 | 0.31 | 3.04 | 1.52 | 0.03 | 1.25 |
| 620 | 78.1 | 1.34 | 29.7 | 0.45 | 5.95 | 4.96 | 0.56 | 1.52 |
| 621 | 18.5 | 0.28 | 17.3 | 0.56 | 2.08 | 1.08 | 0.96 | 1.19 |
| 622 | 73.2 | 1.13 | 14.7 | 0.30 | 1.47 | 0.98 | 0.42 | 0.76 |
| 623 | 62.5 | 0.83 | 29.7 | 0.32 | 4.24 | 4.94 | 0.38 | 1.04 |
| 624 | 67.2 | 1.01 | 15.0 | 0.31 | 1.67 | 0.88 | 0.36 | 0.38 |
| 625 | 75.8 | 1.20 | 10.3 | 0.31 | 1.29 | 0.80 | 0.62 | 0.78 |
| 626 | 62.8 | 1.11 | 18.3 | 8.36 | 3.44 | 2.12 | 8.20 | 24.10 |
| 627 | 70.7 | 1.97 | 12.0 | 0.29 | 1.50 | 1.29 | 0.41 | 0.67 |
| 628 | 55.8 | 0.72 | 20.3 | 0.34 | 2.65 | 1.61 | 0.91 | 0.97 |
| 629 | 75.2 | 0.75 | 12.7 | 0.44 | 1.41 | 1.90 | 0.67 | 0.99 |
| 630 | 63.7 | 1.01 | 12.7 | 0.27 | 1.19 | 1.36 | 0.38 | 0.95 |
| 631 | 62.3 | 0.83 | 11.3 | 0.43 | 1.26 | 1.42 | 1.31 | 0.91 |

Table 42: Provided are the values of each of the parameters (as described above) measured in *Sorghum* accessions (Seed ID) under drought conditions. Growth conditions are specified in the experimental procedure section.

TABLE 43

Additional Measured parameters in Tomato accessions under drought conditions

| | Corr. ID | | | | | | |
|---|---|---|---|---|---|---|---|
| Seed ID | 6 | 12 | 3 | 31 | 32 | 8 | 39 |
| 612 | 0.47 | 2.62 | 0.009 | 0.57 | 1.15 | 1.72 | 0.19 |
| 613 | 0.48 | 1.09 | 0.195 | 1.41 | 0.73 | 0.34 | 24.40 |
| 614 | 0.63 | 1.85 | 0.209 | 1.27 | 1.32 | 0.61 | 25.40 |
| 616 | 0.35 | 2.22 | 0.005 | 2.88 | 0.76 | 2.63 | 0.02 |
| 617 | 2.04 | 2.63 | 0.102 | 4.20 | 1.51 | 1.18 | 20.30 |
| 618 | 0.25 | 2.71 | 0.002 | 0.55 | 0.71 | 1.36 | 0.04 |
| 620 | 0.05 | 3.41 | 0.035 | 0.09 | 5.06 | 4.02 | 0.15 |
| 621 | 0.45 | 2.11 | 0.006 | 1.03 | 0.89 | 1.01 | 0.02 |
| 622 | 0.29 | 1.95 | 0.005 | 1.39 | 0.67 | 0.61 | 0.86 |
| 623 | 1.02 | 1.76 | 0.005 | 3.28 | 2.17 | 0.64 | 0.74 |
| 624 | 0.60 | 1.72 | 0.005 | 0.91 | 0.38 | 0.95 | 0.09 |
| 625 | 0.49 | 1.92 | 0.012 | 2.62 | 1.27 | 0.51 | 1.72 |
| 626 | 0.27 | 2.21 | 0.005 | 0.32 | 0.84 | 1.17 | 0.17 |
| 627 | 0.68 | 3.73 | 0.006 | 2.48 | 1.51 | 1.94 | 0.02 |
| 628 | 0.14 | 0.75 | 0.303 | 0.41 | 0.98 | 0.35 | 10.50 |
| 629 | 0.53 | 1.76 | 0.138 | 1.62 | 1.34 | 1.06 | 27.90 |
| 630 | 0.55 | 0.63 | 0.041 | 1.76 | 0.38 | 0.21 | 11.80 |
| 631 | 0.41 | 1.11 | 0.089 | 1.42 | 0.84 | 0.48 | 9.98 |

Table 43.

TABLE 44

Measured parameters in Tomato accessions under normal conditions

| | Corr. ID | | | | | | | | | |
|---|---|---|---|---|---|---|---|---|---|---|
| Seed ID | 5 | 10 | 1 | 46 | 40 | 47 | 19 | 54 | 22 | 28 |
| 612 | 0.83 | 1.53 | 0.05 | 49.7 | 72.8 | 36.2 | 5.7 | 1.2 | 0.017 | 0.031 |
| 613 | 0.34 | 3.17 | 0.01 | 37.2 | 76.5 | 28.4 | 19.3 | 0.3 | 0.009 | 0.085 |
| 614 | 0.49 | 3.02 | 0.01 | 55.8 | 64.3 | 35.9 | 6.3 | 0.7 | 0.009 | 0.054 |
| 616 | 0.12 | 0.84 | 0.29 | 46.4 | 67.1 | 31.1 | 7.7 | | 0.003 | 0.018 |
| 617 | 0.49 | 2.24 | 0.01 | 48.2 | 54.8 | 26.4 | 9.7 | 0.4 | 0.010 | 0.046 |
| 618 | 0.45 | 1.98 | 0.05 | 43.4 | 77.6 | 33.7 | 8.3 | | 0.011 | 0.046 |
| 620 | 0.53 | 0.85 | 0.23 | 42.9 | 58.2 | 25.0 | 5.0 | 0.8 | 0.012 | 0.020 |
| 621 | 0.44 | 2.09 | 0.29 | 53.3 | 66.5 | 35.5 | 8.3 | 0.6 | 0.008 | 0.039 |
| 622 | 0.21 | 3.21 | 0.01 | 58.5 | 64.7 | 37.9 | 10.0 | 0.7 | 0.004 | 0.055 |
| 623 | 0.31 | 2.75 | 0.01 | 51.1 | 75.2 | 38.4 | 7.0 | 0.8 | 0.006 | 0.054 |
| 624 | 0.66 | 1.81 | 0.06 | 40.0 | 66.2 | 26.5 | 9.0 | 0.9 | 0.017 | 0.045 |
| 625 | 0.19 | 3.77 | 0.01 | 47.6 | 63.2 | 30.1 | 8.0 | 0.5 | 0.004 | 0.079 |
| 626 | 0.85 | 1.89 | 0.03 | 57.9 | 56.8 | 32.9 | 5.3 | 1.0 | 0.015 | 0.033 |
| 627 | 0.27 | 1.93 | 0.26 | 48.3 | 36.0 | 17.4 | 8.0 | 0.7 | 0.006 | 0.040 |
| 628 | 0.35 | 2.14 | 0.03 | 43.6 | 77.6 | 33.8 | 7.7 | 0.4 | 0.008 | 0.049 |
| 629 | 0.33 | 1.65 | 0.00 | 54.5 | 100.0 | 54.5 | 9.0 | 0.7 | 0.006 | 0.030 |
| 630 | 0.31 | 3.01 | 0.00 | 41.6 | 63.2 | 26.3 | 10.7 | 0.7 | 0.008 | 0.072 |
| 631 | 0.29 | 2.29 | 0.01 | 59.1 | 75.1 | 44.4 | 9.0 | 0.3 | 0.005 | 0.039 |

Table 44: Provided are the values of each of the parameters (as described above) measured in *Sorghum* accessions (Seed ID) under normal growth conditions. Growth conditions are specified in the experimental procedure section.

TABLE 45

Additional measured parameters in Tomato accessions under normal conditions

| | Corr. ID | | | | | | | | | |
|---|---|---|---|---|---|---|---|---|---|---|
| Seed ID | 14 | 24 | 51 | 16 | 18 | 55 | 57 | 45 | 62 | 60 |
| 612 | 0.35 | 0.05 | | | | | | | | |
| 613 | 0.10 | 0.09 | | | | | | | | |
| 614 | 0.14 | 0.06 | 426 | 6.3 | 3.7 | 0.6 | 0.82 | 141 | 0.0012 | 0.0035 |
| 616 | 0.13 | 0.02 | 582 | 8.0 | 4.8 | 3.1 | 2.46 | 690 | 0.0002 | 0.0002 |
| 617 | 0.18 | 0.06 | 291 | 5.6 | 3.4 | 0.2 | 0.50 | 130 | 0.0017 | 0.0037 |
| 618 | 0.19 | 0.06 | 594 | 7.7 | 4.6 | 2.6 | 2.76 | 299 | 0.0008 | 0.0015 |
| 620 | 0.38 | 0.03 | 948 | 7.9 | 4.4 | 6.3 | 5.32 | 1120 | 0.0006 | 0.0005 |
| 621 | 0.17 | 0.05 | 233 | 6.2 | 3.2 | 5.8 | 5.24 | 112 | 0.0019 | 0.0039 |
| 622 | 0.06 | 0.06 | 341 | 6.2 | 3.4 | 0.4 | 0.61 | 106 | 0.0006 | 0.0020 |
| 623 | 0.10 | 0.06 | 339 | 5.7 | 3.1 | 0.3 | 0.66 | 123 | 0.0009 | 0.0025 |
| 624 | 0.27 | 0.06 | 190 | 4.4 | 2.4 | 2.0 | 2.70 | 105 | 0.0035 | 0.0063 |

TABLE 45-continued

Additional measured parameters in Tomato accessions under normal conditions

| | Corr. ID | | | | | | | | | |
|---|---|---|---|---|---|---|---|---|---|---|
| Seed ID | 14 | 24 | 51 | 16 | 18 | 55 | 57 | 45 | 62 | 60 |
| 625 | 0.05 | 0.08 | 422 | 4.4 | 2.0 | 2.5 | 0.70 | 112 | 0.0004 | 0.0017 |
| 626 | 0.31 | 0.05 | 581 | 6.8 | 3.8 | 1.4 | 2.64 | 308 | 0.0015 | 0.0028 |
| 627 | 0.12 | 0.05 | 808 | 7.4 | 3.7 | 2.0 | 4.67 | 419 | 0.0003 | 0.0007 |
| 628 | 0.14 | 0.06 | 784 | 6.7 | 3.0 | 1.4 | 2.17 | 366 | 0.0004 | 0.0009 |
| 629 | 0.17 | 0.04 | 352 | 5.9 | 3.2 | 2.3 | 0.49 | 213 | 0.0009 | 0.0015 |
| 630 | 0.09 | 0.08 | 256 | 4.2 | 2.1 | 0.5 | 0.34 | 85 | 0.0012 | 0.0037 |
| 631 | 0.11 | 0.04 | 1080 | 10.3 | 5.9 | 0.4 | 0.75 | 470 | 0.0003 | 0.0006 |

Table 45: Provided are the values of each of the parameters (as described above) measured in *Sorghum* accessions (Seed ID) under normal growth conditions. Growth conditions are specified in the experimental procedure section.

TABLE 46

Measured parameters in Tomato accessions under low nitrogen conditions

| | Corr. ID | | | | | | | | | | | | | |
|---|---|---|---|---|---|---|---|---|---|---|---|---|---|---|
| Seed ID | 7 | 11 | 2 | 33 | 9 | 49 | 43 | 48 | 37 | 38 | 36 | 20 | 52 | 26 |
| 612 | 0.41 | 4.04 | 0.024 | 0.49 | 2.65 | 38.4 | 74.1 | 28.5 | 0.77 | 0.79 | 1.0 | 19.0 | 0.53 | 3.35 |
| 613 | 0.66 | 1.21 | 0.191 | 1.93 | 0.38 | 39.4 | 99.1 | 39.0 | 1.06 | 1.37 | 1.3 | 5.3 | 0.37 | 0.28 |
| 614 | 0.48 | 2.25 | 0.006 | 0.97 | 0.74 | 47.5 | 69.5 | 33.0 | 0.85 | 0.92 | 1.1 | 9.0 | 0.31 | 1.42 |
| 616 | 0.46 | 2.54 | 0.005 | 3.80 | 3.01 | 37.0 | 63.2 | 23.4 | 0.80 | 0.75 | 0.9 | 13.0 | 0.35 | 1.70 |
| 617 | 1.35 | 1.85 | 0.096 | 2.78 | 0.83 | 44.6 | 77.4 | 34.5 | 0.93 | 1.31 | 1.4 | 10.7 | 0.47 | 1.10 |
| 618 | 0.35 | 3.06 | 0.004 | 0.78 | 1.54 | 41.7 | 77.9 | 32.5 | 0.96 | 0.97 | 1.0 | 16.7 | 0.25 | 2.00 |
| 620 | 0.01 | 3.13 | 0.006 | 0.02 | 3.70 | 34.4 | 80.5 | 27.7 | 0.80 | 1.11 | 1.4 | 6.0 | 0.29 | 1.20 |
| 621 | 0.51 | 2.54 | 0.007 | 1.16 | 1.22 | 50.0 | 67.4 | 33.7 | 0.94 | 0.95 | 1.0 | 16.0 | 0.47 | 1.92 |
| 622 | 0.44 | 1.84 | 0.006 | 2.07 | 0.58 | 44.7 | 67.2 | 30.0 | 0.76 | 0.79 | 1.0 | 15.0 | 0.40 | 1.50 |
| 623 | 0.47 | 1.52 | 0.013 | 1.51 | 0.55 | 53.7 | 66.1 | 35.5 | 1.05 | 0.92 | 0.9 | 6.0 | 0.30 | 0.86 |
| 624 | 1.59 | 1.91 | 0.021 | 2.41 | 1.06 | 35.7 | 69.6 | 24.8 | 0.89 | 0.94 | 1.1 | 17.0 | 0.82 | 1.89 |
| 625 | 0.39 | 1.86 | 0.005 | 2.06 | 0.49 | 58.8 | 69.3 | 40.8 | 1.24 | 1.36 | 1.1 | 13.0 | 0.40 | 1.62 |
| 626 | 0.32 | 2.47 | 0.006 | 0.38 | 1.31 | 47.5 | 100.0 | 47.5 | 0.82 | 1.44 | 1.8 | 8.7 | 0.35 | 1.62 |
| 627 | 0.45 | 2.62 | 0.048 | 1.64 | 1.36 | 45.2 | 57.7 | 26.1 | 0.94 | 1.50 | 1.6 | 9.3 | 0.43 | 1.17 |
| 628 | 0.14 | 1.08 | 0.357 | 0.41 | 0.51 | 39.0 | 90.8 | 35.4 | 0.89 | 1.05 | 1.2 | 12.7 | 0.35 | 1.65 |
| 629 | 0.40 | 1.17 | 0.037 | 1.21 | 0.71 | 45.0 | 68.0 | 30.6 | 0.83 | 0.56 | 0.7 | 6.7 | 0.45 | 0.74 |
| 630 | 1.44 | 0.92 | 0.626 | 4.59 | 0.31 | 65.3 | 59.6 | 39.0 | 1.57 | 1.48 | 0.9 | 9.3 | 0.28 | 0.88 |
| 631 | 0.50 | 1.09 | | 1.70 | 0.47 | 51.9 | 72.2 | 37.5 | 0.88 | 0.84 | 1.0 | 8.0 | 0.47 | 0.89 |

Table 46: Provided are the values of each of the parameters (as described above) measured in *Sorghum* accessions (Seed ID) under low nitrogen growth conditions. Growth conditions are specified in the experimental procedure section.

TABLE 47

Additional measured parameters in Tomato accessions under low nitrogen conditions

| | Corr. ID | | | | | | | | | | | | |
|---|---|---|---|---|---|---|---|---|---|---|---|---|---|
| Seed ID | 29 | 21 | 27 | 13 | 23 | 50 | 15 | 17 | 56 | 44 | 61 | 59 | 58 |
| 612 | 0.46 | 0.014 | 0.14 | 0.09 | 0.16 | 566 | 6.4 | 3.5 | 0.87 | 140 | 0.0007 | 0.003 | 1.1 |
| 613 | 1.07 | 0.017 | 0.03 | 0.35 | 0.05 | 385 | 5.9 | 2.0 | 3.66 | 317 | 0.0017 | 0.002 | 6.9 |
| 614 | 0.44 | 0.014 | 0.07 | 0.18 | 0.08 | 295 | 3.7 | 1.8 | 0.57 | 131 | 0.0016 | 0.004 | 0.6 |
| 616 | 0.01 | 0.020 | 0.11 | 0.15 | 0.13 | 378 | 5.4 | 2.6 | 0.37 | 149 | 0.0012 | 0.003 | 0.5 |
| 617 | 1.08 | 0.039 | 0.05 | 0.42 | 0.09 | 476 | 7.0 | 3.5 | 3.40 | 258 | 0.0028 | 0.005 | 7.2 |
| 618 | 0.02 | 0.011 | 0.09 | 0.10 | 0.11 | 197 | 3.7 | 1.7 | 0.68 | 64 | 0.0018 | 0.006 | 0.4 |
| 620 | 0.37 | 0.000 | 0.11 | 0.00 | 0.11 | 453 | 4.4 | 1.9 | 0.45 | 145 | 0.0000 | 0.000 | |
| 621 | 0.81 | 0.015 | 0.08 | 0.17 | 0.09 | 626 | 6.7 | 3.5 | 0.47 | 246 | 0.0008 | 0.002 | 0.6 |
| 622 | 0.55 | 0.015 | 0.06 | 0.19 | 0.08 | 748 | 6.7 | 3.3 | 0.54 | 406 | 0.0006 | 0.001 | 0.7 |
| 623 | 0.36 | 0.013 | 0.04 | 0.24 | 0.06 | 454 | 4.4 | 2.5 | 0.39 | 299 | 0.0010 | 0.002 | 0.6 |
| 624 | 0.95 | 0.064 | 0.08 | 0.45 | 0.14 | 165 | 3.9 | 2.6 | 0.97 | 86 | 0.0097 | 0.019 | 1.3 |
| 625 | 0.80 | 0.010 | 0.05 | 0.17 | 0.06 | 338 | 5.3 | 2.6 | 0.91 | 182 | 0.0012 | 0.002 | 1.3 |
| 626 | 0.34 | 0.007 | 0.05 | 0.12 | 0.06 | 396 | 6.3 | 3.6 | 0.36 | 160 | 0.0008 | 0.002 | 0.5 |
| 627 | 0.61 | 0.017 | 0.10 | 0.15 | 0.12 | 236 | 5.1 | 2.6 | 0.35 | 90 | 0.0019 | 0.005 | 0.6 |
| 628 | 0.94 | 0.004 | 0.03 | 0.12 | 0.03 | 175 | 4.7 | 2.5 | 0.57 | 161 | 0.0008 | 0.001 | 0.9 |
| 629 | 0.68 | 0.013 | 0.04 | 0.25 | 0.05 | 442 | 6.8 | 3.4 | 4.38 | 379 | 0.0009 | 0.001 | 6.2 |

TABLE 47-continued

Additional measured parameters in Tomato accessions under low nitrogen conditions

| Seed ID | Corr. ID | | | | | | | | | | | |
|---|---|---|---|---|---|---|---|---|---|---|---|---|
| | 29 | 21 | 27 | 13 | 23 | 50 | 15 | 17 | 56 | 44 | 61 | 59 | 58 |
| 630 | 0.40 | 0.037 | 0.02 | 0.61 | 0.06 | 489 | 7.1 | 3.3 | 2.02 | 531 | 0.0030 | 0.003 | 3.7 |
| 631 | 1.44 | 0.013 | 0.03 | 0.31 | 0.04 | 708 | 8.2 | 3.7 | 8.13 | 651 | 0.0007 | 0.001 | 11.3 |

Table 47: Provided are the values of each of the parameters (as described above) measured in *Sorghum* accessions (Seed ID) under low nitrogen growth conditions. Growth conditions are specified in the experimental procedure section.

TABLE 48

Correlation between the expression level of selected LNU genes of some embodiments of the invention in various tissues and the phenotypic performance under low nitrogen, normal or drought stress conditions across Tomato accessions

| Gene Name | R | P | Exp. set ID | Corr. ID | Exp. set ID | Gene Name | R | P | Exp. set ID |
|---|---|---|---|---|---|---|---|---|---|
| LNU323 | 0.75 | 0.0116 | F | 21 | F | LNU330 | 0.75 | 0.0127 | F |
| LNU429 | 0.73 | 0.0156 | F | 21 | F | LNU390 | 0.90 | 0.0003 | F |
| LNU310 | 0.80 | 0.0051 | F | 21 | F | LNU405 | 0.91 | 0.0003 | F |
| LNU461 | 0.71 | 0.0313 | C | 22 | C | LNU411 | 0.92 | 0.0002 | F |
| LNU328 | 0.84 | 0.0046 | A | 22 | A | LNU356 | 0.75 | 0.0134 | E |
| LNU405 | 0.70 | 0.0235 | F | 23 | F | LNU390 | 0.72 | 0.0178 | E |
| LNU357 | 0.74 | 0.0238 | C | 24 | C | LNU405 | 0.77 | 0.0094 | E |
| LNU331 | 0.82 | 0.0073 | C | 24 | C | LNU413 | 0.73 | 0.0156 | F |
| LNU383 | 0.78 | 0.0131 | C | 24 | C | LNU356 | 0.83 | 0.0032 | E |
| LNU342 | 0.70 | 0.0339 | A | 24 | A | LNU405 | 0.84 | 0.0026 | E |
| LNU430 | 0.71 | 0.0215 | B | 34 | B | LNU413 | 0.83 | 0.0112 | C |
| LNU455 | 0.86 | 0.0013 | D | 35 | D | LNU500 | 0.72 | 0.0187 | E |
| LNU506 | 0.75 | 0.0129 | B | 35 | B | LNU329 | 0.75 | 0.0128 | E |
| LNU468 | 0.75 | 0.0134 | B | 35 | B | LNU295 | 0.81 | 0.0157 | C |
| LNU430 | 0.79 | 0.0066 | B | 35 | B | LNU413 | 0.90 | 0.0020 | C |
| LNU489 | 0.71 | 0.0204 | B | 35 | B | LNU413 | 0.80 | 0.0058 | F |
| LNU455 | 0.84 | 0.0026 | B | 35 | B | LNU411 | 0.85 | 0.0017 | F |
| LNU455 | 0.76 | 0.0112 | D | 25 | D | LNU384 | 0.78 | 0.0072 | E |
| LNU430 | 0.72 | 0.0189 | B | 25 | B | LNU302 | 0.77 | 0.0095 | A |
| LNU357 | 0.76 | 0.0181 | C | 28 | C | LNU468 | 0.72 | 0.0294 | F |
| LNU331 | 0.78 | 0.0141 | C | 28 | C | LNU370 | 0.77 | 0.0250 | C |
| LNU383 | 0.74 | 0.0231 | C | 28 | C | LNU468 | 0.82 | 0.0038 | C |
| LNU375 | 0.72 | 0.0297 | C | 28 | C | LNU375 | 0.82 | 0.0071 | F |
| LNU430 | 0.73 | 0.0252 | C | 28 | C | LNU430 | 0.72 | 0.0294 | F |
| LNU342 | 0.75 | 0.0209 | A | 28 | A | LNU390 | 0.81 | 0.0043 | E |
| LNU461 | 0.76 | 0.0106 | D | 41 | D | LNU411 | 0.72 | 0.0183 | E |
| LNU384 | 0.79 | 0.0061 | F | 43 | F | LNU413 | 0.80 | 0.0059 | C |
| LNU506 | 0.77 | 0.0097 | F | 43 | F | LNU413 | 0.79 | 0.0062 | A |
| LNU342 | 0.70 | 0.0234 | F | 43 | F | LNU384 | 0.79 | 0.0061 | E |
| LNU383 | 0.88 | 0.0008 | E | 43 | E | LNU295 | 0.74 | 0.0345 | C |
| LNU384 | 0.70 | 0.0234 | F | 36 | F | LNU500 | 0.76 | 0.0108 | E |
| LNU506 | 0.74 | 0.0136 | F | 36 | F | LNU390 | 0.79 | 0.0061 | F |
| LNU442 | 0.73 | 0.0161 | F | 44 | F | LNU405 | 0.75 | 0.0127 | F |
| LNU390 | 0.76 | 0.0111 | F | 44 | F | LNU383 | 0.70 | 0.0341 | F |
| LNU405 | 0.85 | 0.0018 | F | 44 | F | LNU429 | 0.87 | 0.0024 | F |
| LNU430 | 0.81 | 0.0047 | F | 44 | F | LNU442 | 0.77 | 0.0144 | F |
| LNU500 | 0.80 | 0.0051 | F | 44 | F | LNU323 | 0.87 | 0.0023 | F |
| LNU500 | 0.72 | 0.0425 | C | 45 | C | LNU310 | 0.92 | 0.0005 | F |
| LNU442 | 0.76 | 0.0107 | C | 46 | C | LNU500 | 0.76 | 0.0176 | F |
| LNU461 | 0.72 | 0.0184 | A | 46 | A | LNU331 | 0.78 | 0.0130 | E |
| LNU336 | 0.75 | 0.0133 | A | 46 | A | LNU430 | 0.75 | 0.0206 | E |
| LNU356 | 0.70 | 0.0233 | A | 46 | A | LNU375 | 0.76 | 0.0112 | D |
| LNU310 | 0.85 | 0.0017 | C | 47 | C | LNU413 | 0.71 | 0.0208 | D |
| LNU506 | 0.89 | 0.0006 | F | 48 | F | LNU413 | 0.71 | 0.0214 | B |
| LNU506 | 0.76 | 0.0101 | E | 48 | E | LNU328 | 0.72 | 0.0186 | B |
| LNU455 | 0.82 | 0.0034 | E | 48 | E | LNU413 | 0.80 | 0.0056 | F |
| LNU331 | 0.75 | 0.0117 | E | 38 | E | LNU411 | 0.78 | 0.0073 | F |
| LNU383 | 0.72 | 0.0196 | E | 38 | E | LNU384 | 0.75 | 0.0124 | E |
| LNU454 | 0.79 | 0.0061 | E | 38 | E | LNU330 | 0.76 | 0.0103 | E |
| LNU455 | 0.73 | 0.0158 | E | 38 | E | LNU356 | 0.73 | 0.0161 | E |
| LNU442 | 0.78 | 0.0082 | F | 49 | F | LNU500 | 0.76 | 0.0108 | E |
| LNU323 | 0.75 | 0.0128 | F | 49 | F | LNU329 | 0.91 | 0.0003 | E |
| LNU429 | 0.79 | 0.0067 | F | 49 | F | LNU411 | 0.72 | 0.0178 | E |
| LNU430 | 0.86 | 0.0014 | F | 49 | F | LNU384 | 0.70 | 0.0239 | D |
| LNU462 | 0.70 | 0.0239 | E | 49 | E | LNU390 | 0.70 | 0.0234 | B |
| LNU295 | 0.73 | 0.0166 | F | 37 | F | LNU323 | 0.84 | 0.0023 | F |
| LNU323 | 0.88 | 0.0007 | F | 37 | F | LNU429 | 0.86 | 0.0016 | F |

TABLE 48-continued

Correlation between the expression level of selected LNU genes of some embodiments of the invention in various tissues and the phenotypic performance under low nitrogen, normal or drought stress conditions across Tomato accessions

| Gene Name | R | P | Exp. set ID | Corr. ID | Exp. set ID | Gene Name | R | P | Exp. set ID |
|---|---|---|---|---|---|---|---|---|---|
| LNU383 | 0.72 | 0.0190 | F | 37 | F | LNU375 | 0.73 | 0.0157 | F |
| LNU429 | 0.92 | 0.0002 | F | 37 | F | LNU310 | 0.84 | 0.0021 | F |
| LNU375 | 0.73 | 0.0159 | F | 37 | F | LNU500 | 0.72 | 0.0198 | F |
| LNU310 | 0.88 | 0.0008 | F | 37 | F | LNU390 | 0.73 | 0.0163 | D |
| LNU331 | 0.81 | 0.0043 | E | 37 | E | LNU390 | 0.75 | 0.0131 | B |
| LNU430 | 0.75 | 0.0119 | E | 37 | E | LNU405 | 0.79 | 0.0069 | B |
| LNU451 | 0.75 | 0.0127 | F | 52 | F | LNU411 | 0.80 | 0.0051 | B |
| LNU326 | 0.71 | 0.0208 | C | 54 | C | LNU323 | 0.79 | 0.0071 | F |
| LNU442 | 0.78 | 0.0074 | A | 54 | A | LNU429 | 0.77 | 0.0087 | F |
| LNU326 | 0.80 | 0.0050 | A | 54 | A | LNU310 | 0.84 | 0.0025 | F |
| LNU489 | 0.84 | 0.0025 | A | 54 | A | LNU390 | 0.91 | 0.0002 | D |
| LNU489 | 0.77 | 0.0092 | F | 59 | F | LNU405 | 0.86 | 0.0013 | B |
| LNU442 | 0.84 | 0.0022 | E | 59 | E | LNU411 | 0.87 | 0.0010 | B |
| LNU454 | 0.83 | 0.0029 | E | 59 | E | LNU451 | 0.73 | 0.0172 | D |
| LNU489 | 0.82 | 0.0041 | E | 59 | E | LNU413 | 0.71 | 0.0224 | D |
| LNU357 | 0.71 | 0.0483 | C | 60 | C | LNU405 | 0.71 | 0.0220 | F |
| LNU331 | 0.83 | 0.0109 | C | 60 | C | LNU451 | 0.73 | 0.0167 | D |
| LNU310 | 0.73 | 0.0412 | C | 60 | C | LNU413 | 0.79 | 0.0070 | D |
| LNU455 | 0.75 | 0.0323 | C | 60 | C | LNU323 | 0.81 | 0.0043 | F |
| LNU329 | 0.84 | 0.0096 | C | 60 | C | LNU429 | 0.82 | 0.0038 | F |
| LNU295 | 0.83 | 0.0033 | F | 61 | F | LNU375 | 0.84 | 0.0024 | F |
| LNU429 | 0.73 | 0.0171 | F | 61 | F | LNU310 | 0.78 | 0.0072 | F |
| LNU310 | 0.82 | 0.0039 | F | 61 | F | LNU500 | 0.80 | 0.0060 | F |
| LNU295 | 0.73 | 0.0169 | E | 61 | E | LNU461 | 0.71 | 0.0334 | C |
| LNU454 | 0.71 | 0.0207 | E | 61 | E | LNU328 | 0.78 | 0.0133 | A |
| LNU442 | 0.72 | 0.0431 | C | 62 | C | LNU370 | 0.78 | 0.0083 | A |
| LNU455 | 0.87 | 0.0049 | C | 62 | C | LNU413 | 0.75 | 0.0132 | A |
| LNU329 | 0.77 | 0.0270 | C | 62 | C | LNU413 | 0.73 | 0.0172 | F |

Table 48.
"Corr. Set ID"—correlation set ID according to the correlated parameters Table above.
"Exp. Set" = Expression set.

Correlation of Early Vigor Traits Across Collection of Tomato Ecotypes Under Low Nitrogen, 300 mM NaCl, and Normal Growth Conditions Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N) or at Normal growth solution (Full Hoagland containing 8 mM N solution, at 28±2° C.). Plants were grown at 28±2° C.

Full Hoagland solution consists of: $KNO_3$-0.808 grams/liter, $MgSO_4$-0.12 grams/liter, $KH_2PO_4$-0.172 grams/liter and 0.01% (volume/volume) of 'Super coratin' micro elements (Iron-EDDHA [ethylenediamine-N,N'-bis(2-hydroxyphenylacetic acid)]-40.5 grams/liter; Mn-20.2 grams/liter; Zn 10.1 grams/liter; Co 1.5 grams/liter; and Mo 1.1 grams/liter), solution's pH should be 6.5-6.8].

Analyzed Tomato Tissues—

All 10 selected Tomato varieties were sample per each treatment. Two types of tissues [leaves and roots] were sampled and RNA was extracted as described above. For convenience, each micro-array expression information tissue type has received a Set ID as summarized in Table 49 below.

TABLE 49

Tomato transcriptom expression sets

| Expression Set | Set ID |
|---|---|
| Leaves at 300 mM NaCl | A |
| Leaves at Normal conditions | B |
| Leaves at Low Nitrogen conditions | C |
| Roots at 100 mM NaCl | D |
| Roots at Normal conditions | E |
| Roots at Low Nitrogen conditions | F |

Table 49 Provided are the tomato transcriptom experimental sets.

Tomato Vigor Related Parameters—

Following 5 weeks of growing, plant were harvested and analyzed for Leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 50, herein below.

TABLE 50

Tomato correlated parameters (vectors)

| Correlation set | Correlation ID |
|---|---|
| Leaf No NaCl [number] | 1 |
| Leaf No Normal [number] | 2 |
| Leaf No NUE [number] | 3 |
| Leaf No Ratio NaCl/Normal | 4 |
| Leaf No Ratio NaCl/NUE | 5 |
| Leaf number ratio NUE/Normal | 6 |

TABLE 50-continued

Tomato correlated parameters (vectors)

| Correlation set | Correlation ID |
|---|---|
| NUE roots (Root Biomass [Dw]/SPAD) Cold | 7 |
| NUE roots (Root Biomass [Dw]/SPAD) Low N | 8 |
| NUE roots (Root Biomass [Dw]/SPAD) NaCl | 9 |
| NUE roots (Root Biomass [Dw]/SPAD) Normal | 10 |
| NUE roots Low N | 11 |
| NUE roots Normal | 12 |
| NUE shoots (shoot Biomass [Dw]/SPAD) Cold | 13 |
| NUE shoots (shoot Biomass [Dw]/SPAD) Low N | 14 |
| NUE shoots (shoot Biomass [Dw]/SPAD) NaCl | 15 |
| NUE shoots (shoot Biomass [Dw]/SPAD) Normal | 16 |
| NUE shoots Low N | 17 |
| NUE shoots Normal | 18 |
| NUE total biomass (Total Biomass [Dw]/SPAD) Cold | 19 |
| NUE total biomass (Total Biomass [Dw]/SPAD) Low N | 20 |
| NUE total biomass (Total Biomass [Dw]/SPAD) NaCl | 21 |
| NUE total biomass (Total Biomass [Dw]/SPAD) Normal | 22 |
| NUE total biomass Low N | 23 |
| NUE total biomass Normal | 24 |
| Plant biomass NaCl [gr] | 25 |
| Plant height NaCl [cm] | 26 |
| Plant height Normal [cm] | 27 |
| Plant height NUE [cm] | 28 |
| Plant Height Ratio NaCl/Normal | 29 |
| Plant Height Ratio NaCl/NUE | 30 |
| Plant Height Ratio NUE/Normal | 31 |
| Ratio Shoot Biomass/Root Biomass Normal | 32 |
| Ratio Shoot Biomass/Root Biomass NUE | 33 |
| Root Biomass reduction compared to normal [%] Low N | 34 |
| Shoot Biomass reduction compared to normal [%] Low N | 35 |
| SPAD Cold [SPAD unit] | 36 |
| SPAD NaCl [SPAD unit] | 37 |
| SPAD Normal [SPAD unit] | 38 |
| SPAD NUE [SPAD unit] | 39 |
| SPAD NUE/Normal | 40 |

Table 50 Provided are the tomato correlated parameters, NUE means nitrogen use efficiency

Experimental Results 10 different Tomato varieties were grown and characterized for parameters as described above. The average for each of the measured parameter was calculated using the JMP software and values are summarized in Tables 51-53 below. Subsequent correlation analysis was conducted (Table 54). Follow, results were integrated to the database.

TABLE 51

Measured parameters in Tomato accessions under low nitrogen conditions

| Corr. ID | 1139 | 2078 | 2958 | 5077 | 5080 | 5084 | 5085 | 5088 | 5089 | 5092 | 5113 |
|---|---|---|---|---|---|---|---|---|---|---|---|
| 28 | 36.8 | 39.9 | 34.4 | 47.0 | 46.4 | 45.4 | 47.7 | 39.3 | 41.8 | 41.0 | |
| 27 | 45.3 | 47.8 | 40.8 | 55.3 | 56.2 | 48.7 | 55.8 | 37.4 | 49.6 | 46.3 | |
| 39 | 34.6 | 24.9 | 28.6 | 31.6 | 29.7 | 31.8 | 30.3 | 30.3 | 31.3 | 28.8 | |
| 6 | 0.85 | 0.90 | 0.98 | 1.09 | 0.88 | 1.02 | 0.87 | 1.06 | 0.91 | 1.12 | |
| 31 | 0.81 | 0.83 | 0.84 | 0.85 | 0.83 | 0.93 | 0.85 | 1.05 | 0.84 | 0.88 | |
| 40 | 1.01 | 0.98 | 1.02 | 1.00 | 0.98 | 0.98 | 0.93 | 1.05 | 1.01 | 0.99 | |
| 3 | 5.6 | 6.2 | 7.2 | 6.8 | 5.6 | 6.6 | 5.1 | 5.9 | 5.6 | 6.3 | |
| 14 | 0.004 | 0.004 | 0.003 | 0.007 | 0.005 | 0.005 | 0.012 | 0.007 | 0.007 | 0.007 | 0.006 |
| 8 | 0.001 | 0.001 | 0.000 | 0.001 | 0.001 | 0.001 | 0.001 | 0.001 | 0.001 | 0.001 | 0.001 |
| 20 | 0.005 | 0.005 | 0.003 | 0.008 | 0.005 | 0.006 | 0.013 | 0.008 | 0.008 | 0.008 | 0.007 |
| 39 | 10.9 | 11.5 | 11.4 | 10.4 | 11.2 | 8.9 | 7.9 | 8.0 | 10.3 | 8.6 | 14.5 |
| 33 | 5.0 | 6.4 | 11.4 | 9.5 | 11.6 | 8.2 | 10.4 | 10.5 | 8.2 | 8.0 | 3.9 |
| 35 | 75.4 | 62.2 | 55.1 | 49.7 | 63.2 | 82.7 | 66.9 | 108.0 | 55.4 | 54.4 | 59.7 |
| 34 | 62.6 | 144.0 | 54.2 | 70.5 | 59.7 | 96.1 | 107.0 | 112.0 | 81.6 | 32.2 | 87.5 |
| 17 | 35.4 | 38.4 | 24.1 | 65.0 | 46.7 | 46.7 | 120.0 | 60.1 | 66.3 | 56.5 | 60.3 |
| 11 | 7.0 | 7.7 | 2.5 | 7.0 | 5.0 | 8.0 | 15.1 | 9.0 | 8.8 | 7.3 | 15.9 |
| 23 | 58.5 | 69.7 | 63.8 | 69.3 | 71.1 | 60.5 | 73.9 | 68.8 | 66.7 | 70.8 | 49.7 |

Table 51.

TABLE 52

Measured parameters in Tomato accessions under normal conditions

| Corr. ID | 1139 | 2078 | 2958 | 5077 | 5080 | 5084 | 5085 | 5088 | 5089 | 5092 | 5113 |
|---|---|---|---|---|---|---|---|---|---|---|---|
| 2 | 6.6 | 6.9 | 7.3 | 6.2 | 6.3 | 6.4 | 5.9 | 5.6 | 6.1 | 5.7 | |
| 27 | 45.3 | 47.8 | 40.8 | 55.3 | 56.2 | 48.7 | 55.8 | 37.4 | 49.6 | 46.3 | |
| 38 | 34.3 | 25.3 | 28.1 | 31.4 | 30.2 | 32.4 | 32.6 | 28.8 | 30.9 | 29.0 | |
| 16 | 0.005 | 0.006 | 0.005 | 0.014 | 0.008 | 0.005 | 0.017 | 0.007 | 0.011 | 0.012 | 0.009 |
| 10 | 0.001 | 0.001 | 0.001 | 0.001 | 0.001 | 0.001 | 0.001 | 0.001 | 0.001 | 0.003 | 0.002 |
| 22 | 0.006 | 0.007 | 0.006 | 0.016 | 0.009 | 0.006 | 0.019 | 0.008 | 0.012 | 0.014 | 0.011 |
| 38 | 9.3 | 10.2 | 8.9 | 8.4 | 9.8 | 8.6 | 6.6 | 7.0 | 8.7 | 7.4 | 9.4 |
| 32 | 5.4 | 12.7 | 10.0 | 15.4 | 8.8 | 7.5 | 12.6 | 8.0 | 14.3 | 4.8 | 6.3 |
| 18 | 4.7 | 6.2 | 4.4 | 13.1 | 7.4 | 5.7 | 17.9 | 5.6 | 12.0 | 10.4 | 10.1 |

TABLE 52-continued

Measured parameters in Tomato accessions under normal conditions

| Corr. ID | Line | | | | | | | | | | |
|---|---|---|---|---|---|---|---|---|---|---|---|
| | 1139 | 2078 | 2958 | 5077 | 5080 | 5084 | 5085 | 5088 | 5089 | 5092 | 5113 |
| 12 | 1.1 | 0.5 | 0.5 | 1.0 | 0.8 | 0.8 | 0.9 | 0.8 | 1.1 | 2.3 | 1.8 |
| 24 | 7.5 | 9.1 | 8.6 | 8.9 | 7.2 | 7.9 | 9.1 | 7.9 | 8.6 | 8.7 | 6.2 |

Table 52.

TABLE 53

Measured parameters in Tomato accessions under salinity conditions

| Corr. ID | Line | | | | | | | | | | |
|---|---|---|---|---|---|---|---|---|---|---|---|
| | 1139 | 2078 | 2958 | 5077 | 5080 | 5084 | 5085 | 5088 | 5089 | 5092 | 5113 |
| 1 | 3.6 | 3.9 | 5.0 | 4.0 | 3.6 | 4.4 | 3.2 | 3.7 | 4.0 | 4.3 | |
| 26 | 5.6 | 6.5 | 8.5 | 8.6 | 8.9 | 7.6 | 8.6 | 5.6 | 5.8 | 9.4 | |
| 25 | 0.36 | 0.44 | 0.26 | 0.71 | 0.46 | 0.54 | 0.66 | 0.40 | 0.52 | 0.45 | |
| 4 | 0.54 | 0.57 | 0.68 | 0.64 | 0.56 | 0.54 | 0.67 | 0.65 | 0.75 | | |
| 5 | 0.64 | 0.63 | 0.69 | 0.59 | 0.64 | 0.67 | 0.62 | 0.63 | 0.72 | 0.68 | |
| 29 | 0.12 | 0.14 | 0.21 | 0.15 | 0.16 | 0.16 | 0.15 | 0.15 | 0.12 | 0.20 | |
| 30 | 0.15 | 0.16 | 0.25 | 0.18 | 0.19 | 0.17 | 0.18 | 0.14 | 0.14 | 0.23 | |
| 15 | 0.00051 | 0.00072 | 0.00067 | 0.00117 | 0.00172 | 0.00098 | 0.00117 | 0.00075 | 0.00101 | 0.00102 | 0.00069 |
| 37 | 11.4 | 10.4 | 11.6 | 10.8 | 10.8 | 7.0 | 9.2 | 8.5 | 10.4 | 8.8 | 12.4 |
| 9 | 0.00006 | 0.00005 | 0.00011 | 0.00010 | 0.00007 | 0.00009 | 0.00010 | 0.00008 | 0.00009 | | 0.00005 |
| 21 | 0.00072 | 0.00063 | 0.00081 | 0.00142 | 0.00178 | 0.00107 | 0.00126 | 0.00083 | 0.00111 | | 0.00069 |

Table 53.

TABLE 54

Correlation between the expression level of selected LNU genes of some embodiments of the invention in various tissues and the phenotypic performance under low nitrogen, normal or salinity stress conditions across Tomato accessions

| Gene Name | R | P | Exp. set ID | Corr. ID | Gene Name | R | P | Exp. set ID | Corr. ID |
|---|---|---|---|---|---|---|---|---|---|
| LNU329 | 0.7083 | 0.0493 | E | 28 | LNU326 | 0.8788 | 0.0041 | B | 27 |
| LNU302 | 0.7327 | 0.0387 | E | 28 | LNU330 | 0.8425 | 0.0087 | E | 27 |
| LNU357 | 0.7723 | 0.0247 | B | 31 | LNU413 | 0.7917 | 0.0192 | E | 27 |
| LNU331 | 0.8767 | 0.0043 | B | 31 | LNU302 | 0.7866 | 0.0206 | E | 27 |
| LNU383 | 0.8600 | 0.0062 | B | 31 | LNU384 | 0.7754 | 0.0238 | C | 2 |
| LNU328 | 0.8777 | 0.0042 | B | 31 | LNU342 | 0.9151 | 0.0014 | C | 2 |
| LNU357 | 0.7536 | 0.0308 | E | 31 | LNU329 | 0.7521 | 0.0314 | C | 2 |
| LNU328 | 0.7973 | 0.0178 | E | 31 | LNU336 | 0.8290 | 0.0109 | F | 2 |
| LNU310 | 0.7634 | 0.0275 | E | 31 | LNU342 | 0.9078 | 0.0018 | F | 2 |
| LNU390 | 0.8277 | 0.0059 | B | 8 | LNU328 | 0.7701 | 0.0254 | F | 2 |
| LNU411 | 0.7071 | 0.0331 | F | 12 | LNU342 | 0.7150 | 0.0462 | B | 3 |
| LNU413 | 0.7337 | 0.0245 | F | 24 | LNU384 | 0.8177 | 0.0131 | E | 3 |
| LNU413 | 0.7107 | 0.0482 | D | 9 | LNU326 | 0.7485 | 0.0128 | A | 1 |
| LNU419 | 0.7467 | 0.0208 | D | 15 | LNU411 | 0.7105 | 0.0213 | A | 1 |
| LNU419 | 0.7120 | 0.0476 | D | 21 | LNU506 | 0.7282 | 0.0169 | D | 1 |
| LNU429 | 0.7081 | 0.0328 | E | 11 | LNU342 | 0.7964 | 0.0102 | C | 38 |
| LNU429 | 0.7655 | 0.0162 | E | 17 | LNU405 | 0.7466 | 0.0208 | C | 38 |
| LNU429 | 0.7725 | 0.0147 | B | 23 | LNU342 | 0.8237 | 0.0064 | F | 38 |
| LNU429 | 0.7482 | 0.0204 | E | 14 | LNU295 | 0.7157 | 0.0301 | B | 39 |
| LNU429 | 0.7468 | 0.0208 | E | 20 | LNU342 | 0.7705 | 0.0151 | B | 39 |
| LNU442 | 0.7235 | 0.0276 | C | 10 | LNU342 | 0.7524 | 0.0193 | E | 39 |
| LNU454 | 0.8033 | 0.0091 | B | 11 | LNU328 | 0.7810 | 0.0130 | E | 39 |
| LNU454 | 0.7311 | 0.0252 | C | 16 | LNU302 | 0.8253 | 0.0062 | F | 18 |
| LNU454 | 0.8641 | 0.0027 | B | 17 | LNU302 | 0.7142 | 0.0306 | E | 17 |
| LNU454 | 0.7053 | 0.0338 | B | 8 | LNU328 | 0.7733 | 0.0145 | F | 11 |
| LNU454 | 0.8078 | 0.0084 | B | 14 | LNU330 | 0.8985 | 0.0010 | F | 16 |
| LNU454 | 0.8065 | 0.0086 | B | 20 | LNU330 | 0.7329 | 0.0247 | E | 14 |
| LNU455 | 0.7856 | 0.0121 | E | 17 | LNU357 | 0.7146 | 0.0305 | B | 8 |
| LNU455 | 0.7710 | 0.0150 | E | 14 | LNU370 | 0.7600 | 0.0175 | D | 15 |
| LNU455 | 0.8144 | 0.0075 | D | 15 | LNU370 | 0.8050 | 0.0159 | A | 21 |
| LNU455 | 0.7123 | 0.0313 | F | 22 | LNU370 | 0.7489 | 0.0325 | D | 21 |
| LNU455 | 0.7665 | 0.0160 | E | 20 | LNU375 | 0.7687 | 0.0155 | F | 24 |

TABLE 54-continued

Correlation between the expression level of selected LNU genes of some embodiments of the invention in various tissues and the phenotypic performance under low nitrogen, normal or salinity stress conditions across Tomato accessions

| Gene Name | R | P | Exp. set ID | Corr. ID | Gene Name | R | P | Exp. set ID | Corr. ID |
|---|---|---|---|---|---|---|---|---|---|
| LNU430 | 0.7661 | 0.0161 | C | 32 | LNU383 | 0.8420 | 0.0044 | E | 11 |
| LNU461 | 0.7475 | 0.0206 | F | 32 | LNU383 | 0.8489 | 0.0038 | E | 17 |
| LNU375 | 0.7001 | 0.0357 | F | 32 | LNU383 | 0.7579 | 0.0180 | E | 8 |
| LNU302 | 0.7956 | 0.0103 | F | 32 | LNU383 | 0.8014 | 0.0094 | E | 14 |
| LNU370 | 0.7836 | 0.0125 | E | 33 | LNU383 | 0.8080 | 0.0084 | E | 20 |
| LNU328 | 0.7480 | 0.0328 | B | 40 | LNU506 | 0.7019 | 0.0351 | B | 34 |
| LNU310 | 0.7821 | 0.0218 | E | 40 | LNU468 | 0.7567 | 0.0183 | B | 34 |
| LNU457 | 0.7104 | 0.0483 | E | 40 | LNU357 | 0.7732 | 0.0145 | B | 34 |
| LNU455 | 0.7766 | 0.0234 | D | 21 | LNU390 | 0.8615 | 0.0028 | B | 34 |
| LNU461 | 0.7563 | 0.0184 | E | 23 | LNU430 | 0.7132 | 0.0310 | E | 34 |
| LNU461 | 0.7072 | 0.0498 | A | 9 | LNU357 | 0.8028 | 0.0092 | B | 35 |
| LNU461 | 0.7008 | 0.0355 | F | 16 | LNU331 | 0.8319 | 0.0054 | B | 35 |
| LNU468 | 0.7215 | 0.0282 | B | 11 | LNU383 | 0.8901 | 0.0013 | B | 35 |
| LNU468 | 0.7176 | 0.0295 | E | 11 | LNU328 | 0.8573 | 0.0031 | B | 35 |
| LNU468 | 0.7581 | 0.0179 | B | 8 | LNU331 | 0.7450 | 0.0213 | E | 35 |
| LNU468 | 0.7499 | 0.0200 | E | 8 | LNU413 | 0.7913 | 0.0064 | D | 25 |
| LNU489 | 0.8607 | 0.0029 | C | 10 | LNU419 | 0.7032 | 0.0233 | D | 25 |
| LNU489 | 0.8498 | 0.0037 | C | 12 | LNU383 | 0.8065 | 0.0048 | A | 26 |
| LNU489 | 0.8379 | 0.0048 | F | 12 | LNU384 | 0.7849 | 0.0072 | D | 26 |
| LNU489 | 0.8969 | 0.0010 | F | 10 | LNU329 | 0.7535 | 0.0118 | D | 26 |
| LNU489 | 0.7049 | 0.0340 | B | 8 | LNU326 | 0.8788 | 0.0041 | C | 27 |
| LNU489 | 0.7166 | 0.0298 | F | 22 | LNU330 | 0.8425 | 0.0087 | F | 27 |
| LNU489 | 0.8254 | 0.0116 | A | 21 | LNU413 | 0.7917 | 0.0192 | F | 27 |
| LNU489 | 0.8603 | 0.0061 | D | 21 | LNU302 | 0.7866 | 0.0206 | F | 27 |
| LNU506 | 0.7567 | 0.0183 | E | 14 | LNU326 | 0.8727 | 0.0047 | B | 28 |
| LNU413 | 0.7216 | 0.0433 | E | 28 | | | | | |

Table 54.
"Corr. Set ID"—correlation set ID according to the correlated parameters Table above.

Example 11

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley Tissues—

Four tissues at different developmental stages [leaf, meristem, root tip and adventitious root], representing different plant characteristics, were sampled and RNA was extracted as described above. Each micro-array expression information tissue type has received a Set ID as summarized in Table 55 below.

TABLE 55

Barley transcriptom expression sets

| Expression Set | Set ID |
|---|---|
| Leaf/drought/reproductive | A |
| Leaf/drought/vegetative | B |
| Leaf/low N/TP3 | C |
| Leaf/normal/TP3 | D |
| Root tip/low N/TP3 | E |
| Root tip/normal/TP3 | F |
| Root tip/drought/vegetative | G |
| Root tip/recovery drought/vegetative | H |
| Adv root/low N/TP3 | I |
| Adv root/normal/TP3 | J |
| Meristem/drought/vegetative | K |

Table 55

Barley Yield Components and Vigor Related Parameters Assessment—

15 Barley accessions in 5 repetitive blocks, each containing 5 plants per pot were grown at net house. Three different treatments were applied: plants were regularly fertilized and watered during plant growth until harvesting (as recommended for commercial growth) or under low Nitrogen (80% percent less Nitrogen) or drought stress. Plants were phenotyped on a daily basis following the parameters listed in Table 56 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb (dot) nih (dot) gov/]. Next, analyzed data was saved to text files and processed using the JMP statistical analysis software (SAS institute).

Grains Number—

The total number of grains from all spikes that were manually threshed was counted. No. of grains per plot were counted.

Grain Weight (gr.)—

At the end of the experiment all spikes of the pots were collected. The total grains from all spikes that were manually threshed were weight. The grain yield was calculated by per plot.

Spike Length and Width Analysis—

At the end of the experiment the length and width of five chosen spikes per plant were measured using measuring tape excluding the awns.

Spike Number Analysis—

The spikes per plant were counted.

Plant Height—

Each of the plants was measured for its height using measuring tape. Height was measured from ground level to top of the longest spike excluding awns at two time points at the Vegetative growth (30 days after sowing) and at harvest.

Spike Weight—

The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—

The Root/Shoot Ratio is calculated using Formula XV.

Root/Shoot Ratio=total weight of the root at harvest/
total weight of the vegetative portion above
ground at harvest     Formula XV Total No. of Tillers—

All tillers were counted per plot at two time points at the Vegetative growth (30 days after sowing) and at harvest.

SPAD—

Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), Root Length (cm) and No of Lateral Roots—

3 plants per plot were selected for measurement of root weight, root length and for counting the number of lateral roots formed.

Shoot FW—

Weight of 3 plants per plot were recorded at different time-points.

Relative Water Content—

Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for Barley)—

The harvest index is calculated using Formula X above.

Relative Growth Rate:

The relative growth rate (RGR) of Plant Height (Formula XI above), Spad (Formula XVI) and number of tillers (Formula XVII) are calculated as follows:

Relative growth rate of SPAD=Regression coefficient
of SPAD measurements along time course     Formula XVI Relative growth rate of Number of
tillers=Regression coefficient of Number of tillers along time course     Formula XVII

TABLE 56

Barley correlated parameters (vectors)

| Correlation set | Correlation ID |
|---|---|
| Chlorophyll level 30DAG [SPAD] Drought | 1 |
| Chlorophyll level at TP3 [SPAD] Low N | 2 |
| Chlorophyll level at TP3 [SPAD] Normal | 3 |
| Grain yield per plant [gr.] Drought | 4 |
| Grain yield per plot [gr.] Low N | 5 |
| Grain yield per plot [gr.] Normal | 6 |
| Grain yield per plot [gr.] Normal | 7 |
| Grains per plant [number] Drought | 8 |
| Grains per plot [number] Low N | 9 |
| Grains per plot [number] Normal | 10 |
| Harvest index [number] Drought | 11 |
| Lateral roots per plant 30DAG [number] Drought | 12 |
| Lateral roots per plant at TP3 [number] Low N | 13 |
| Lateral roots per plant at TP3 [number] Normal | 14 |
| Leaf Area at TP4 [number] Low N | 15 |
| Leaf Area at TP4 [number] Normal | 16 |
| Leaf maximal length at TP4 [mm] Low N | 17 |
| Leaf maximal length at TP4 [mm] Normal | 18 |
| Leaf maximal width at TP4 [mm] Low N | 19 |
| Leaf maximal width at TP4 [mm] Normal | 20 |
| Number of leaves per plant at TP4 [number] Low N | 21 |
| Number of leaves per plant at TP4 [number] Normal | 22 |
| Plant height per plant at TP3 [cm] Low N | 23 |
| Plant height per plot at harvest [cm] Drought | 24 |
| Plant height per plot at harvest [cm] Low N | 25 |
| Plant height per plot at harvest [cm] Normal | 26 |
| Relative water content 30DAG [percent] Drought | 27 |
| Root DW per plant at harvest [gr.]/Shoot DW per plant at harvest [gr.] Drought | 28 |
| Root DW per plant at harvest [gr.] Drought | 29 |
| Root FW per plant 30DAG [gr.] Drought | 30 |
| Root FW per plant at TP3 [gr.] Low N | 31 |
| Root FW per plant at TP3 [gr.] Normal | 32 |
| Root length per plant 30DAG [cm] Drought | 33 |
| Root length per plant at TP3 [cm] Low N | 34 |
| Root length per plant at TP3 [cm] Normal | 35 |
| Shoot DW at harvest per plant [gr.] Drought | 36 |
| Shoot FW per plant at 30DAG [gr.] Drought | 37 |
| Shoot FW per plant at TP3 [gr.] Low N | 38 |
| Shoot FW per plant at TP3 [gr.] Normal | 39 |
| Spike length [cm] Drought | 40 |
| Spike length [cm] Low N | 41 |
| Spike length [cm] Normal | 42 |
| Spike width [mm] Drought | 43 |
| Spike width [mm] Low N | 44 |
| Spike width [mm] Normal | 45 |
| Spikes per plant [number] Drought | 46 |
| Spikes per plot [number] Low N | 47 |
| Spikes per plot [number] Normal | 48 |
| Spikes weight per plant [gr.] Drought | 49 |
| Spikes yield per plot [gr.] Low N | 50 |
| Spikes yield per plot [gr.] Normal | 51 |
| Tillers per plant at TP3 [number] Low N | 52 |
| Tillers per plant at harvest [number] Drought | 53 |

TABLE 56-continued

Barley correlated parameters (vectors)

| Correlation set | Correlation ID |
|---|---|
| Tillers per plot at harvest [number] Low N | 54 |
| Tillers per plot at harvest [number] Normal | 55 |
| Tillers per plant at TP3 [number] Normal | 56 |

Table 56
Provided are the barley correlated parameters,
TP means time point,
DW—dry weight,
FW—fresh weight and
Low N—Low Nitrogen.

Experimental Results 15 different Barley accessions were grown and characterized for different parameters as described above. The average for each of the measured parameter was calculated using the JMP software and values are summarized in Tables 57-60 below. Subsequent correlation analysis between the various transcriptom sets and the average parameters (Table 61) was conducted. Follow, results were integrated to the database.

TABLE 57

Measured parameters of correlation Ids in Barley accessions under low Nitrogen conditions

| Corr. ID | 2 | 4 | 6 | 9 | 11 | 13 | 15 | 31 | 50 | 53 |
|---|---|---|---|---|---|---|---|---|---|---|
| 21 | 10.0 | 8.6 | 7.5 | 7.5 | 8.0 | 8.0 | 10.0 | 11.5 | 8.5 | 6.3 |
| 17 | 152 | 124 | 112 | 124 | 108 | 103 | 135 | 149 | 142 | 95 |
| 19 | 5.2 | 5.3 | 5.1 | 5.2 | 5.2 | 5.3 | 5.1 | 5.3 | 5.3 | 5.1 |
| 13 | 6.3 | 6.7 | 4.3 | 5.7 | 6.0 | 5.0 | 7.3 | 6.0 | 6.0 | 4.7 |
| 25 | 65.8 | 53.8 | 61.4 | 81.8 | 82.0 | 41.0 | 44.6 | 47.8 | 59.4 | 56.4 |
| 23 | 22.5 | 19.7 | 17.3 | 19.2 | 18.8 | 16.3 | 19.2 | 18.2 | 26.0 | 19.8 |
| 31 | 0.88 | 0.43 | 0.12 | 0.30 | 0.23 | 0.38 | 0.55 | 0.50 | 0.40 | 0.32 |
| 34 | 22.2 | 30.5 | 22.0 | 23.8 | 21.7 | 24.7 | 24.5 | 23.0 | 21.7 | 22.8 |
| 9 | 106.0 | 219.0 | 88.2 | 202.0 | 165.0 | 230.0 | 125.0 | 223.0 | 134.0 | 143.0 |
| 5 | 6.0 | 7.4 | 3.3 | 7.8 | 7.3 | 9.8 | 6.3 | 9.7 | 5.1 | 5.8 |
| 6 | 30.3 | 37.0 | 10.8 | 35.4 | 19.8 | 46.4 | 38.3 | 54.1 | 22.6 | 42.0 |
| 38 | 0.78 | 0.45 | 0.33 | 0.50 | 0.43 | 0.43 | 0.62 | 0.53 | 0.58 | 0.43 |
| 2 | 26.6 | 25.4 | 26.5 | 25.0 | 23.3 | 24.0 | 26.1 | 23.2 | 23.9 | 24.2 |
| 41 | 90.2 | 20.4 | 16.3 | 18.8 | 19.6 | 15.2 | 16.6 | 16.4 | 19.3 | 18.8 |
| 50 | 11.3 | 12.2 | 9.2 | 12.2 | 13.4 | 13.7 | 10.6 | 15.1 | 11.6 | 10.9 |
| 44 | 9.6 | 7.1 | 9.4 | 10.0 | 8.1 | 8.0 | 9.4 | 7.2 | 4.9 | 8.5 |
| 15 | 67.8 | 52.4 | 51.5 | 68.0 | 46.3 | 39.4 | 57.9 | 64.2 | 57.1 | 46.2 |
| 47 | 7.8 | 15.0 | 11.6 | 5.4 | 9.0 | 12.2 | 8.4 | 14.5 | 25.0 | 7.0 |
| 54 | 12.5 | 21.2 | 16.0 | 6.8 | 14.6 | 16.2 | 14.0 | 18.8 | 20.8 | 11.0 |

Table 57.

TABLE 58

Measured parameters of correlation Ids in Barley accessions under normal conditions

| Corr. ID | 2 | 4 | 6 | 9 | 11 | 13 | 15 | 31 | 50 | 53 |
|---|---|---|---|---|---|---|---|---|---|---|
| 6 | 30.3 | 37.0 | 10.8 | 35.4 | 19.8 | 46.4 | 38.3 | 54.1 | 22.6 | 42.0 |
| 10 | 621 | 903 | 242 | 984 | 510 | 1090 | 768 | 1070 | 582 | 950 |
| 26 | 72.0 | 65.8 | 67.4 | 91.6 | 84.0 | 64.7 | 66.2 | 56.6 | 82.0 | 62.8 |
| 48 | 34.2 | 49.8 | 36.0 | 19.3 | 32.0 | 41.5 | 38.0 | 45.6 | 71.4 | 28.0 |
| 42 | 17.2 | 20.3 | 18.3 | 16.5 | 19.2 | 16.5 | 16.1 | 19.1 | 20.4 | 21.7 |
| 45 | 10.5 | 7.4 | 8.3 | 10.2 | 9.1 | 9.5 | 10.3 | 8.8 | 6.6 | 10.4 |
| 51 | 60.8 | 62.7 | 34.9 | 55.9 | 39.4 | 69.4 | 59.7 | 79.1 | 50.3 | 60.0 |
| 55 | 34.6 | 49.2 | 40.0 | 27.5 | 41.6 | 46.7 | 38.8 | 48.6 | 48.8 | 29.0 |
| 35 | 27.2 | 24.0 | 21.8 | 21.5 | 15.0 | 21.3 | 15.2 | 16.0 | 20.3 | 13.5 |
| 14 | 10.7 | 9.7 | 8.3 | 10.0 | 8.7 | 7.0 | 9.7 | 9.7 | 9.7 | 8.7 |
| 32 | 0.62 | 0.35 | 0.25 | 0.23 | 0.27 | 0.27 | 0.27 | 0.27 | 0.35 | 0.32 |
| 56 | 2.3 | 2.3 | 1.0 | 1.3 | 2.0 | 2.0 | 1.7 | 3.3 | 2.3 | 1.3 |
| 3 | 34.2 | 37.0 | 35.2 | 35.0 | 41.4 | 39.1 | 36.8 | 42.8 | 33.7 | 36.9 |
| 39 | 15.6 | 2.6 | 1.3 | 2.2 | 1.9 | 2.2 | 1.8 | 3.0 | 3.0 | 1.8 |
| 22 | 23.2 | 22.2 | 22.7 | 17.3 | 18.2 | 24.2 | 22.0 | 28.3 | 25.5 | 19.0 |
| 16 | 313 | 259 | 273 | 299 | 199 | 294 | 296 | 309 | 276 | 291 |
| 20 | 4.6 | 5.8 | 5.8 | 5.8 | 5.5 | 5.8 | 6.0 | 5.3 | 6.0 | 5.4 |
| 18 | 535 | 479 | 499 | 384 | 348 | 502 | 470 | 551 | 594 | 399 |

Table 58.

TABLE 59

Measured parameters of correlation Ids in Barley accessions under drought conditions

| Corr. ID | Line | | | | | | | |
|---|---|---|---|---|---|---|---|---|
| | 2 | 4 | 6 | 8 | 9 | 10 | 11 | 13 |
| 11 | 0.69 | 0.60 | 0.29 | 0.44 | 0.78 | 0.47 | 0.66 | 0.53 |
| 27 | 69.8 | 87.4 | 58.3 | 80.6 | 73.1 | 80.6 | 53.4 | 55.9 |
| 28 | 0.02 | 0.01 | 0.02 | 0.01 | 0.01 | 0.01 | 0.01 | 0.01 |
| 8 | 252 | 348 | 72 | 160 | 377 | 170 | 268 | 111 |
| 4 | 7.75 | 8.50 | 2.05 | 5.38 | 11.00 | 5.55 | 9.80 | 3.55 |
| 24 | 48.0 | 40.8 | 47.4 | 64.8 | 52.6 | 46.0 | 52.8 | 35.0 |
| 46 | 3.43 | 8.55 | 3.05 | 4.07 | 3.72 | 4.20 | 4.36 | 7.60 |
| 40 | 15.6 | 16.0 | 14.2 | 14.8 | 16.5 | 16.7 | 16.8 | 13.3 |
| 43 | 7.62 | 6.06 | 7.84 | 7.81 | 8.35 | 8.64 | 9.07 | 7.82 |
| 49 | 15.0 | 22.0 | 11.7 | 18.8 | 21.0 | 17.7 | 24.2 | 18.2 |
| 36 | 3.55 | 5.67 | 5.12 | 6.86 | 3.11 | 6.15 | 5.05 | 3.20 |
| 29 | 70.7 | 66.2 | 117.0 | 84.1 | 37.5 | 77.5 | 60.2 | 27.1 |
| 33 | 18.3 | 21.7 | 17.0 | 15.2 | 27.0 | 21.7 | 20.3 | 22.0 |
| 12 | 6.67 | 6.00 | 6.33 | 7.00 | 7.00 | 8.33 | 8.67 | 7.33 |
| 30 | 1.68 | 1.45 | 0.58 | 0.63 | 1.07 | 2.07 | 1.48 | 1.12 |
| 53 | 8.78 | 13.90 | 8.45 | 9.15 | 5.12 | 11.70 | 9.04 | 10.90 |
| 1 | 39.7 | 42.1 | 42.4 | 42.3 | 36.8 | 41.3 | 33.6 | 36.6 |
| 37 | 1.22 | 1.88 | 0.90 | 0.90 | 1.43 | 1.90 | 1.52 | 1.17 |

Table 59.

TABLE 60

Additional measured parameters of correlation IDs in Barley accessions under drought conditions

| Corr. ID | Line | | | | | | |
|---|---|---|---|---|---|---|---|
| | 15 | 31 | 38 | 50 | 53 | 93 | 13s |
| 11 | 0.53 | 0.69 | 0.75 | 0.81 | 0.87 | 0.41 | 0.69 |
| 27 | 43.2 | 45.5 | 76.5 | | | | |
| 28 | 0.03 | 0.01 | 0.01 | 0.01 | 0.02 | 0.03 | 0.01 |
| 8 | 154 | 288 | 274 | 358 | 521 | 105 | 205 |
| 4 | 5.28 | 9.92 | 10.20 | 14.00 | 17.50 | 2.56 | 7.20 |
| 24 | 45.20 | 37.70 | 41.20 | 49.90 | 43.00 | 32.00 | 38.00 |
| 46 | 4.92 | 6.90 | 5.80 | 9.67 | 5.42 | 3.21 | 8.44 |
| 40 | 14.20 | 15.70 | 17.50 | 18.30 | 17.40 | 12.70 | 13.50 |
| 43 | 8.74 | 6.98 | 8.05 | 6.72 | 9.55 | 5.47 | 7.32 |
| 49 | 19.50 | 23.40 | 28.20 | 33.00 | 34.80 | 9.88 | 18.00 |
| 36 | 4.76 | 4.52 | 3.38 | 3.31 | 2.65 | 3.74 | 3.28 |
| 29 | 117 | 37 | 26 | 22 | 41 | 99 | 19 |
| 33 | 20.7 | 21.0 | 20.3 | 19.7 | 16.7 | 15.0 | 24.0 |
| 12 | 6.67 | 7.67 | 6.67 | 8.67 | 7.67 | 6.67 | 7.67 |
| 30 | 1.67 | 1.62 | 0.85 | 1.38 | 0.82 | 0.70 | 1.87 |
| 53 | 10.30 | 13.00 | 7.44 | 11.00 | 6.78 | 16.10 | 10.20 |
| 1 | 45.10 | 38.30 | 36.20 | 31.80 | 33.50 | 40.60 | 40.50 |
| 37 | 1.90 | 1.75 | 1.58 | 1.73 | 1.00 | 0.83 | 1.95 |

Table 60.

TABLE 61

Correlation between the expression level of selected LNU genes of some embodiments of the invention in various tissues and the phenotypic performance under low nitrogen, normal or drought stress conditions across Barley accessions

| Gene Name | R | P | Exp. Set ID | Corr. ID | Gene Name | R | P | Exp. set ID | Corr. ID |
|---|---|---|---|---|---|---|---|---|---|
| LNU488 | 0.72 | 0.0462 | D | 10 | LNU322 | 0.89 | 0.0032 | B | 36 |
| LNU407 | 0.74 | 0.0371 | D | 10 | LNU436 | 0.85 | 0.0037 | K | 36 |
| LNU507 | 0.74 | 0.0349 | D | 10 | LNU425 | 0.76 | 0.0164 | K | 36 |
| LNU502 | 0.76 | 0.0174 | I | 9 | LNU436 | 0.86 | 0.0056 | G | 36 |
| LNU409 | 0.72 | 0.0293 | I | 9 | LNU435 | 0.81 | 0.0085 | K | 37 |
| LNU488 | 0.86 | 0.0014 | E | 9 | LNU305 | 0.70 | 0.0342 | H | 37 |
| LNU436 | 0.90 | 0.0004 | E | 9 | LNU407 | 0.82 | 0.0236 | A | 8 |
| LNU437 | 0.83 | 0.0030 | E | 9 | LNU502 | 0.76 | 0.0491 | A | 8 |
| LNU507 | 0.83 | 0.0030 | E | 9 | LNU466 | 0.73 | 0.0378 | G | 8 |
| LNU425 | 0.82 | 0.0067 | C | 13 | LNU448 | 0.72 | 0.0428 | G | 8 |
| LNU448 | 0.83 | 0.0028 | E | 13 | LNU448 | 0.78 | 0.0129 | H | 8 |
| LNU487 | 0.88 | 0.0008 | E | 13 | LNU487 | 0.76 | 0.0488 | A | 4 |
| LNU425 | 0.77 | 0.0251 | D | 16 | LNU502 | 0.84 | 0.0176 | A | 4 |
| LNU467 | 0.79 | 0.0207 | D | 16 | LNU297 | 0.71 | 0.0312 | K | 4 |
| LNU472 | 0.82 | 0.0063 | C | 17 | LNU466 | 0.71 | 0.0477 | G | 4 |
| LNU435 | 0.81 | 0.0155 | D | 18 | LNU448 | 0.71 | 0.0306 | H | 4 |
| LNU407 | 0.87 | 0.0026 | J | 3 | LNU437 | 0.73 | 0.0262 | H | 4 |
| LNU466 | 0.80 | 0.0099 | J | 3 | LNU502 | 0.85 | 0.0165 | A | 11 |
| LNU425 | 0.82 | 0.0072 | J | 3 | LNU466 | 0.72 | 0.0457 | G | 11 |

TABLE 61-continued

Correlation between the expression level of selected LNU genes of some embodiments of the invention in various tissues and the phenotypic performance under low nitrogen, normal or drought stress conditions across Barley accessions

| Gene Name | R | P | Exp. Set ID | Corr. ID | Gene Name | R | P | Exp. set ID | Corr. ID |
|---|---|---|---|---|---|---|---|---|---|
| LNU507 | 0.75 | 0.0328 | D | 3 | LNU437 | 0.73 | 0.0269 | H | 11 |
| LNU407 | 0.72 | 0.0420 | F | 3 | LNU391 | 0.76 | 0.0483 | A | 12 |
| LNU466 | 0.73 | 0.0408 | F | 3 | LNU499 | 0.81 | 0.0286 | A | 24 |
| LNU488 | 0.83 | 0.0058 | I | 19 | LNU322 | 0.77 | 0.0426 | A | 24 |
| LNU391 | 0.75 | 0.0206 | I | 19 | LNU322 | 0.78 | 0.0235 | B | 24 |
| LNU408 | 0.83 | 0.0054 | I | 19 | LNU436 | 0.85 | 0.0080 | B | 24 |
| LNU488 | 0.85 | 0.0040 | C | 19 | LNU437 | 0.76 | 0.0274 | B | 24 |
| LNU407 | 0.78 | 0.0130 | C | 19 | LNU507 | 0.79 | 0.0199 | B | 24 |
| LNU436 | 0.72 | 0.0284 | C | 19 | LNU472 | 0.74 | 0.0217 | K | 24 |
| LNU425 | 0.78 | 0.0081 | E | 19 | LNU409 | 0.72 | 0.0300 | K | 24 |
| LNU507 | 0.70 | 0.0340 | I | 21 | LNU499 | 0.81 | 0.0154 | G | 24 |
| LNU425 | 0.76 | 0.0175 | C | 21 | LNU436 | 0.77 | 0.0262 | G | 24 |
| LNU425 | 0.77 | 0.0089 | E | 21 | LNU437 | 0.74 | 0.0352 | G | 24 |
| LNU435 | 0.76 | 0.0182 | J | 22 | LNU409 | 0.74 | 0.0356 | G | 24 |
| LNU435 | 0.88 | 0.0036 | D | 22 | LNU407 | 0.90 | 0.0061 | A | 28 |
| LNU456 | 0.80 | 0.0173 | D | 22 | LNU425 | 0.86 | 0.0129 | A | 28 |
| LNU436 | 0.71 | 0.0468 | F | 22 | LNU447 | 0.83 | 0.0199 | A | 28 |
| LNU322 | 0.77 | 0.0148 | I | 23 | LNU409 | 0.85 | 0.0163 | A | 28 |
| LNU436 | 0.75 | 0.0187 | C | 23 | LNU425 | 0.84 | 0.0083 | B | 28 |
| LNU472 | 0.73 | 0.0260 | C | 23 | LNU456 | 0.80 | 0.0165 | B | 28 |
| LNU425 | 0.86 | 0.0014 | E | 23 | LNU408 | 0.73 | 0.0412 | G | 28 |
| LNU437 | 0.74 | 0.0235 | C | 25 | LNU425 | 0.84 | 0.0099 | G | 28 |
| LNU467 | 0.82 | 0.0131 | D | 26 | LNU322 | 0.82 | 0.0069 | H | 28 |
| LNU322 | 0.72 | 0.0445 | F | 26 | LNU407 | 0.80 | 0.0313 | H | 27 |
| LNU436 | 0.79 | 0.0206 | F | 26 | LNU448 | 0.88 | 0.0093 | A | 29 |
| LNU436 | 0.79 | 0.0109 | I | 31 | LNU305 | 0.76 | 0.0293 | B | 29 |
| LNU487 | 0.76 | 0.0176 | I | 31 | LNU322 | 0.76 | 0.0284 | B | 29 |
| LNU438 | 0.80 | 0.0097 | C | 31 | LNU456 | 0.79 | 0.0195 | B | 29 |
| LNU425 | 0.86 | 0.0030 | C | 31 | LNU507 | 0.77 | 0.0244 | B | 29 |
| LNU472 | 0.74 | 0.0216 | C | 31 | LNU409 | 0.87 | 0.0049 | B | 29 |
| LNU502 | 0.72 | 0.0303 | C | 31 | LNU408 | 0.73 | 0.0389 | G | 29 |
| LNU437 | 0.78 | 0.0135 | J | 32 | LNU438 | 0.85 | 0.0075 | G | 29 |
| LNU499 | 0.79 | 0.0186 | D | 32 | LNU456 | 0.72 | 0.0456 | G | 29 |
| LNU425 | 0.72 | 0.0428 | F | 32 | LNU409 | 0.76 | 0.0290 | G | 29 |
| LNU466 | 0.79 | 0.0067 | E | 34 | LNU407 | 0.71 | 0.0334 | H | 29 |
| LNU436 | 0.79 | 0.0063 | E | 34 | LNU438 | 0.74 | 0.0361 | B | 30 |
| LNU437 | 0.76 | 0.0170 | J | 35 | LNU305 | 0.70 | 0.0347 | H | 30 |
| LNU437 | 0.74 | 0.0364 | F | 35 | LNU438 | 0.73 | 0.0411 | B | 33 |
| LNU436 | 0.76 | 0.0184 | I | 38 | LNU447 | 0.73 | 0.0245 | H | 33 |
| LNU425 | 0.71 | 0.0324 | I | 38 | LNU305 | 0.74 | 0.0364 | G | 40 |
| LNU472 | 0.80 | 0.0096 | I | 38 | LNU305 | 0.78 | 0.0376 | A | 46 |
| LNU438 | 0.79 | 0.0107 | C | 38 | LNU499 | 0.82 | 0.0129 | B | 46 |
| LNU425 | 0.76 | 0.0185 | C | 38 | LNU467 | 0.73 | 0.0415 | B | 46 |
| LNU472 | 0.76 | 0.0176 | C | 38 | LNU502 | 0.80 | 0.0180 | B | 46 |
| LNU502 | 0.79 | 0.0121 | C | 38 | LNU472 | 0.87 | 0.0022 | H | 46 |
| LNU437 | 0.82 | 0.0068 | J | 39 | LNU502 | 0.88 | 0.0092 | A | 49 |
| LNU499 | 0.83 | 0.0105 | D | 39 | LNU502 | 0.80 | 0.0167 | B | 49 |
| LNU425 | 0.72 | 0.0294 | I | 41 | LNU297 | 0.82 | 0.0074 | K | 49 |
| LNU438 | 0.81 | 0.0082 | C | 41 | LNU437 | 0.71 | 0.0311 | H | 49 |
| LNU425 | 0.78 | 0.0139 | C | 41 | LNU466 | 0.88 | 0.0090 | A | 43 |
| LNU487 | 0.70 | 0.0351 | C | 41 | LNU425 | 0.82 | 0.0228 | A | 43 |
| LNU502 | 0.86 | 0.0027 | C | 41 | LNU447 | 0.80 | 0.0313 | A | 43 |
| LNU448 | 0.78 | 0.0213 | D | 42 | LNU409 | 0.80 | 0.0296 | A | 43 |
| LNU487 | 0.72 | 0.0455 | D | 42 | LNU305 | 0.77 | 0.0244 | B | 43 |
| LNU305 | 0.77 | 0.0143 | I | 44 | LNU507 | 0.74 | 0.0356 | B | 43 |
| LNU487 | 0.76 | 0.0185 | I | 44 | LNU391 | 0.72 | 0.0302 | K | 43 |
| LNU499 | 0.79 | 0.0203 | D | 45 | LNU488 | 0.83 | 0.0110 | B | 53 |
| LNU425 | 0.72 | 0.0437 | D | 45 | LNU435 | 0.85 | 0.0036 | K | 53 |
| LNU436 | 0.81 | 0.0080 | C | 47 | LNU467 | 0.84 | 0.0050 | K | 53 |
| LNU322 | 0.87 | 0.0024 | J | 48 | LNU467 | 0.79 | 0.0193 | G | 53 |
| LNU488 | 0.76 | 0.0284 | D | 48 | LNU435 | 0.73 | 0.0271 | H | 53 |
| LNU407 | 0.77 | 0.0269 | D | 48 | LNU456 | 0.83 | 0.0053 | C | 2 |
| LNU425 | 0.77 | 0.0256 | D | 48 | LNU407 | 0.85 | 0.0038 | I | 5 |
| LNU437 | 0.86 | 0.0067 | D | 48 | LNU435 | 0.80 | 0.0099 | I | 5 |
| LNU437 | 0.79 | 0.0198 | F | 48 | LNU408 | 0.80 | 0.0100 | I | 5 |
| LNU436 | 0.72 | 0.0289 | J | 48 | LNU467 | 0.86 | 0.0033 | I | 5 |
| LNU487 | 0.71 | 0.0498 | D | 48 | LNU502 | 0.86 | 0.0027 | I | 5 |
| LNU435 | 0.70 | 0.0350 | I | 50 | LNU409 | 0.78 | 0.0134 | I | 5 |
| LNU408 | 0.76 | 0.0177 | I | 50 | LNU466 | 0.71 | 0.0315 | C | 5 |
| LNU438 | 0.72 | 0.0302 | I | 50 | LNU391 | 0.73 | 0.0250 | C | 5 |
| LNU467 | 0.79 | 0.0106 | I | 50 | LNU507 | 0.71 | 0.0308 | C | 5 |
| LNU507 | 0.73 | 0.0243 | I | 50 | LNU322 | 0.77 | 0.0095 | E | 5 |

TABLE 61-continued

Correlation between the expression level of selected LNU genes of some embodiments of the invention in various tissues and the phenotypic performance under low nitrogen, normal or drought stress conditions across Barley accessions

| Gene Name | R | P | Exp. Set ID | Corr. ID | Gene Name | R | P | Exp. set ID | Corr. ID |
|---|---|---|---|---|---|---|---|---|---|
| LNU466 | 0.78 | 0.0123 | C | 50 | LNU436 | 0.81 | 0.0046 | E | 5 |
| LNU391 | 0.81 | 0.0081 | C | 50 | LNU437 | 0.76 | 0.0107 | E | 5 |
| LNU437 | 0.72 | 0.0191 | E | 50 | LNU502 | 0.72 | 0.0186 | E | 5 |
| LNU408 | 0.75 | 0.0201 | J | 51 | LNU408 | 0.71 | 0.0327 | J | 6 |
| LNU507 | 0.73 | 0.0409 | D | 51 | LNU507 | 0.77 | 0.0251 | D | 6 |
| LNU488 | 0.73 | 0.0387 | F | 51 | LNU407 | 0.84 | 0.0046 | I | 9 |
| LNU488 | 0.72 | 0.0284 | I | 52 | LNU435 | 0.78 | 0.0134 | I | 9 |
| LNU467 | 0.73 | 0.0269 | J | 56 | LNU408 | 0.88 | 0.0016 | I | 9 |
| LNU488 | 0.71 | 0.0484 | D | 56 | LNU438 | 0.86 | 0.0030 | I | 9 |
| LNU407 | 0.72 | 0.0451 | D | 56 | LNU467 | 0.79 | 0.0114 | I | 9 |
| LNU437 | 0.72 | 0.0452 | D | 56 | LNU408 | 0.81 | 0.0082 | J | 10 |
| LNU436 | 0.74 | 0.0343 | F | 56 | LNU438 | 0.72 | 0.0271 | J | 10 |

Table 61.

Example 12

Production of Maize Transcriptom and High Throughput Correlation Analysis with Yield and NUE Related Parameters Using 44K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Low Nitrogen Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize Tissues—

All 10 selected maize hybrids were sample per each treatment. Plant tissues [flag leaf, flower meristem, grain, ear and internode] growing under Normal conditions were sampled and RNA was extracted as described above. Each micro-array expression information tissue type has received a Set ID as summarized in Table 62 below.

TABLE 62

Maize transcriptom expression sets

| Expression Set | Set ID |
|---|---|
| Maize field/Low/N/Ear/TP5 | A |
| Maize field/Low/N/Ear/TP6 | B |
| Maize field/Low/N/Internodes/TP2 | C |
| Maize field/Low/N/Internodes/TP5 | D |
| Maize field/Low/N/Leaf/TP5 | E |
| Maize field/Low/N/Leaf/TP6 | F |
| Maize field/Normal/Ear/R1-R2 | G |
| Maize field/Normal/Grain/Distal/R4-R5 | H |
| Maize field/Normal/Internode/R3-R4 | J |
| Maize field/Normal/Internode/V6-V8 | K |
| Maize field/Normal/Leaf/R1-R2 | L |
| Maize field/Normal/Leaf/V6-V8 | M |
| Maize field/Low/N/Internodes/TP6 | N |

Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected using digital imaging system:

Grain Area ($cm^2$)—

At the end of the growing period the grains were separated from the ear. A sample of ~200 grains were weighted, photographed and images were processed using the below described image processing system. The grain area was measured from those images and was divided by the number of grains.

Grain Length and Grain Width (cm)—

At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—

At the end of the growing period 5 ears were, photographed and images were processed using the below described image processing system. The Ear area was measured from those images and was divided by the number of Ears.

Ear Length and Ear Width (cm)—

At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight Per Plant (gr.)—

At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—

At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—

Plants were characterized for height at harvesting. In each measure, 6 plants were measured for their height using a measuring tape. Height was measured from ground level to top of the plant below the tassel. Ear height was measured from the ground level to the place were the main ear is located.

Leaf Number Per Plant—

Plants were characterized for leaf number during growing period at 5 time points. In each measure, plants were measured for their leaf number by counting all the leaves of 3 selected plants per plot.

Relative Growth Rate

Was calculated using Formulas XI and XII (described above).

SPAD—

Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry Weight Per Plant—

At the end of the experiment (when Inflorescence were dry) all vegetative material from plots within blocks A-C were collected.

Dry weight=total weight of the vegetative portion above ground (excluding roots) after drying at 70° C. in oven for 48 hours;

Harvest Index (HI) (Maize)—

The harvest index was calculated using Formula XIV.

Percent Filled Ear [%]—

It was calculated as the percentage of the Ear area with grains out of the total ear.

Cob Diameter [cm]—

The diameter of the cob without grains was measured using a ruler.

Kernel Row Number Per Ear—

The number of rows in each ear was counted.

Experimental Results 11 different maize hybrids were grown and characterized for different parameters: The average for each of the measured parameter was calculated using the JMP software (Tables 63-65) and a subsequent correlation analysis was performed (Tables 66-67). Results were then integrated to the database.

TABLE 63

Maize correlated parameters (vectors)

| Correlation set | Correlation ID |
|---|---|
| Ear Length [cm] Low N | 1 |
| Ear Length [cm] Normal | 2 |
| Ear Length of filled area [cm] Low N | 3 |
| Ear Length of filled area [cm] Normal | 4 |
| Ear width [mm] Low N | 5 |
| Ear width [mm] Normal | 6 |
| Ears weight per plot [kg] Low N | 7 |
| Ears weight per plot [kg] Normal | 8 |
| Final Leaf Area [number] Low N | 9 |
| Final Leaf Area [number] Normal | 10 |
| Final Leaf Number [number] Low N | 11 |
| Final Leaf Number [number] Normal | 12 |
| Final Main Ear Height [cm] Low N | 13 |
| Final Main Ear Height [cm] Normal | 14 |
| Final Plant DW [kg] Low N | 15 |
| Final Plant DW [kg] Normal | 16 |
| Final Plant Height [cm] Low N | 17 |
| Final Plant Height [cm] Normal | 18 |
| No of rows per ear [number] Low N | 19 |
| No of rows per ear [number] Normal | 20 |
| NUE at early grain filling [R1-R2] yield kg/N in plant per SPAD Low N | 21 |
| NUE at early grain filling [R1-R2] yield kg/N in plant per SPAD Normal | 22 |
| NUE at grain filling [R3-R4] yield kg/N in plant per SPAD Low N | 23 |
| NUE at grain filling [R3-R4] yield kg/N in plant per SPAD Normal | 24 |
| NUE yield kg/N applied in soil kg Low N | 25 |
| NUE yield kg/N applied in soil kg Normal | 26 |
| NUpE [biomass/N applied] Low N | 27 |
| NUpE [biomass/N applied] Normal | 28 |
| Seed yield per dunam [kg] Low N | 29 |
| Seed yield per dunam [kg] Normal | 30 |
| seed yield per plant [kg] Normal | 31 |
| seed yield per plant [kg] Low N | 32 |
| SPAD at R1-R2 [number] Low N | 33 |
| SPAD at R1-R2 [number] Normal | 34 |
| SPAD at R3-R4 [number] Low N | 35 |
| SPAD at R3-R4 [number] Normal | 36 |
| Stalk width at TP5 Normal | 37 |
| Stalk width at TP5 Low N | 38 |
| Yield/LAI Low N | 39 |
| Yield/LAI Normal | 40 |
| Yield/stalk width Normal | 41 |
| Yield/stalk width Low N | 42 |

SPAD at R1-R2 and SPAD R3-R4: Chlorophyl level after early and late stages of grain filling,
NUE—nitrogen use efficiency,
NUpE—nitrogen uptake efficiency,
LAI—leaf area,
Low N—Low Nitrogen.

TABLE 64

Measured parameters in Maize accessions under normal conditions

| Corr. ID/ Line | 1 | 2 | 3 | 4 | 5 | 6 | 7 | 8 | 9 | 10 | 11 |
|---|---|---|---|---|---|---|---|---|---|---|---|
| 16 | 1.27 | 1.30 | 1.33 | 1.50 | 1.30 | 1.58 | 1.42 | 1.37 | 1.70 | 11.40 | 0.42 |
| 8 | 8.94 | 7.02 | 7.53 | 7.99 | 8.48 | 5.63 | 6.10 | 6.66 | 8.21 | 8.40 | 1.88 |
| 31 | 0.17 | 0.14 | 0.15 | 0.16 | 0.15 | 0.12 | 0.12 | 0.13 | 0.15 | 0.17 | 0.04 |
| 30 | 1340 | 1090 | 1200 | 1270 | 1200 | 937 | 986 | 1050 | 1230 | 1370 | 301 |
| 18 | 273 | 260 | 288 | 238 | 287 | 225 | 264 | 252 | 279 | 278 | 164 |
| 14 | 130.0 | 122.0 | 128.0 | 113.0 | 135.0 | 94.3 | 121.0 | 108.0 | 140.0 | 112.0 | 60.4 |
| 12 | 11.8 | 11.1 | 13.3 | 11.8 | 11.9 | 12.3 | 12.4 | 12.2 | 11.7 | 12.6 | 9.3 |
| 37 | 2.9 | 2.6 | 2.7 | 2.9 | 2.7 | 2.6 | 2.9 | 2.7 | 2.7 | 2.8 | 2.3 |
| 2 | 19.9 | 20.2 | 18.1 | 19.9 | 19.5 | 17.7 | 17.7 | 17.3 | 17.5 | 20.5 | 19.9 |
| 6 | 51.1 | 46.3 | 45.9 | 47.6 | 51.4 | 47.4 | 47.3 | 46.8 | 48.3 | 49.3 | 41.8 |
| 4 | 16.2 | 17.5 | 17.7 | 18.4 | 15.7 | 14.7 | 12.9 | 14.0 | 12.3 | 18.8 | 16.1 |
| 20 | 16.1 | 14.7 | 15.4 | 15.9 | 16.2 | 15.2 | 16.0 | 14.8 | 17.7 | 15.4 | 14.3 |
| 34 | 56.9 | 57.2 | 59.3 | 61.6 | 58.6 | 61.2 | 60.2 | 61.1 | 57.5 | 62.2 | 52.0 |
| 36 | 59.9 | 60.9 | 56.9 | 58.7 | 58.7 | 63.2 | 59.8 | 62.4 | 57.2 | 61.9 | 49.3 |
| 26 | 4.5 | 3.6 | 4.0 | 4.2 | 4.0 | 3.1 | 3.3 | 3.5 | 4.1 | 4.6 | 1.0 |
| 24 | 25.0 | 17.8 | 20.3 | 20.0 | 19.0 | 13.9 | 16.2 | 17.2 | 21.5 | 21.0 | 5.5 |
| 22 | 23.4 | 19.1 | 20.3 | 20.7 | 20.5 | 15.4 | 16.4 | 17.2 | 21.0 | 22.0 | 5.7 |
| 41 | 457 | 412 | 443 | 439 | 447 | 357 | 337 | 386 | 472 | 482 | 140 |
| 28 | 0.008 | 0.009 | 0.009 | 0.010 | 0.009 | 0.011 | 0.009 | 0.009 | 0.004 | 0.076 | 0.003 |
| 10 | 3.2 | 4.0 | 3.3 | 4.0 | 3.9 | 4.2 | 4.0 | 4.3 | 4.3 | 2.9 | |
| 40 | 426 | 313 | 307 | 362 | 314 | 225 | 266 | 262 | | 482 | |

Table 64. Provided are the values of each of the parameters (as described above) measured in maize accessions (Seed ID) under regular growth conditions. Growth conditions are specified in the experimental procedure section.

TABLE 65

Additional measured parameters in Maize accessions under low Nitrogen conditions

| Corr. ID/ Line | 1 | 2 | 3 | 4 | 5 | 6 | 7 | 8 | 9 | 10 | 11 |
|---|---|---|---|---|---|---|---|---|---|---|---|
| 15 | 1.59 | 1.43 | 1.53 | 1.95 | 1.48 | 1.60 | 1.58 | 1.28 | 1.51 | 1.52 | 0.43 |
| 7 | 6.61 | 7.97 | 9.63 | 9.22 | 7.63 | 7.21 | 7.92 | 29.00 | 7.80 | 9.78 | 2.41 |
| 32 | 0.14 | 0.16 | 0.19 | 0.19 | 0.14 | 0.15 | 0.15 | 0.14 | 0.14 | 0.20 | 0.05 |
| 29 | 1080 | 1260 | 1550 | 1500 | 1140 | 1160 | 1210 | 1250 | 1150 | 1590 | 383 |
| 17 | 306 | 271 | 291 | 252 | 260 | 227 | 272 | 249 | 279 | 270 | 171 |
| 13 | 158 | 136 | 128 | 133 | 138 | 100 | 130 | 115 | 144 | 114 | 62 |
| 11 | 15.0 | 11.6 | 13.5 | 11.6 | 11.8 | 11.9 | 12.6 | 11.7 | 12.4 | 13.2 | 9.3 |
| 38 | 2.8 | 2.4 | 2.7 | 2.8 | 2.7 | 2.6 | 3.0 | 2.6 | 2.7 | 2.8 | 2.3 |
| 1 | 20.6 | 21.0 | 20.2 | 20.1 | 20.1 | 18.5 | 19.1 | 18.2 | 20.1 | 21.2 | 17.8 |
| 5 | 46.7 | 48.2 | 48.3 | 49.9 | 52.9 | 47.4 | 49.6 | 48.6 | 52.4 | 50.0 | 42.6 |
| 3 | 18.4 | 18.4 | 19.8 | 18.8 | 16.2 | 16.0 | 15.3 | 15.7 | 16.8 | 19.6 | 14.1 |
| 19 | 14.2 | 15.2 | 15.0 | 15.7 | 16.0 | 15.9 | 15.6 | 14.5 | 16.4 | 15.7 | 14.4 |
| 33 | 60.2 | 57.9 | 58.8 | 59.5 | 58.5 | 64.0 | 56.4 | 60.0 | 58.3 | 61.7 | 53.1 |
| 35 | 59.3 | 57.6 | 58.4 | 59.2 | 58.2 | 62.7 | 61.0 | 59.9 | 57.5 | 61.9 | 49.6 |
| 25 | 7.2 | 8.4 | 10.3 | 10.0 | 7.6 | 7.7 | 8.1 | 8.3 | 7.6 | 10.6 | 2.6 |
| 23 | 18.4 | 21.9 | 26.5 | 25.3 | 19.7 | 18.5 | 19.8 | 20.9 | 19.9 | 25.9 | 7.7 |
| 21 | 18.0 | 21.8 | 26.3 | 25.1 | 19.5 | 18.0 | 21.4 | 20.8 | 19.7 | 25.7 | 7.2 |
| 42 | 417 | 528 | 583 | 541 | 428 | 444 | 407 | 477 | 446 | 562 | 168 |
| 27 | 0.011 | 0.010 | 0.010 | 0.013 | 0.010 | 0.011 | 0.011 | 0.009 | 0.010 | 0.010 | 0.003 |
| 9 | 2.92 | 3.15 | 3.33 | 2.87 | 2.79 | 3.76 | 3.50 | 5.02 | | 3.16 | |
| 39 | 342 | 408 | 465 | 522 | 440 | 313 | 346 | 288 | | 501 | |

Table 65. Provided are the values of each of the parameters (as described above) measured in maize accessions (Seed ID) under regular growth conditions. Growth conditions are specified in the experimental procedure section.

TABLE 66

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU469 | 0.86 | 0.0135 | A | 21 | LNU476 | 0.90 | 0.0060 | G | 41 |
| LNU469 | 0.76 | 0.0289 | E | 21 | LNU476 | 0.72 | 0.0191 | M | 41 |
| LNU476 | 0.90 | 0.0054 | G | 22 | LNU519 | 0.78 | 0.0225 | B | 40 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU476 | 0.74 | 0.0152 | M | 22 | LNU519 | 0.76 | 0.0291 | H | 41 |
| LNU519 | 0.79 | 0.0205 | H | 22 | LNU519 | 0.83 | 0.0220 | I | 41 |
| LNU519 | 0.79 | 0.0337 | I | 22 | LNU299 | 0.73 | 0.0248 | N | 1 |
| LNU519 | 0.82 | 0.0120 | B | 21 | LNU299 | 0.83 | 0.0102 | F | 1 |
| LNU299 | 0.90 | 0.0065 | A | 23 | LNU311 | 0.82 | 0.0244 | A | 1 |
| LNU299 | 0.80 | 0.0175 | B | 23 | LNU317 | 0.82 | 0.0250 | A | 1 |
| LNU299 | 0.87 | 0.0011 | C | 23 | LNU348 | 0.88 | 0.0019 | K | 2 |
| LNU299 | 0.91 | 0.0020 | F | 23 | LNU394 | 0.79 | 0.0202 | E | 1 |
| LNU300 | 0.77 | 0.0433 | A | 23 | LNU394 | 0.88 | 0.0039 | B | 1 |
| LNU300 | 0.80 | 0.0172 | B | 23 | LNU418 | 0.74 | 0.0343 | H | 2 |
| LNU300 | 0.72 | 0.0428 | F | 23 | LNU418 | 0.87 | 0.0103 | A | 1 |
| LNU301 | 0.78 | 0.0381 | A | 23 | LNU460 | 0.89 | 0.0030 | F | 1 |
| LNU301 | 0.79 | 0.0202 | B | 23 | LNU469 | 0.85 | 0.0143 | A | 1 |
| LNU307 | 0.80 | 0.0058 | C | 23 | LNU469 | 0.79 | 0.0202 | E | 1 |
| LNU307 | 0.79 | 0.0116 | N | 23 | LNU476 | 0.85 | 0.0073 | E | 1 |
| LNU307 | 0.83 | 0.0103 | E | 23 | LNU519 | 0.72 | 0.0420 | J | 2 |
| LNU307 | 0.72 | 0.0437 | F | 23 | LNU299 | 0.81 | 0.0149 | F | 3 |
| LNU339 | 0.89 | 0.0074 | A | 23 | LNU317 | 0.88 | 0.0097 | A | 3 |
| LNU339 | 0.74 | 0.0351 | E | 23 | LNU339 | 0.89 | 0.0070 | A | 3 |
| LNU348 | 0.91 | 0.0018 | F | 23 | LNU348 | 0.76 | 0.0296 | F | 3 |
| LNU360 | 0.80 | 0.0166 | E | 23 | LNU376 | 0.71 | 0.0486 | F | 3 |
| LNU361 | 0.78 | 0.0387 | A | 23 | LNU394 | 0.75 | 0.0129 | M | 4 |
| LNU361 | 0.72 | 0.0438 | E | 23 | LNU394 | 0.82 | 0.0130 | E | 3 |
| LNU371 | 0.80 | 0.0300 | A | 23 | LNU394 | 0.84 | 0.0181 | A | 3 |
| LNU376 | 0.75 | 0.0316 | F | 23 | LNU394 | 0.76 | 0.0300 | F | 3 |
| LNU394 | 0.74 | 0.0348 | E | 23 | LNU394 | 0.86 | 0.0065 | B | 3 |
| LNU394 | 0.76 | 0.0459 | A | 23 | LNU418 | 0.82 | 0.0251 | A | 3 |
| LNU394 | 0.84 | 0.0085 | B | 23 | LNU460 | 0.78 | 0.0220 | F | 3 |
| LNU459 | 0.82 | 0.0124 | F | 23 | LNU469 | 0.88 | 0.0086 | G | 4 |
| LNU469 | 0.84 | 0.0180 | A | 23 | LNU469 | 0.71 | 0.0313 | K | 4 |
| LNU469 | 0.77 | 0.0265 | E | 23 | LNU469 | 0.79 | 0.0337 | L | 4 |
| LNU476 | 0.71 | 0.0478 | F | 23 | LNU469 | 0.79 | 0.0353 | A | 3 |
| LNU519 | 0.78 | 0.0215 | B | 23 | LNU469 | 0.72 | 0.0436 | F | 3 |
| LNU300 | 0.90 | 0.0051 | G | 24 | LNU519 | 0.70 | 0.0353 | K | 4 |
| LNU307 | 0.88 | 0.0089 | G | 24 | LNU299 | 0.89 | 0.0072 | A | 5 |
| LNU307 | 0.83 | 0.0206 | I | 24 | LNU299 | 0.88 | 0.0042 | B | 5 |
| LNU307 | 0.84 | 0.0044 | K | 24 | LNU299 | 0.77 | 0.0089 | C | 5 |
| LNU307 | 0.78 | 0.0388 | L | 24 | LNU299 | 0.82 | 0.0125 | E | 5 |
| LNU311 | 0.80 | 0.0321 | G | 24 | LNU299 | 0.89 | 0.0032 | F | 5 |
| LNU311 | 0.76 | 0.0280 | H | 24 | LNU300 | 0.91 | 0.0043 | A | 5 |
| LNU332 | 0.72 | 0.0419 | H | 24 | LNU300 | 0.88 | 0.0044 | B | 5 |
| LNU332 | 0.84 | 0.0172 | I | 24 | LNU300 | 0.75 | 0.0126 | C | 5 |
| LNU348 | 0.89 | 0.0071 | I | 24 | LNU300 | 0.71 | 0.0463 | E | 5 |
| LNU359 | 0.82 | 0.0231 | G | 24 | LNU301 | 0.88 | 0.0083 | A | 5 |
| LNU360 | 0.87 | 0.0101 | L | 24 | LNU301 | 0.78 | 0.0228 | B | 5 |
| LNU361 | 0.79 | 0.0360 | G | 24 | LNU307 | 0.77 | 0.0425 | A | 5 |
| LNU361 | 0.76 | 0.0300 | H | 24 | LNU307 | 0.82 | 0.0121 | B | 5 |
| LNU371 | 0.74 | 0.0341 | H | 24 | LNU307 | 0.73 | 0.0171 | C | 5 |
| LNU394 | 0.84 | 0.0172 | G | 24 | LNU307 | 0.77 | 0.0144 | N | 5 |
| LNU460 | 0.76 | 0.0472 | G | 24 | LNU307 | 0.83 | 0.0105 | E | 5 |
| LNU476 | 0.87 | 0.0103 | G | 24 | LNU307 | 0.82 | 0.0119 | F | 5 |
| LNU476 | 0.72 | 0.0200 | M | 24 | LNU332 | 0.84 | 0.0083 | B | 5 |
| LNU519 | 0.74 | 0.0370 | H | 24 | LNU339 | 0.76 | 0.0487 | A | 5 |
| LNU299 | 0.91 | 0.0042 | A | 24 | LNU339 | 0.76 | 0.0293 | E | 5 |
| LNU299 | 0.85 | 0.0080 | B | 24 | LNU348 | 0.85 | 0.0072 | F | 5 |
| LNU299 | 0.89 | 0.0007 | C | 24 | LNU359 | 0.91 | 0.0049 | A | 5 |
| LNU299 | 0.72 | 0.0273 | N | 24 | LNU359 | 0.73 | 0.0379 | B | 5 |
| LNU299 | 0.76 | 0.0271 | E | 24 | LNU360 | 0.77 | 0.0440 | A | 5 |
| LNU299 | 0.91 | 0.0016 | F | 24 | LNU360 | 0.82 | 0.0128 | E | 5 |
| LNU300 | 0.82 | 0.0248 | A | 24 | LNU361 | 0.79 | 0.0359 | A | 5 |
| LNU300 | 0.85 | 0.0080 | B | 24 | LNU361 | 0.72 | 0.0419 | E | 5 |
| LNU300 | 0.71 | 0.0487 | F | 24 | LNU371 | 0.78 | 0.0382 | A | 5 |
| LNU301 | 0.79 | 0.0354 | A | 24 | LNU371 | 0.75 | 0.0117 | C | 5 |
| LNU301 | 0.81 | 0.0137 | B | 24 | LNU371 | 0.76 | 0.0293 | E | 5 |
| LNU307 | 0.77 | 0.0408 | A | 24 | LNU394 | 0.77 | 0.0242 | B | 5 |
| LNU307 | 0.73 | 0.0395 | B | 24 | LNU459 | 0.87 | 0.0046 | F | 5 |
| LNU307 | 0.77 | 0.0088 | C | 24 | LNU460 | 0.91 | 0.0044 | A | 5 |
| LNU307 | 0.76 | 0.0168 | N | 24 | LNU460 | 0.72 | 0.0424 | B | 5 |
| LNU307 | 0.86 | 0.0060 | E | 24 | LNU469 | 0.81 | 0.0285 | A | 5 |
| LNU307 | 0.74 | 0.0343 | F | 24 | LNU469 | 0.82 | 0.0118 | E | 5 |
| LNU339 | 0.85 | 0.0164 | A | 24 | LNU519 | 0.85 | 0.0081 | B | 5 |
| LNU339 | 0.74 | 0.0365 | E | 24 | LNU299 | 0.90 | 0.0025 | H | 6 |
| LNU348 | 0.88 | 0.0044 | F | 24 | LNU299 | 0.84 | 0.0047 | K | 6 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU360 | 0.83 | 0.0113 | E | 24 | LNU301 | 0.76 | 0.0486 | G | 6 |
| LNU361 | 0.79 | 0.0344 | A | 24 | LNU301 | 0.79 | 0.0202 | H | 6 |
| LNU361 | 0.76 | 0.0277 | E | 24 | LNU307 | 0.85 | 0.0164 | G | 6 |
| LNU371 | 0.83 | 0.0217 | A | 24 | LNU311 | 0.91 | 0.0016 | H | 6 |
| LNU371 | 0.72 | 0.0294 | N | 24 | LNU332 | 0.92 | 0.0014 | H | 6 |
| LNU376 | 0.71 | 0.0463 | B | 24 | LNU348 | 0.77 | 0.0419 | I | 6 |
| LNU376 | 0.73 | 0.0408 | F | 24 | LNU359 | 0.89 | 0.0066 | G | 6 |
| LNU394 | 0.74 | 0.0367 | E | 24 | LNU361 | 0.86 | 0.0065 | J | 6 |
| LNU394 | 0.85 | 0.0081 | B | 24 | LNU361 | 0.79 | 0.0121 | K | 6 |
| LNU459 | 0.84 | 0.0088 | F | 24 | LNU394 | 0.76 | 0.0460 | I | 6 |
| LNU460 | 0.76 | 0.0486 | A | 24 | LNU418 | 0.81 | 0.0139 | H | 6 |
| LNU469 | 0.81 | 0.0281 | A | 24 | LNU459 | 0.76 | 0.0276 | J | 6 |
| LNU469 | 0.80 | 0.0170 | E | 24 | LNU460 | 0.88 | 0.0093 | G | 6 |
| LNU519 | 0.81 | 0.0141 | B | 24 | LNU460 | 0.88 | 0.0038 | H | 6 |
| LNU299 | 0.76 | 0.0275 | B | 26 | LNU471 | 0.79 | 0.0197 | H | 6 |
| LNU299 | 0.79 | 0.0109 | N | 26 | LNU476 | 0.85 | 0.0152 | G | 6 |
| LNU299 | 0.89 | 0.0034 | E | 26 | LNU476 | 0.82 | 0.0126 | H | 6 |
| LNU299 | 0.81 | 0.0156 | F | 26 | LNU518 | 0.70 | 0.0351 | K | 6 |
| LNU300 | 0.77 | 0.0444 | D | 26 | LNU519 | 0.90 | 0.0020 | H | 6 |
| LNU300 | 0.71 | 0.0488 | E | 26 | LNU519 | 0.81 | 0.0267 | I | 6 |
| LNU300 | 0.81 | 0.0159 | F | 26 | LNU299 | 0.72 | 0.0458 | H | 8 |
| LNU371 | 0.71 | 0.0207 | C | 26 | LNU300 | 0.89 | 0.0067 | G | 8 |
| LNU371 | 0.74 | 0.0357 | F | 26 | LNU300 | 0.76 | 0.0495 | L | 8 |
| LNU394 | 0.71 | 0.0463 | E | 26 | LNU307 | 0.90 | 0.0061 | G | 8 |
| LNU418 | 0.76 | 0.0286 | B | 26 | LNU307 | 0.79 | 0.0338 | I | 8 |
| LNU460 | 0.90 | 0.0052 | D | 26 | LNU307 | 0.86 | 0.0032 | K | 8 |
| LNU469 | 0.76 | 0.0293 | E | 26 | LNU307 | 0.78 | 0.0369 | L | 8 |
| LNU471 | 0.89 | 0.0068 | A | 26 | LNU307 | 0.77 | 0.0099 | M | 8 |
| LNU299 | 0.81 | 0.0154 | H | 26 | LNU311 | 0.79 | 0.0362 | G | 8 |
| LNU299 | 0.86 | 0.0030 | K | 26 | LNU311 | 0.79 | 0.0184 | H | 8 |
| LNU300 | 0.83 | 0.0215 | L | 26 | LNU317 | 0.73 | 0.0401 | E | 7 |
| LNU311 | 0.92 | 0.0037 | G | 26 | LNU332 | 0.83 | 0.0113 | B | 7 |
| LNU317 | 0.71 | 0.0324 | K | 26 | LNU332 | 0.82 | 0.0134 | H | 8 |
| LNU361 | 0.71 | 0.0304 | K | 26 | LNU332 | 0.81 | 0.0281 | I | 8 |
| LNU371 | 0.78 | 0.0387 | G | 26 | LNU339 | 0.78 | 0.0224 | F | 7 |
| LNU371 | 0.78 | 0.0400 | L | 26 | LNU339 | 0.74 | 0.0363 | H | 8 |
| LNU394 | 0.89 | 0.0070 | G | 26 | LNU348 | 0.89 | 0.0032 | E | 7 |
| LNU418 | 0.77 | 0.0431 | G | 26 | LNU348 | 0.75 | 0.0318 | H | 8 |
| LNU460 | 0.71 | 0.0479 | H | 26 | LNU348 | 0.91 | 0.0050 | I | 8 |
| LNU469 | 0.86 | 0.0128 | L | 26 | LNU358 | 0.77 | 0.0252 | B | 7 |
| LNU471 | 0.80 | 0.0306 | I | 26 | LNU359 | 0.83 | 0.0196 | A | 7 |
| LNU476 | 0.90 | 0.0056 | I | 26 | LNU359 | 0.84 | 0.0169 | G | 8 |
| LNU299 | 0.71 | 0.0492 | J | 28 | LNU359 | 0.76 | 0.0278 | H | 8 |
| LNU299 | 0.87 | 0.0108 | L | 28 | LNU360 | 0.80 | 0.0315 | A | 7 |
| LNU299 | 0.89 | 0.0067 | A | 27 | LNU360 | 0.89 | 0.0077 | D | 7 |
| LNU299 | 0.86 | 0.0064 | B | 27 | LNU360 | 0.79 | 0.0210 | H | 8 |
| LNU299 | 0.75 | 0.0122 | C | 27 | LNU360 | 0.88 | 0.0095 | L | 8 |
| LNU299 | 0.73 | 0.0241 | N | 27 | LNU361 | 0.72 | 0.0419 | F | 7 |
| LNU299 | 0.88 | 0.0037 | E | 27 | LNU361 | 0.80 | 0.0319 | G | 8 |
| LNU299 | 0.80 | 0.0172 | F | 27 | LNU361 | 0.81 | 0.0146 | H | 8 |
| LNU300 | 0.91 | 0.0045 | A | 27 | LNU371 | 0.77 | 0.0429 | A | 7 |
| LNU300 | 0.86 | 0.0057 | B | 27 | LNU394 | 0.83 | 0.0204 | G | 8 |
| LNU300 | 0.82 | 0.0035 | C | 27 | LNU361 | 0.88 | 0.0084 | A | 7 |
| LNU300 | 0.90 | 0.0008 | N | 27 | LNU358 | 0.83 | 0.0213 | A | 7 |
| LNU300 | 0.91 | 0.0018 | E | 27 | LNU418 | 0.77 | 0.0255 | H | 8 |
| LNU300 | 0.90 | 0.0024 | F | 27 | LNU460 | 0.89 | 0.0075 | A | 7 |
| LNU301 | 0.74 | 0.0355 | B | 27 | LNU460 | 0.80 | 0.0299 | G | 8 |
| LNU307 | 0.78 | 0.0214 | H | 28 | LNU460 | 0.77 | 0.0262 | H | 8 |
| LNU307 | 0.74 | 0.0374 | B | 27 | LNU469 | 0.91 | 0.0048 | A | 7 |
| LNU307 | 0.76 | 0.0115 | C | 27 | LNU471 | 0.81 | 0.0159 | H | 8 |
| LNU307 | 0.85 | 0.0039 | N | 27 | LNU476 | 0.90 | 0.0061 | G | 8 |
| LNU307 | 0.87 | 0.0048 | F | 27 | LNU476 | 0.79 | 0.0189 | H | 8 |
| LNU311 | 0.86 | 0.0015 | M | 28 | LNU476 | 0.71 | 0.0220 | M | 8 |
| LNU311 | 0.71 | 0.0489 | B | 27 | LNU519 | 0.80 | 0.0176 | E | 7 |
| LNU317 | 0.76 | 0.0469 | I | 28 | LNU519 | 0.88 | 0.0039 | H | 8 |
| LNU332 | 0.73 | 0.0383 | B | 27 | LNU519 | 0.77 | 0.0418 | I | 8 |
| LNU339 | 0.74 | 0.0373 | E | 27 | LNU332 | 0.83 | 0.0214 | B | 9 |
| LNU348 | 0.85 | 0.0068 | F | 27 | LNU348 | 0.77 | 0.0427 | E | 9 |
| LNU359 | 0.79 | 0.0340 | G | 28 | LNU358 | 0.87 | 0.0116 | B | 9 |
| LNU359 | 0.80 | 0.0304 | A | 27 | LNU359 | 0.83 | 0.0212 | E | 9 |
| LNU359 | 0.83 | 0.0107 | B | 27 | LNU361 | 0.82 | 0.0253 | F | 9 |
| LNU394 | 0.71 | 0.0211 | C | 27 | LNU376 | 0.89 | 0.0013 | C | 9 |
| LNU361 | 0.78 | 0.0220 | B | 27 | LNU471 | 0.82 | 0.0235 | D | 9 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU376 | 0.90 | 0.0021 | B | 27 | LNU471 | 0.83 | 0.0200 | E | 9 |
| LNU376 | 0.84 | 0.0086 | F | 27 | LNU519 | 0.76 | 0.0483 | E | 9 |
| LNU394 | 0.73 | 0.0418 | E | 27 | LNU299 | 0.89 | 0.0067 | G | 12 |
| LNU394 | 0.82 | 0.0119 | J | 28 | LNU299 | 0.72 | 0.0273 | K | 12 |
| LNU394 | 0.84 | 0.0191 | L | 28 | LNU299 | 0.77 | 0.0417 | A | 11 |
| LNU394 | 0.74 | 0.0348 | B | 27 | LNU299 | 0.70 | 0.0342 | N | 11 |
| LNU418 | 0.80 | 0.0300 | A | 27 | LNU299 | 0.77 | 0.0244 | E | 11 |
| LNU459 | 0.78 | 0.0234 | E | 27 | LNU300 | 0.90 | 0.0057 | G | 12 |
| LNU459 | 0.74 | 0.0372 | F | 27 | LNU300 | 0.82 | 0.0130 | H | 12 |
| LNU460 | 0.83 | 0.0205 | A | 27 | LNU300 | 0.72 | 0.0197 | M | 12 |
| LNU460 | 0.87 | 0.0046 | B | 27 | LNU301 | 0.85 | 0.0149 | G | 12 |
| LNU469 | 0.92 | 0.0013 | H | 28 | LNU301 | 0.75 | 0.0499 | A | 11 |
| LNU469 | 0.77 | 0.0449 | A | 27 | LNU301 | 0.74 | 0.0215 | N | 11 |
| LNU469 | 0.85 | 0.0164 | D | 27 | LNU307 | 0.77 | 0.0410 | G | 12 |
| LNU469 | 0.79 | 0.0207 | E | 27 | LNU307 | 0.86 | 0.0141 | L | 12 |
| LNU471 | 0.83 | 0.0108 | B | 27 | LNU307 | 0.88 | 0.0041 | E | 11 |
| LNU299 | 0.91 | 0.0042 | A | 32 | LNU311 | 0.76 | 0.0451 | G | 12 |
| LNU299 | 0.85 | 0.0080 | B | 32 | LNU311 | 0.78 | 0.0238 | B | 11 |
| LNU299 | 0.89 | 0.0007 | C | 32 | LNU317 | 0.71 | 0.0475 | J | 12 |
| LNU299 | 0.72 | 0.0273 | N | 32 | LNU317 | 0.81 | 0.0083 | K | 12 |
| LNU299 | 0.76 | 0.0271 | E | 32 | LNU317 | 0.80 | 0.0057 | C | 11 |
| LNU299 | 0.91 | 0.0016 | F | 32 | LNU317 | 0.72 | 0.0426 | F | 11 |
| LNU300 | 0.82 | 0.0248 | A | 32 | LNU332 | 0.75 | 0.0306 | B | 11 |
| LNU300 | 0.85 | 0.0080 | B | 32 | LNU339 | 0.79 | 0.0188 | E | 11 |
| LNU300 | 0.71 | 0.0487 | F | 32 | LNU359 | 0.90 | 0.0052 | G | 12 |
| LNU301 | 0.79 | 0.0354 | A | 32 | LNU359 | 0.82 | 0.0234 | D | 11 |
| LNU301 | 0.81 | 0.0137 | B | 32 | LNU360 | 0.77 | 0.0407 | G | 12 |
| LNU307 | 0.77 | 0.0408 | A | 32 | LNU360 | 0.71 | 0.0312 | N | 11 |
| LNU307 | 0.73 | 0.0395 | B | 32 | LNU360 | 0.71 | 0.0479 | E | 11 |
| LNU307 | 0.77 | 0.0088 | C | 32 | LNU360 | 0.72 | 0.0443 | F | 11 |
| LNU307 | 0.76 | 0.0168 | N | 32 | LNU361 | 0.90 | 0.0053 | G | 12 |
| LNU307 | 0.86 | 0.0060 | E | 32 | LNU371 | 0.56 | 0.0135 | G | 12 |
| LNU307 | 0.74 | 0.0343 | F | 32 | LNU371 | 0.78 | 0.0402 | I | 12 |
| LNU339 | 0.85 | 0.0164 | A | 32 | LNU371 | 0.70 | 0.0343 | K | 12 |
| LNU339 | 0.74 | 0.0365 | E | 32 | LNU371 | 0.77 | 0.0439 | L | 12 |
| LNU348 | 0.88 | 0.0044 | F | 32 | LNU376 | 0.80 | 0.0183 | B | 11 |
| LNU360 | 0.83 | 0.0113 | E | 32 | LNU394 | 0.76 | 0.0467 | G | 12 |
| LNU361 | 0.79 | 0.0344 | A | 32 | LNU394 | 0.78 | 0.0372 | I | 12 |
| LNU361 | 0.76 | 0.0277 | E | 32 | LNU394 | 0.78 | 0.0139 | K | 12 |
| LNU371 | 0.83 | 0.0217 | A | 32 | LNU418 | 0.76 | 0.0473 | G | 12 |
| LNU371 | 0.72 | 0.0294 | N | 32 | LNU418 | 0.79 | 0.0121 | N | 11 |
| LNU376 | 0.71 | 0.0463 | B | 32 | LNU459 | 0.87 | 0.0010 | M | 12 |
| LNU376 | 0.73 | 0.0408 | F | 32 | LNU460 | 0.87 | 0.0050 | J | 12 |
| LNU394 | 0.74 | 0.0367 | E | 32 | LNU476 | 0.84 | 0.0187 | G | 12 |
| LNU394 | 0.85 | 0.0081 | B | 32 | LNU476 | 0.79 | 0.0363 | I | 12 |
| LNU459 | 0.84 | 0.0088 | F | 32 | LNU476 | 0.76 | 0.0294 | J | 12 |
| LNU460 | 0.76 | 0.0486 | A | 32 | LNU518 | 0.73 | 0.0254 | N | 11 |
| LNU469 | 0.81 | 0.0281 | A | 32 | LNU519 | 0.76 | 0.0469 | I | 12 |
| LNU469 | 0.80 | 0.0170 | E | 32 | LNU299 | 0.90 | 0.0055 | A | 13 |
| LNU519 | 0.81 | 0.0141 | B | 32 | LNU300 | 0.89 | 0.0068 | A | 13 |
| LNU300 | 0.91 | 0.0046 | G | 32 | LNU300 | 0.77 | 0.0149 | N | 13 |
| LNU300 | 0.76 | 0.0451 | L | 32 | LNU300 | 0.76 | 0.0283 | E | 13 |
| LNU307 | 0.89 | 0.0072 | G | 32 | LNU300 | 0.87 | 0.0048 | F | 13 |
| LNU307 | 0.76 | 0.0476 | I | 32 | LNU301 | 0.86 | 0.0134 | A | 13 |
| LNU307 | 0.89 | 0.0012 | K | 32 | LNU307 | 0.79 | 0.0061 | C | 13 |
| LNU307 | 0.79 | 0.0351 | L | 32 | LNU307 | 0.72 | 0.0297 | N | 13 |
| LNU307 | 0.77 | 0.0095 | M | 32 | LNU307 | 0.72 | 0.0433 | E | 13 |
| LNU311 | 0.79 | 0.0348 | G | 32 | LNU307 | 0.77 | 0.0269 | F | 13 |
| LNU332 | 0.80 | 0.0324 | I | 32 | LNU311 | 0.83 | 0.0104 | B | 13 |
| LNU348 | 0.88 | 0.0081 | I | 32 | LNU317 | 0.76 | 0.0295 | B | 13 |
| LNU359 | 0.86 | 0.0123 | G | 32 | LNU317 | 0.82 | 0.0131 | F | 13 |
| LNU360 | 0.86 | 0.0138 | L | 32 | LNU332 | 0.86 | 0.0064 | B | 13 |
| LNU361 | 0.82 | 0.0245 | G | 32 | LNU332 | 0.84 | 0.0084 | E | 13 |
| LNU361 | 0.72 | 0.0460 | H | 32 | LNU339 | 0.88 | 0.0085 | A | 13 |
| LNU394 | 0.85 | 0.0153 | G | 32 | LNU339 | 0.76 | 0.0463 | D | 13 |
| LNU394 | 0.78 | 0.0373 | I | 32 | LNU339 | 0.91 | 0.0017 | E | 13 |
| LNU394 | 0.72 | 0.0288 | K | 32 | LNU348 | 0.76 | 0.0472 | D | 13 |
| LNU460 | 0.82 | 0.0249 | G | 32 | LNU348 | 0.84 | 0.0099 | F | 13 |
| LNU471 | 0.71 | 0.0500 | H | 32 | LNU359 | 0.3 | 0.0385 | B | 13 |
| LNU476 | 0.90 | 0.0063 | G | 32 | LNU360 | 0.81 | 0.0147 | B | 13 |
| LNU476 | 0.74 | 0.0138 | M | 32 | LNU360 | 0.80 | 0.0181 | F | 13 |
| LNU519 | 0.78 | 0.0223 | H | 32 | LNU361 | 0.86 | 0.0138 | A | 13 |
| LNU519 | 0.78 | 0.0391 | I | 32 | LNU376 | 0.77 | 0.0256 | B | 13 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU299 | 0.78 | 0.0126 | K | 34 | LNU394 | 0.85 | 0.0145 | A | 13 |
| LNU299 | 0.77 | 0.0451 | A | 34 | LNU459 | 0.71 | 0.0316 | N | 13 |
| LNU299 | 0.79 | 0.0202 | B | 34 | LNU460 | 0.91 | 0.0046 | A | 13 |
| LNU299 | 0.73 | 0.0168 | C | 34 | LNU469 | 0.91 | 0.0039 | A | 13 |
| LNU299 | 0.85 | 0.0143 | D | 34 | LNU469 | 0.82 | 0.0035 | C | 13 |
| LNU299 | 0.77 | 0.0161 | N | 34 | LNU469 | 0.73 | 0.0419 | E | 13 |
| LNU299 | 0.80 | 0.0161 | E | 34 | LNU299 | 0.75 | 0.0311 | H | 14 |
| LNU299 | 0.75 | 0.0339 | F | 34 | LNU300 | 0.82 | 0.0232 | G | 14 |
| LNU300 | 0.80 | 0.0291 | I | 34 | LNU301 | 0.71 | 0.0499 | H | 14 |
| LNU300 | 0.79 | 0.0109 | K | 34 | LNU307 | 0.90 | 0.0059 | G | 14 |
| LNU300 | 0.81 | 0.0137 | B | 34 | LNU307 | 0.77 | 0.0424 | I | 14 |
| LNU301 | 0.82 | 0.0234 | G | 34 | LNU307 | 0.70 | 0.0353 | K | 14 |
| LNU301 | 0.71 | 0.0311 | K | 34 | LNU307 | 0.83 | 0.0217 | L | 14 |
| LNU301 | 0.80 | 0.0163 | B | 34 | LNU307 | 0.84 | 0.0024 | M | 14 |
| LNU301 | 0.71 | 0.0228 | C | 34 | LNU332 | 0.86 | 0.0124 | I | 14 |
| LNU301 | 0.77 | 0.0245 | E | 34 | LNU348 | 0.89 | 0.0074 | I | 14 |
| LNU307 | 0.80 | 0.0303 | G | 34 | LNU359 | 0.77 | 0.0429 | G | 14 |
| LNU307 | 0.83 | 0.0109 | H | 34 | LNU360 | 0.82 | 0.0235 | I | 14 |
| LNU307 | 0.79 | 0.0359 | L | 34 | LNU360 | 0.91 | 0.0041 | L | 14 |
| LNU317 | 0.76 | 0.0180 | K | 34 | LNU371 | 0.83 | 0.0102 | H | 14 |
| LNU317 | 0.71 | 0.0209 | M | 34 | LNU418 | 0.84 | 0.0097 | H | 14 |
| LNU317 | 0.77 | 0.0090 | C | 34 | LNU459 | 0.71 | 0.0217 | M | 14 |
| LNU360 | 0.77 | 0.0450 | A | 34 | LNU460 | 0.71 | 0.0470 | H | 14 |
| LNU361 | 0.83 | 0.0209 | G | 34 | LNU471 | 0.77 | 0.0448 | G | 14 |
| LNU361 | 0.86 | 0.0058 | E | 34 | LNU476 | 0.80 | 0.0297 | G | 14 |
| LNU371 | 0.86 | 0.0141 | G | 34 | LNU518 | 0.70 | 0.0342 | K | 14 |
| LNU371 | 0.83 | 0.0214 | I | 34 | LNU519 | 0.79 | 0.0356 | I | 14 |
| LNU371 | 0.81 | 0.0087 | K | 34 | LNU299 | 0.89 | 0.0067 | A | 15 |
| LNU371 | 0.77 | 0.0433 | L | 34 | LNU299 | 0.86 | 0.0064 | B | 15 |
| LNU376 | 0.78 | 0.0212 | B | 34 | LNU299 | 0.75 | 0.0122 | C | 15 |
| LNU394 | 0.82 | 0.0253 | I | 34 | LNU299 | 0.73 | 0.0241 | N | 15 |
| LNU394 | 0.76 | 0.0166 | K | 34 | LNU299 | 0.88 | 0.0037 | E | 15 |
| LNU459 | 0.71 | 0.0216 | M | 34 | LNU299 | 0.80 | 0.0172 | F | 15 |
| LNU460 | 0.83 | 0.0219 | G | 34 | LNU299 | 0.71 | 0.0492 | J | 16 |
| LNU460 | 0.75 | 0.0313 | B | 34 | LNU299 | 0.87 | 0.0108 | L | 16 |
| LNU469 | 0.87 | 0.0048 | H | 34 | LNU300 | 0.91 | 0.0045 | A | 15 |
| LNU471 | 0.88 | 0.0083 | A | 34 | LNU300 | 0.86 | 0.0057 | B | 15 |
| LNU476 | 0.80 | 0.0291 | G | 34 | LNU300 | 0.82 | 0.0035 | C | 15 |
| LNU476 | 0.84 | 0.0189 | A | 34 | LNU300 | 0.90 | 0.0008 | N | 15 |
| LNU476 | 0.86 | 0.0067 | B | 34 | LNU300 | 0.91 | 0.0018 | E | 15 |
| LNU518 | 0.76 | 0.0286 | B | 34 | LNU300 | 0.90 | 0.0024 | F | 15 |
| LNU519 | 0.74 | 0.0235 | N | 34 | LNU301 | 0.74 | 0.0355 | B | 15 |
| LNU299 | 0.86 | 0.0067 | J | 36 | LNU307 | 0.74 | 0.0374 | B | 15 |
| LNU299 | 0.91 | 0.0041 | A | 36 | LNU307 | 0.76 | 0.0115 | C | 15 |
| LNU299 | 0.79 | 0.0185 | B | 36 | LNU307 | 0.85 | 0.0039 | N | 15 |
| LNU299 | 0.89 | 0.0006 | C | 36 | LNU307 | 0.87 | 0.0048 | F | 15 |
| LNU299 | 0.78 | 0.0387 | D | 36 | LNU307 | 0.78 | 0.0214 | H | 16 |
| LNU299 | 0.80 | 0.0101 | N | 36 | LNU311 | 0.71 | 0.0489 | B | 15 |
| LNU299 | 0.90 | 0.0023 | E | 36 | LNU311 | 0.86 | 0.0015 | M | 16 |
| LNU299 | 0.83 | 0.0110 | F | 36 | LNU317 | 0.76 | 0.0469 | I | 16 |
| LNU300 | 0.92 | 0.0037 | G | 36 | LNU332 | 0.73 | 0.0383 | B | 15 |
| LNU300 | 0.80 | 0.0315 | I | 36 | LNU339 | 0.74 | 0.0373 | E | 15 |
| LNU300 | 0.74 | 0.0239 | K | 36 | LNU348 | 0.85 | 0.0068 | F | 15 |
| LNU300 | 0.83 | 0.0202 | A | 36 | LNU359 | 0.80 | 0.0304 | A | 15 |
| LNU300 | 0.89 | 0.0030 | B | 36 | LNU359 | 0.83 | 0.0107 | B | 15 |
| LNU300 | 0.86 | 0.0014 | C | 36 | LNU359 | 0.79 | 0.0340 | G | 16 |
| LNU301 | 0.80 | 0.0308 | G | 36 | LNU361 | 0.78 | 0.0220 | B | 15 |
| LNU301 | 0.77 | 0.0426 | I | 36 | LNU376 | 0.90 | 0.0021 | B | 15 |
| LNU301 | 0.77 | 0.0152 | K | 36 | LNU376 | 0.84 | 0.0086 | F | 15 |
| LNU301 | 0.86 | 0.0068 | B | 36 | LNU394 | 0.71 | 0.0211 | C | 15 |
| LNU301 | 0.89 | 0.0007 | C | 36 | LNU394 | 0.74 | 0.0348 | B | 15 |
| LNU301 | 0.86 | 0.0135 | D | 36 | LNU394 | 0.82 | 0.0119 | J | 16 |
| LNU307 | 0.89 | 0.0071 | G | 36 | LNU394 | 0.84 | 0.0191 | L | 16 |
| LNU307 | 0.76 | 0.0282 | H | 36 | LNU394 | 0.73 | 0.0418 | E | 15 |
| LNU307 | 0.83 | 0.0197 | I | 36 | LNU418 | 0.80 | 0.0300 | A | 15 |
| LNU307 | 0.77 | 0.0143 | K | 36 | LNU459 | 0.78 | 0.0234 | E | 15 |
| LNU307 | 0.80 | 0.0293 | L | 36 | LNU459 | 0.74 | 0.0372 | F | 15 |
| LNU307 | 0.80 | 0.0053 | M | 36 | LNU460 | 0.83 | 0.0205 | A | 15 |
| LNU307 | 0.84 | 0.0170 | A | 36 | LNU460 | 0.87 | 0.0046 | B | 15 |
| LNU307 | 0.85 | 0.0082 | E | 36 | LNU469 | 0.77 | 0.0449 | A | 15 |
| LNU307 | 0.84 | 0.0085 | F | 36 | LNU469 | 0.85 | 0.0164 | D | 15 |
| LNU311 | 0.73 | 0.0396 | B | 36 | LNU469 | 0.79 | 0.0207 | E | 15 |
| LNU332 | 0.78 | 0.0237 | B | 36 | LNU469 | 0.92 | 0.0013 | H | 16 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU339 | 0.83 | 0.0220 | D | 36 | LNU471 | 0.83 | 0.0108 | B | 15 |
| LNU348 | 0.78 | 0.0383 | I | 36 | LNU299 | 0.88 | 0.0088 | A | 17 |
| LNU348 | 0.79 | 0.0197 | B | 36 | LNU299 | 0.77 | 0.0098 | C | 17 |
| LNU359 | 0.88 | 0.0090 | G | 36 | LNU299 | 0.76 | 0.0295 | F | 17 |
| LNU359 | 0.77 | 0.0448 | A | 36 | LNU299 | 0.76 | 0.0494 | G | 18 |
| LNU359 | 0.72 | 0.0446 | B | 36 | LNU299 | 0.71 | 0.0205 | M | 18 |
| LNU360 | 0.82 | 0.0225 | A | 36 | LNU300 | 0.79 | 0.0209 | F | 17 |
| LNU360 | 0.77 | 0.0268 | E | 36 | LNU300 | 0.83 | 0.0197 | G | 18 |
| LNU361 | 0.70 | 0.0236 | C | 36 | LNU300 | 0.83 | 0.0111 | H | 18 |
| LNU361 | 0.80 | 0.0173 | E | 36 | LNU301 | 0.86 | 0.0127 | A | 17 |
| LNU371 | 0.77 | 0.0438 | A | 36 | LNU307 | 0.71 | 0.0468 | B | 17 |
| LNU371 | 0.86 | 0.0060 | E | 36 | LNU307 | 0.79 | 0.0063 | C | 17 |
| LNU371 | 0.72 | 0.0450 | F | 36 | LNU307 | 0.85 | 0.0079 | E | 17 |
| LNU376 | 0.88 | 0.0037 | B | 36 | LNU307 | 0.76 | 0.0292 | F | 17 |
| LNU394 | 0.72 | 0.0302 | K | 36 | LNU307 | 0.85 | 0.0144 | G | 18 |
| LNU459 | 0.77 | 0.0437 | I | 36 | LNU307 | 0.81 | 0.0269 | I | 18 |
| LNU459 | 0.82 | 0.0124 | F | 36 | LNU307 | 0.75 | 0.0198 | K | 18 |
| LNU460 | 0.89 | 0.0068 | G | 36 | LNU307 | 0.76 | 0.0455 | L | 18 |
| LNU460 | 0.79 | 0.0364 | A | 36 | LNU307 | 0.77 | 0.0091 | M | 18 |
| LNU460 | 0.78 | 0.0238 | B | 36 | LNU311 | 0.82 | 0.0119 | B | 17 |
| LNU460 | 0.80 | 0.0292 | D | 36 | LNU317 | 0.76 | 0.0481 | D | 17 |
| LNU469 | 0.71 | 0.0473 | E | 36 | LNU317 | 0.77 | 0.0252 | F | 17 |
| LNU471 | 0.84 | 0.0178 | G | 36 | LNU317 | 0.78 | 0.0138 | K | 18 |
| LNU471 | 0.85 | 0.0156 | A | 36 | LNU332 | 0.83 | 0.0111 | B | 17 |
| LNU476 | 0.80 | 0.0322 | G | 36 | LNU332 | 0.85 | 0.0142 | D | 17 |
| LNU518 | 0.73 | 0.0411 | B | 36 | LNU332 | 0.74 | 0.0356 | E | 17 |
| LNU519 | 0.91 | 0.0043 | I | 36 | LNU332 | 0.83 | 0.0211 | I | 18 |
| LNU519 | 0.81 | 0.0147 | B | 36 | LNU339 | 0.86 | 0.0134 | A | 17 |
| LNU519 | 0.85 | 0.0035 | N | 36 | LNU339 | 0.92 | 0.0014 | E | 17 |
| LNU299 | 0.87 | 0.0026 | K | 37 | LNU348 | 0.91 | 0.0047 | D | 17 |
| LNU299 | 0.86 | 0.0058 | B | 36 | LNU348 | 0.78 | 0.0222 | F | 17 |
| LNU299 | 0.81 | 0.0155 | E | 36 | LNU348 | 0.84 | 0.0177 | I | 18 |
| LNU299 | 0.72 | 0.0446 | F | 36 | LNU359 | 0.77 | 0.0415 | G | 18 |
| LNU300 | 0.88 | 0.0088 | G | 37 | LNU360 | 0.88 | 0.0036 | E | 17 |
| LNU300 | 0.79 | 0.0344 | L | 37 | LNU360 | 0.80 | 0.0177 | F | 17 |
| LNU300 | 0.77 | 0.0088 | M | 37 | LNU360 | 0.88 | 0.0097 | I | 18 |
| LNU300 | 0.90 | 0.0055 | A | 36 | LNU360 | 0.76 | 0.0462 | L | 18 |
| LNU300 | 0.85 | 0.0070 | B | 36 | LNU361 | 0.84 | 0.0175 | A | 17 |
| LNU300 | 0.89 | 0.0005 | C | 36 | LNU361 | 0.82 | 0.0129 | E | 17 |
| LNU301 | 0.77 | 0.0433 | A | 36 | LNU371 | 0.79 | 0.0203 | H | 18 |
| LNU301 | 0.74 | 0.0154 | C | 36 | LNU376 | 0.77 | 0.0266 | B | 17 |
| LNU301 | 0.72 | 0.0276 | N | 36 | LNU460 | 0.81 | 0.0282 | A | 17 |
| LNU307 | 0.83 | 0.0196 | G | 37 | LNU460 | 0.76 | 0.0487 | G | 18 |
| LNU307 | 0.73 | 0.0172 | M | 37 | LNU469 | 0.79 | 0.0327 | A | 17 |
| LNU307 | 0.83 | 0.0117 | B | 36 | LNU469 | 0.71 | 0.0203 | C | 17 |
| LNU307 | 0.72 | 0.0461 | F | 36 | LNU469 | 0.71 | 0.0499 | J | 18 |
| LNU311 | 0.83 | 0.0209 | G | 37 | LNU476 | 0.81 | 0.0275 | G | 18 |
| LNU311 | 0.89 | 0.0028 | B | 36 | LNU519 | 0.80 | 0.0325 | D | 17 |
| LNU332 | 0.89 | 0.0031 | B | 36 | LNU519 | 0.80 | 0.0317 | I | 18 |
| LNU339 | 0.75 | 0.0308 | B | 36 | LNU307 | 0.73 | 0.0410 | H | 10 |
| LNU348 | 0.87 | 0.0109 | I | 37 | LNU332 | 0.73 | 0.0404 | K | 10 |
| LNU394 | 0.84 | 0.0023 | C | 36 | LNU332 | 0.84 | 0.0049 | M | 10 |
| LNU359 | 0.84 | 0.0183 | G | 37 | LNU471 | 0.79 | 0.0209 | K | 10 |
| LNU360 | 0.81 | 0.0281 | L | 37 | LNU300 | 0.91 | 0.0046 | G | 20 |
| LNU360 | 0.74 | 0.0354 | E | 36 | LNU300 | 0.76 | 0.0451 | L | 20 |
| LNU361 | 0.85 | 0.0153 | G | 37 | LNU307 | 0.89 | 0.0072 | G | 20 |
| LNU371 | 0.85 | 0.0071 | E | 36 | LNU307 | 0.76 | 0.0476 | I | 20 |
| LNU376 | 0.73 | 0.0398 | B | 36 | LNU307 | 0.89 | 0.0012 | K | 20 |
| LNU394 | 0.80 | 0.0302 | D | 36 | LNU307 | 0.79 | 0.0351 | L | 20 |
| LNU394 | 0.85 | 0.0158 | G | 37 | LNU307 | 0.77 | 0.0095 | M | 20 |
| LNU394 | 0.81 | 0.0264 | I | 37 | LNU311 | 0.79 | 0.0348 | G | 20 |
| LNU418 | 0.73 | 0.0379 | E | 36 | LNU332 | 0.80 | 0.0324 | I | 20 |
| LNU459 | 0.74 | 0.0368 | F | 36 | LNU348 | 0.88 | 0.0081 | I | 20 |
| LNU469 | 0.72 | 0.0439 | E | 36 | LNU359 | 0.86 | 0.0123 | G | 20 |
| LNU476 | 0.82 | 0.0232 | G | 37 | LNU360 | 0.86 | 0.0138 | L | 20 |
| LNU519 | 0.78 | 0.0221 | B | 36 | LNU361 | 0.82 | 0.0245 | G | 20 |
| LNU299 | 0.79 | 0.0328 | F | 39 | LNU361 | 0.72 | 0.0460 | H | 20 |
| LNU307 | 0.77 | 0.0445 | F | 39 | LNU361 | 0.85 | 0.0153 | G | 20 |
| LNU311 | 0.73 | 0.0398 | H | 40 | LNU394 | 0.78 | 0.0373 | I | 20 |
| LNU339 | 0.79 | 0.0195 | H | 40 | LNU394 | 0.72 | 0.0288 | K | 20 |
| LNU348 | 0.90 | 0.0022 | K | 40 | LNU460 | 0.82 | 0.0249 | G | 20 |
| LNU361 | 0.74 | 0.0369 | H | 40 | LNU471 | 0.71 | 0.0500 | H | 20 |
| LNU376 | 0.78 | 0.0370 | F | 39 | LNU476 | 0.90 | 0.0063 | G | 20 |

TABLE 66-continued

Correlation between the expression level of selected LNU genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU394 | 0.83 | 0.0196 | F | 39 | LNU476 | 0.74 | 0.0138 | M | 20 |
| LNU394 | 0.90 | 0.0059 | B | 39 | LNU519 | 0.78 | 0.0223 | H | 20 |
| LNU460 | 0.74 | 0.0360 | N | 39 | LNU519 | 0.78 | 0.0391 | I | 20 |
| LNU469 | 0.91 | 0.0048 | B | 39 | LNU299 | 0.92 | 0.0037 | A | 21 |
| LNU469 | 0.89 | 0.0071 | F | 39 | LNU299 | 0.83 | 0.0116 | B | 21 |
| LNU518 | 0.88 | 0.0099 | E | 39 | LNU299 | 0.86 | 0.0014 | C | 21 |
| LNU518 | 0.81 | 0.0278 | F | 39 | LNU299 | 0.91 | 0.0018 | F | 21 |
| LNU519 | 0.72 | 0.0431 | H | 40 | LNU300 | 0.89 | 0.0071 | G | 22 |
| LNU299 | 0.88 | 0.0082 | A | 40 | LNU300 | 0.76 | 0.0452 | L | 22 |
| LNU299 | 0.78 | 0.0219 | B | 40 | LNU300 | 0.80 | 0.0301 | A | 21 |
| LNU299 | 0.91 | 0.0002 | C | 40 | LNU300 | 0.80 | 0.0171 | B | 21 |
| LNU299 | 0.88 | 0.0043 | F | 40 | LNU300 | 0.72 | 0.0446 | F | 21 |
| LNU300 | 0.82 | 0.0135 | B | 40 | LNU301 | 0.83 | 0.0198 | A | 21 |
| LNU300 | 0.77 | 0.0259 | F | 40 | LNU301 | 0.77 | 0.0240 | B | 21 |
| LNU300 | 0.76 | 0.0483 | L | 41 | LNU307 | 0.90 | 0.0052 | G | 22 |
| LNU301 | 0.85 | 0.0081 | B | 40 | LNU307 | 0.80 | 0.0326 | I | 22 |
| LNU307 | 0.76 | 0.0451 | A | 40 | LNU307 | 0.89 | 0.0012 | K | 22 |
| LNU307 | 0.80 | 0.0059 | C | 40 | LNU307 | 0.80 | 0.0314 | L | 22 |
| LNU307 | 0.76 | 0.0164 | N | 40 | LNU307 | 0.77 | 0.0097 | M | 22 |
| LNU307 | 0.85 | 0.0072 | E | 40 | LNU307 | 0.72 | 0.0429 | B | 21 |
| LNU307 | 0.72 | 0.0446 | F | 40 | LNU307 | 0.82 | 0.0034 | C | 21 |
| LNU307 | 0.92 | 0.0035 | G | 41 | LNU307 | 0.80 | 0.0096 | N | 21 |
| LNU307 | 0.78 | 0.0404 | I | 41 | LNU307 | 0.84 | 0.0087 | E | 21 |
| LNU307 | 0.92 | 0.0005 | K | 41 | LNU307 | 0.77 | 0.0262 | F | 21 |
| LNU307 | 0.82 | 0.0236 | L | 41 | LNU311 | 0.78 | 0.0373 | G | 22 |
| LNU307 | 0.78 | 0.0074 | M | 41 | LNU311 | 0.75 | 0.0308 | H | 22 |
| LNU311 | 0.77 | 0.0426 | G | 41 | LNU332 | 0.73 | 0.0405 | H | 22 |
| LNU332 | 0.81 | 0.0261 | I | 41 | LNU332 | 0.80 | 0.0293 | I | 22 |
| LNU339 | 0.87 | 0.0100 | A | 40 | LNU339 | 0.89 | 0.0077 | A | 21 |
| LNU339 | 0.75 | 0.0326 | E | 40 | LNU339 | 0.73 | 0.0247 | N | 21 |
| LNU348 | 0.92 | 0.0013 | F | 40 | LNU339 | 0.79 | 0.0208 | E | 21 |
| LNU348 | 0.92 | 0.0036 | I | 41 | LNU348 | 0.91 | 0.0043 | I | 22 |
| LNU358 | 0.71 | 0.0339 | N | 40 | LNU348 | 0.90 | 0.0022 | F | 21 |
| LNU359 | 0.88 | 0.0091 | G | 41 | LNU359 | 0.85 | 0.0157 | G | 22 |
| LNU360 | 0.76 | 0.0272 | E | 40 | LNU360 | 0.89 | 0.0072 | L | 22 |
| LNU360 | 0.86 | 0.0137 | L | 41 | LNU360 | 0.84 | 0.0097 | E | 21 |
| LNU361 | 0.85 | 0.0154 | A | 40 | LNU361 | 0.80 | 0.0317 | G | 22 |
| LNU361 | 0.80 | 0.0313 | G | 41 | LNU361 | 0.75 | 0.0328 | H | 22 |
| LNU371 | 0.83 | 0.0214 | A | 40 | LNU361 | 0.79 | 0.0362 | A | 21 |
| LNU371 | 0.71 | 0.0481 | B | 40 | LNU361 | 0.75 | 0.0326 | E | 21 |
| LNU376 | 0.71 | 0.0480 | B | 40 | LNU371 | 0.80 | 0.0322 | A | 21 |
| LNU376 | 0.77 | 0.0266 | F | 40 | LNU376 | 0.74 | 0.0359 | F | 21 |
| LNU394 | 0.77 | 0.0447 | A | 40 | LNU394 | 0.74 | 0.0366 | E | 21 |
| LNU394 | 0.81 | 0.0141 | B | 40 | LNU394 | 0.82 | 0.0232 | G | 22 |
| LNU394 | 0.82 | 0.0255 | G | 41 | LNU394 | 0.76 | 0.0487 | A | 21 |
| LNU394 | 0.71 | 0.0311 | K | 41 | LNU394 | 0.82 | 0.0119 | B | 21 |
| LNU459 | 0.88 | 0.0036 | F | 40 | LNU418 | 0.72 | 0.0459 | H | 22 |
| LNU460 | 0.84 | 0.0177 | G | 41 | LNU459 | 0.85 | 0.0082 | F | 21 |
| LNU469 | 0.78 | 0.0399 | A | 40 | LNU460 | 0.81 | 0.0286 | G | 22 |
| LNU471 | 0.73 | 0.0392 | H | 41 | LNU460 | 0.77 | 0.0410 | A | 21 |
| LNU476 | 0.71 | 0.0465 | F | 40 | | | | | |

Table 66. "Corr. Set ID"—correlation set ID according to the correlated parameters Table above.

TABLE 67

Correlation between the expression level of selected LNU homologous genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU494_H2 | 0.76 | 0.0460 | A | 21 | LNU309_H3 | 0.71 | 0.0336 | K | 6 |
| LNU494_H2 | 0.79 | 0.0358 | A | 23 | LNU431_H1 | 0.76 | 0.0289 | H | 6 |
| LNU417_H4 | 0.73 | 0.0414 | H | 24 | LNU417_H4 | 0.76 | 0.0492 | A | 7 |
| LNU417_H4 | 0.78 | 0.0237 | B | 26 | LNU417_H4 | 0.90 | 0.0024 | F | 7 |
| LNU309_H3 | 0.79 | 0.0111 | K | 28 | LNU417_H4 | 0.79 | 0.0198 | H | 8 |
| LNU494_H2 | 0.85 | 0.0078 | B | 27 | LNU431_H1 | 0.77 | 0.0447 | A | 7 |
| LNU309_H3 | 0.71 | 0.0331 | K | 32 | LNU417_H4 | 0.91 | 0.0048 | F | 9 |

TABLE 67-continued

Correlation between the expression level of selected LNU homologous genes of some embodiments of the invention in various tissues and the phenotypic performance under normal conditions across maize accessions

| Gene Name | R | P | Exp. set ID | Corr. ID | Gene Name | R | P | Exp. set ID | Corr. ID |
|---|---|---|---|---|---|---|---|---|---|
| LNU309_H3 | 0.78 | 0.0129 | K | 34 | LNU494_H2 | 0.90 | 0.0056 | E | 9 |
| LNU417_H4 | 0.75 | 0.0128 | C | 34 | LNU309_H3 | 0.80 | 0.0299 | A | 11 |
| LNU417_H4 | 0.87 | 0.0111 | G | 36 | LNU309_H3 | 0.73 | 0.0390 | F | 11 |
| LNU431_H1 | 0.78 | 0.0388 | G | 36 | LNU431_H1 | 0.79 | 0.0348 | G | 12 |
| LNU309_H3 | 0.80 | 0.0172 | N | 39 | LNU494_H2 | 0.71 | 0.0305 | N | 11 |
| LNU417_H4 | 0.71 | 0.0497 | H | 40 | LNU309_H3 | 0.78 | 0.0227 | F | 13 |
| LNU309_H3 | 0.71 | 0.0331 | K | 41 | LNU494_H2 | 0.77 | 0.0264 | B | 13 |
| LNU431_H1 | 0.76 | 0.0476 | A | 40 | LNU309_H3 | 0.73 | 0.0169 | M | 14 |
| LNU309_H3 | 0.87 | 0.0010 | C | 1 | LNU431_H1 | 0.79 | 0.0327 | G | 14 |
| LNU494_H2 | 0.80 | 0.0321 | A | 1 | LNU309_H3 | 0.79 | 0.0111 | K | 16 |
| LNU309_H3 | 0.74 | 0.0148 | C | 3 | LNU494_H2 | 0.85 | 0.0078 | B | 15 |
| LNU309_H3 | 0.71 | 0.0321 | N | 3 | LNU309_H3 | 0.73 | 0.0417 | F | 17 |
| LNU494_H2 | 0.85 | 0.0162 | A | 3 | LNU309_H3 | 0.71 | 0.0331 | K | 20 |
| LNU309_H3 | 0.77 | 0.0253 | H | 6 | LNU417_H4 | 0.72 | 0.0428 | H | 22 |

Table 67. "Corr. Set ID"—correlation set ID according to the correlated parameters Table above.

Example 13

Gene Cloning and Generation of Binary Vectors for Plant Expression

To validate their role in improving yield, selected genes were over-expressed in plants, as follows.

Cloning Strategy

Selected genes from those presented in Examples 1-12 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products are purified using PCR purification kit (Qiagen). In case where the entire coding sequence was not found, RACE kit from Invitrogen (RACE=Rapid Amplification of cDNA Ends) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers were used.

To facilitate cloning of the cDNAs/genomic sequences, a 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers were designed such that the digested cDNA was inserted in the sense formation into the binary vector utilized for transformation.

Each digested PCR product was inserted into a high copy vector pUC19 (New England BioLabs Inc], or into plasmids originating from this vector. In some cases the undigested PCR product was inserted into pCR-Blunt II-TOPO (Invitrogen).

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. In any case the insert was followed by single copy of the NOS terminator (SEQ ID NO:3825). The digested products and the linearized plasmid vector are ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors as shown in Table 68, below.

Several DNA sequences of the selected genes were synthesized by a commercial supplier GeneArt [Hypertext Transfer Protocol://World Wide Web (dot) geneart (dot) coma Synthetic DNA was designed in silico. Suitable restriction enzymes sites were added to the cloned sequences at the 5' end and at the 3' end to enable later cloning into the pQFNc binary vector downstream of the At6669 promoter (SEQ ID NO: 3829).

Binary Vectors Used for Cloning:

The plasmid pPI is constructed by inserting a synthetic poly-(A) signal sequence, originating from pGL3 basic plasmid vector (Promega, Acc No U47295; bp 4658-4811) into the HindIII restriction site of the binary vector pBI101.3

(Clontech, Acc. No. U12640). pGI (pBXYN) is similar to pPI, but the original gene in the backbone, the GUS gene, is replaced by the GUS-Intron gene followed by the NOS terminator (SEQ ID NO:3825) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:3834].

Figure 2:
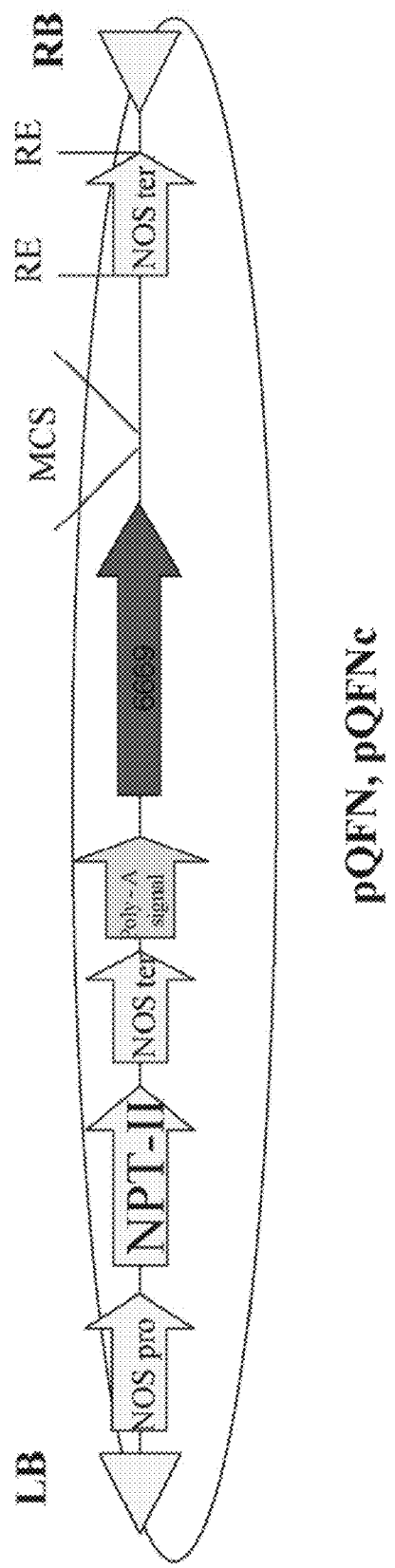
FIG. 2 is a schematic illustration of the modified pGI binary plasmid containing the new At6669 promoter (SEQ ID NO:3829) (pQFN or pQFNc) used for expressing the isolated polynucleotide sequences of some embodiments of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.
Figure 3A:
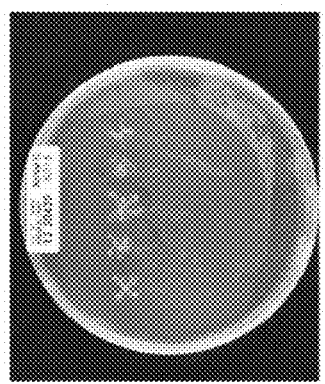
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
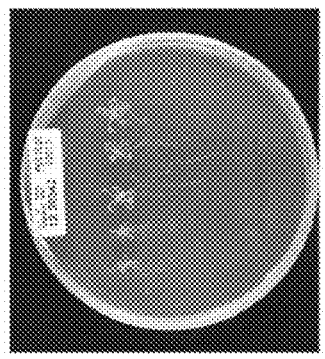
Figure 3E:
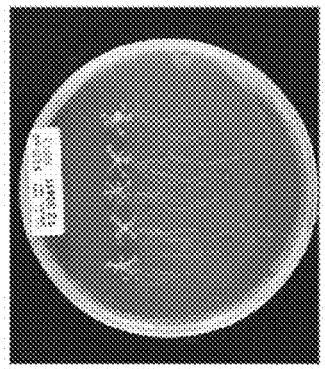
Figure 3B:
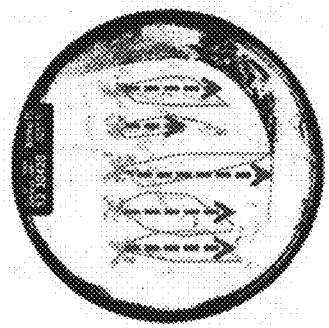
Figure 3D:
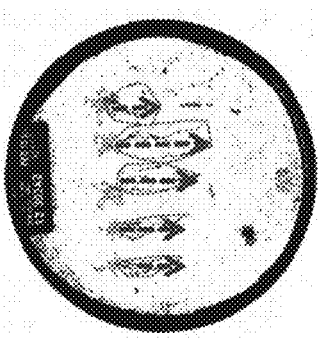
Figure 3F:
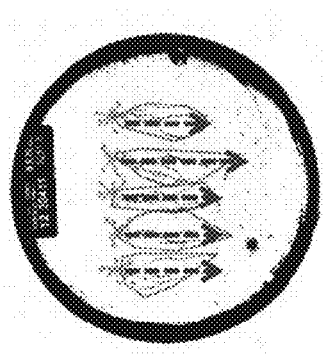
Figure 4:
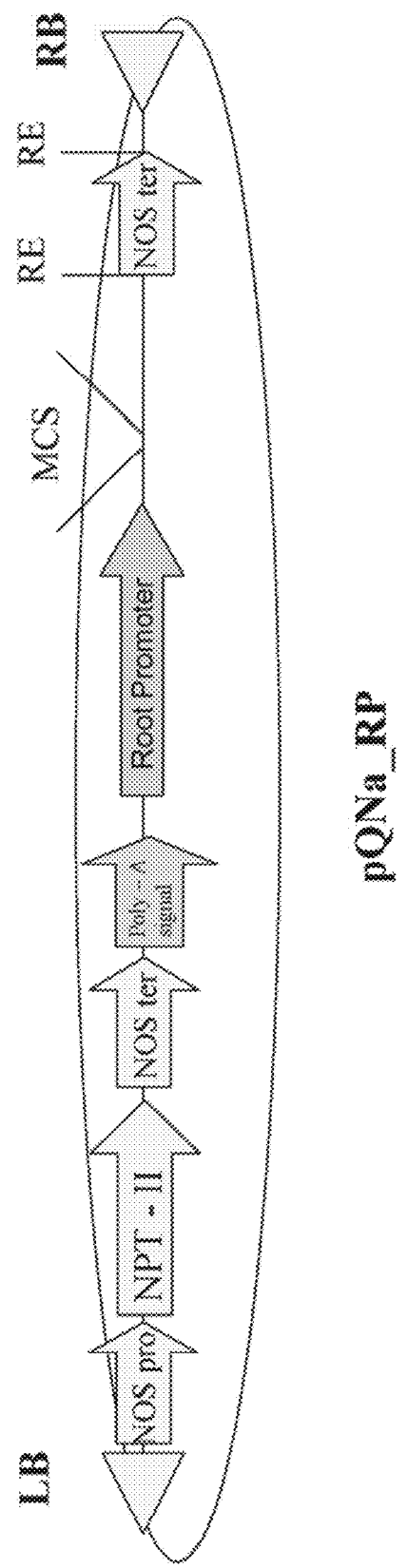
FIG. 4 is a schematic illustration of the modified pGI binary plasmid containing the Root Promoter (pQNa_RP; SEQ ID NO:3830) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); the isolated polynucleotide sequences according to some embodiments of the invention were cloned into the MCS of the vector.
Figure 5:
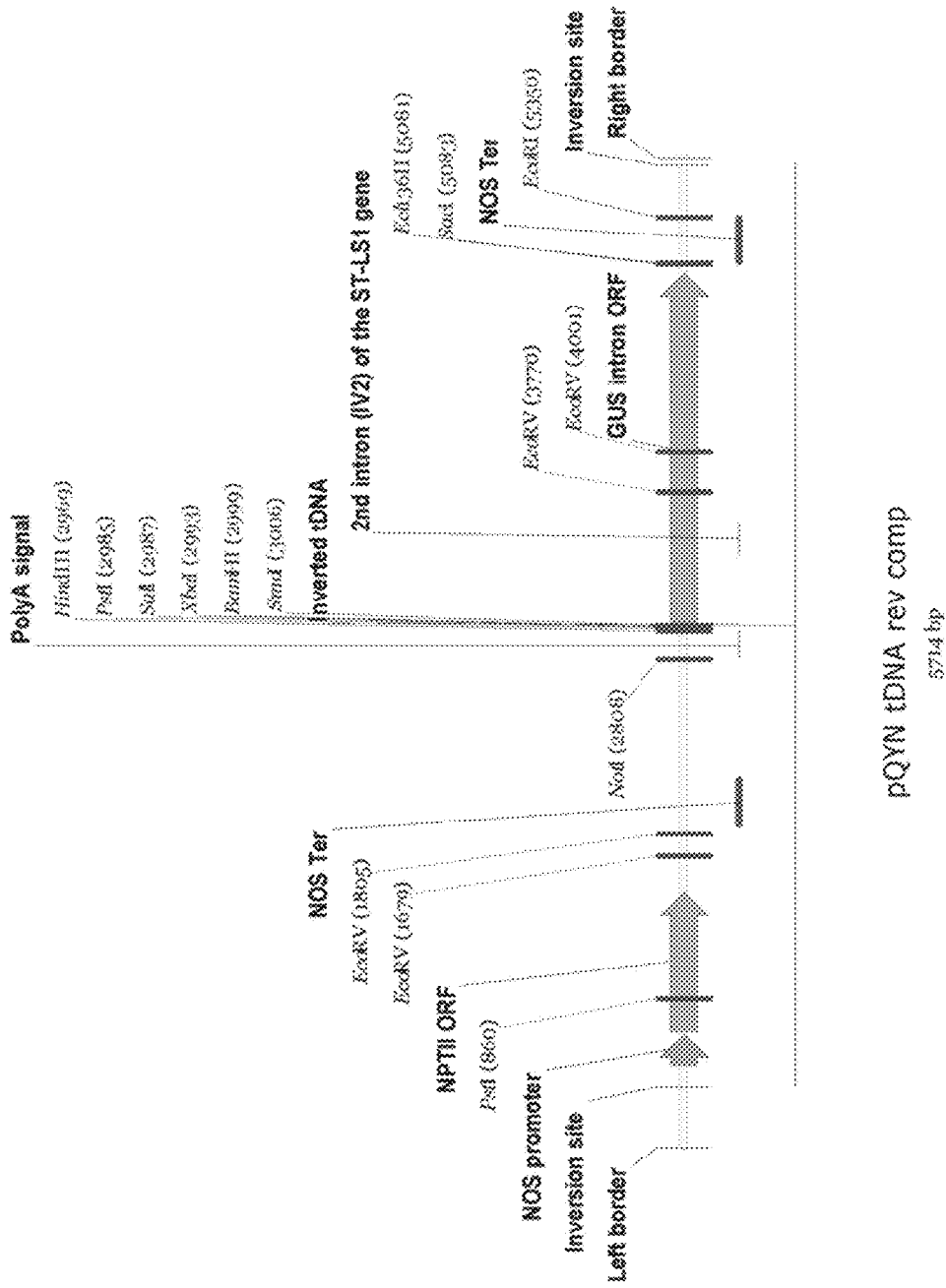
FIG. 5 is a schematic illustration of the pQYN plasmid (5714 bp).
Figure 6:
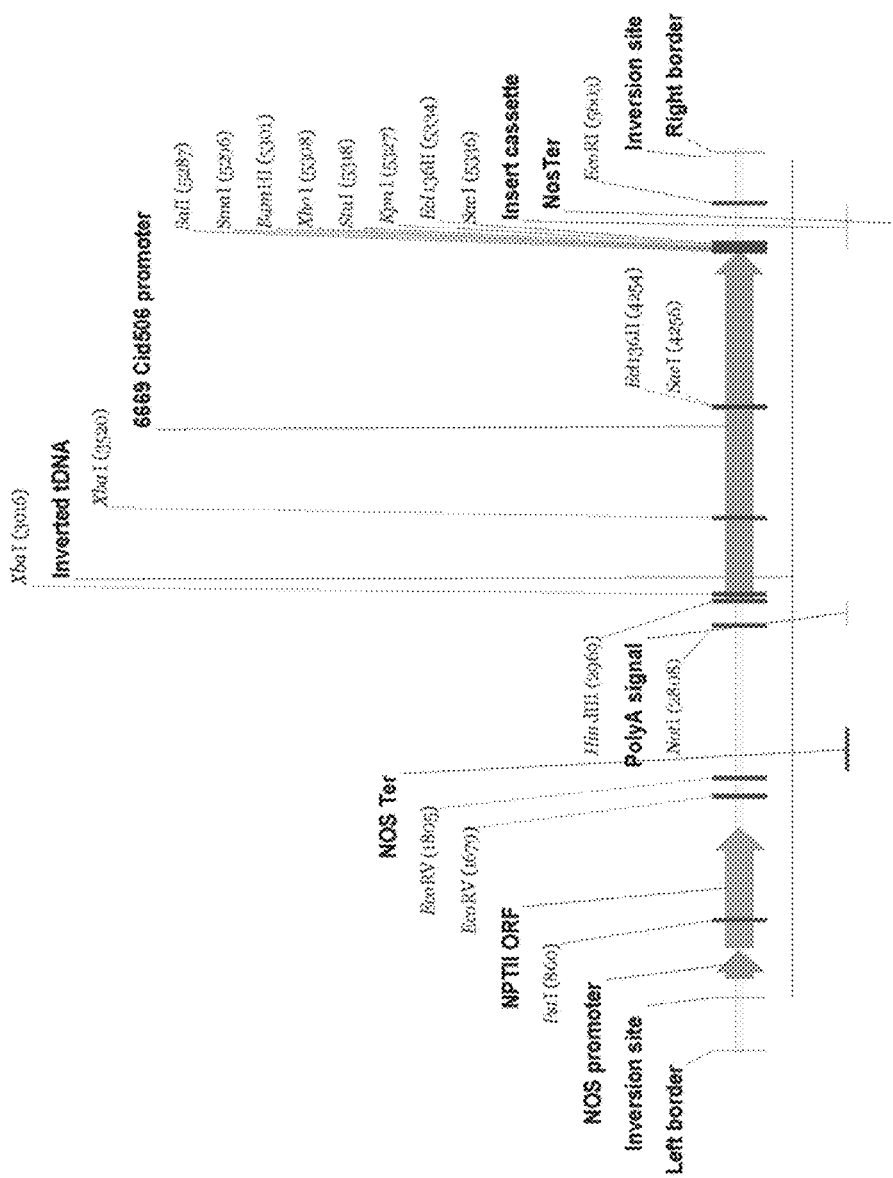
FIG. 6 is a schematic illustration of the pQFN plasmid (5967 bp).
Figure 7:
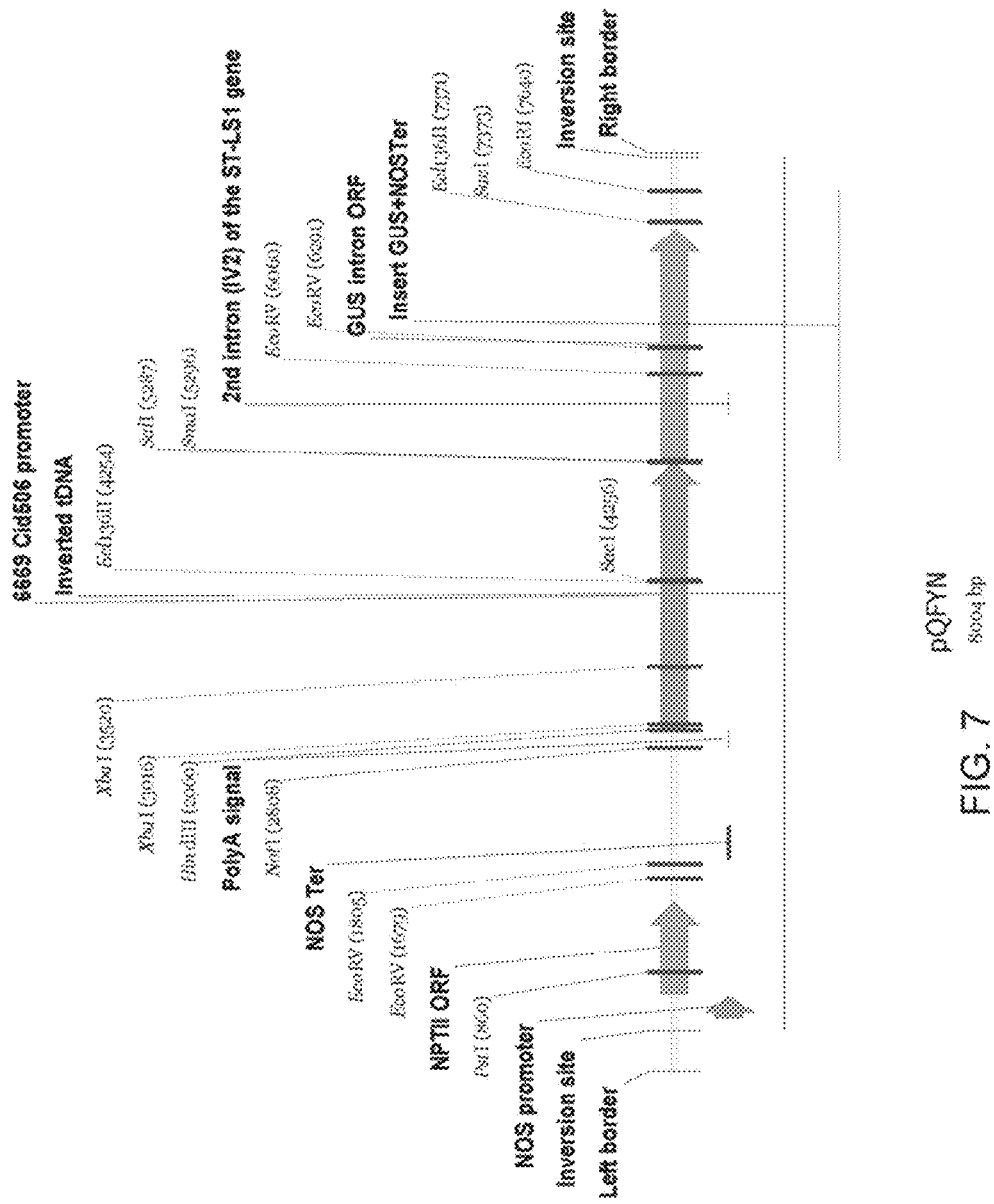
FIG. 7 is a schematic illustration of the pQFYN plasmid (8004 bp).
Figure 8:
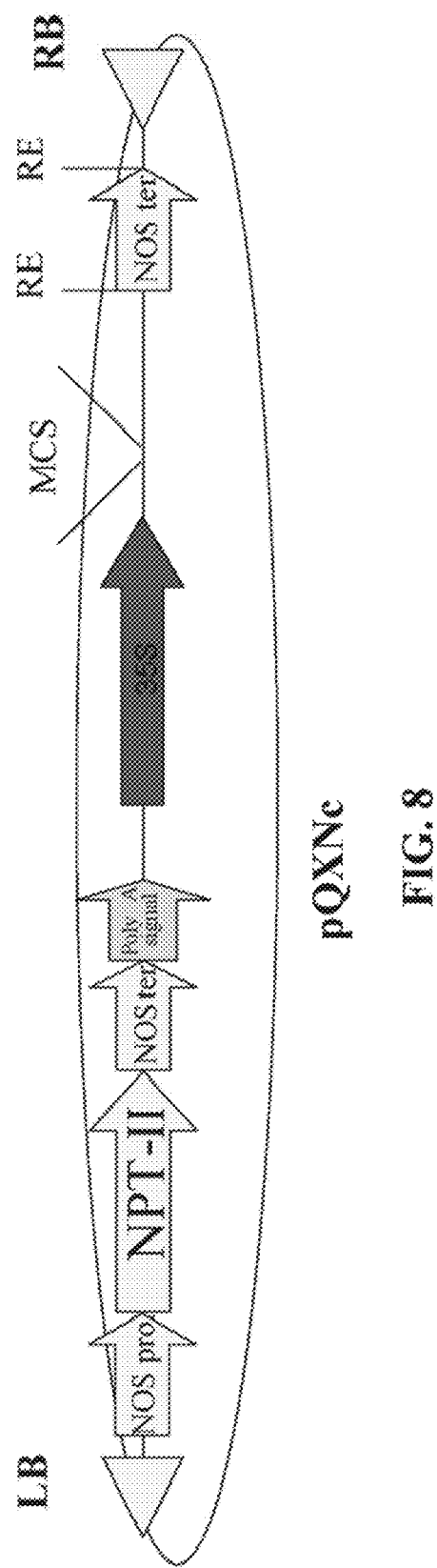
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO:3827). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN_6669 (FIG. 1)] are modified versions of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:3829) was inserted in the modified pGI binary vector, upstream to the cloned genes, followed by DNA ligation and binary plasmid extraction from positive *E. coli* colonies, as described above.

Colonies were analyzed by PCR using the primers covering the insert which were designed to span the introduced promoter and gene. Positive plasmids were identified, isolated and sequenced.

Genes which were cloned by the present inventors are provided in Table 68 below, along with the primers used for cloning.

TABLE 68

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LNU290 | Topo B | WHEAT *Triticum aestivum* L. ND | 3819, 3991 | 266 | 717 |
| LNU291 | pUC19c | SORGHUM *Sorghum bicolor* ND | 3820, 3992, 4153, 4264 | 267 | 471 |
| LNU292 | pUC19c | SORGHUM *Sorghum bicolor* ND | 3821, 3993, 4154, 4265 | 268 | 472 |
| LNU293 | pUC19c | RICE *Oryza sativa* L. Japonica Nipponbare | 4155, 4266 | 269 | 473 |
| LNU294 | pUC19c | SOYBEAN Glycine max 40-219 | 3822, 3994, 4156, 3994 | 270 | 718 |
| LNU295 | pUC19c | TOMATO *Lycopersicum esculentum* MD | 3823, 3995, 4157, 4267 | 271 | 475 |
| LNU296 | | | | 272 | 476 |
| LNU298 | | | | 273 | 478 |
| LNU299 | pUC19c | MAIZE *Zea mays* L. B73 | 3824, 3996, 4158, 4268 | 274 | 479 |
| LNU300 | pUC19c | MAIZE *Zea mays* L. B73 | 3835, 3997, 4159, 4269 | 275 | 480 |
| LNU301 | pUC19c | MAIZE *Zea mays* L. B73 | 3836, 3998, 3836, 4270 | 276 | 481 |
| LNU302 | pUC19c | TOMATO *Lycopersicum esculentum* MD | 3837, 3999, 4160, 4271 | 277 | 482 |
| LNU303 | Topo B | SORGHUM *Sorghum bicolor* ND | 4161, 4272 | 278 | 483 |
| LNU304 | pUC19c | RICE *Oryza sativa* L. Japonica Nipponbare | 3838, 4000, 4162, 4273 | 279 | 484 |
| LNU305 | pUC19c | BARLEY *Hordeum vulgare* L. Manit | 3839, 4001 | 280 | 719 |
| LNU306 | pUC19d | ARABIDOPSIS *Arabidopsis thaliana* Kondara | 3840, 4002 | 281 | 486 |
| LNU307 | Topo B | MAIZE *Zea mays* L. B73 | 3841, 4003 | 282 | 720 |
| LNU308 | pUC19c | ARABIDOPSIS *Arabidopsis thaliana* Kondara | 3842, 4004, 4163, 4274 | 283 | 488 |
| LNU309H3 | | | | 462 | 676 |
| LNU310 | pUC19c | TOMATO *Lycopersicum esculentum* MD | 3843, 4005, 4164, 4275 | 284 | 721 |
| LNU311 | | | | 285 | 491 |
| LNU312 | pUC19c | RICE *Oryza sativa* L. Japonica Nipponbare | 3844, 4006, 4165, 4006 | 286 | 492 |
| LNU314 | Topo B | SORGHUM *Sorghum bicolor* ND | 3845, 4007, 4166, 4276 | 287 | 493 |
| LNU315 | Topo B | WHEAT *Triticum aestivum* L. ND | 3846, 4008 | 288 | 494 |
| LNU316 | pUC19c | SORGHUM *Sorghum bicolor* ND | 3847, 4009, 3847, 4277 | 289 | 495 |
| LNU317 | pUC19c | MAIZE *Zea mays* L. B73 | 3848, 4010, 4167, 4278 | 290 | 496 |
| LNU318 | | | | 291 | 497 |
| LNU319 | pUC19c | SORGHUM *Sorghum bicolor* ND | 3849, 4011 | 292 | 498 |
| LNU322 | pUC19c | BARLEY *Hordeum vulgare* L. Manit | 3850, 4012, 4168, 4279 | 293 | 499 |
| LNU323 | pUC19c | TOMATO *Lycopersicum esculentum* MD | 3851, 4013, 3851, 4280 | 294 | 722 |
| LNU324 | Topo B | SORGHUM *Sorghum bicolor* ND | 3852, 4014, 4169, 4281 | 295 | 723 |
| LNU326 | pUC19c | TOMATO *Lycopersicum esculentum* MD | 3853, 4015, 4170, 4282 | 296 | 724 |
| LNU327 | Topo B | WHEAT *Triticum aestivum* L. EYAL | 3854, 4016, 3854, 4283 | 297 | 503 |
| LNU328 | pUC19c | TOMATO *Lycopersicum esculentum* MD | 3855, 4017, 4171, 4284 | 298 | 725 |
| LNU329 | pUC19c | TOMATO *Lycopersicum esculentum* MD | 3856, 4018, 4172, 4285 | 299 | 726 |
| LNU330 | pUC19c | TOMATO *Lycopersicum esculentum* MD | 3857, 4019, 4173, 4286 | 300 | 506 |
| LNU331 | Topo B | TOMATO *Lycopersicum esculentum* MD | 3858, 4020, 4174, 4287 | 301 | 727 |
| LNU332 | pUC19c | MAIZE *Zea mays* L. B73 | 4175, 4288 | 302 | 508 |
| LNU333 | | | | 303 | 509 |
| LNU335 | Topo B | WHEAT *Triticum aestivum* L. ND | 3859, 4021, 3859, 4021 | 304 | 728 |
| LNU336 | Topo B | TOMATO *Lycopersicum esculentum* MD | 3860, 4022, 4176, 4289 | 305 | 729 |
| LNU337 | pUC19d | GRAPE *Vitis vinifera* ND(red glob (red) x salt krik) | 3861, 4023, 4177, 4177 | 306 | 730 |
| LNU339 | Topo B | MAIZE *Zea mays* L. ND | 3862, 4024, 4178, 4290 | 307 | 513 |
| LNU340 | pUC19c | WHEAT *Triticum aestivum* L. EYAL | 3863, 4025, 3863, 4291 | 308 | 514 |
| LNU341 | | | | 309 | 515 |
| LNU342 | Topo B | TOMATO *Lycopersicum esculentum* MD | 3864, 4026, 4179, 4292 | 310 | 516 |
| LNU343 | Topo B | WHEAT *Triticum aestivum* L. EYAL | 4180, 4293 | 311 | 731 |
| LNU344 | pUC19c | WHEAT *Triticum aestivum* L. ND | 3865, 4027 | 312 | 518 |
| LNU345 | Topo B | WHEAT *Triticum aestivum* L. EYAL | 3866, 4028, 4181, 4294 | 313 | 519 |
| LNU346 | pUC19c | SORGHUM *Sorghum bicolor* ND | 4182, 4295 | 314 | 520 |
| LNU347 | pUC19c | SORGHUM *Sorghum bicolor* ND | 3867, 4029 | 315 | 521 |
| LNU348 | pUC19c | MAIZE *Zea mays* L. B73 | 3868, 4030 | 316 | 522 |
| LNU349 | pUC19c | SOYBEAN Glycine max 40-219 | 3869, 4031 | 317 | 523 |
| LNU350 | pUC19c | WHEAT *Triticum aestivum* L. ND | 3870, 4032, 4183, 4296 | 318 | 732 |
| LNU351 | pUC19c | WHEAT *Triticum aestivum* L. EYAL | 3871, 4033, 4184, 4297 | 319 | 525 |
| LNU352 | pUC19c | WHEAT *Triticum aestivum* L. EYAL | 3872, 4034, 3872, 4298 | 320 | 526 |

TABLE 68-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LNU353 | Topo B | WHEAT *Triticum aestivum* L. ND | 3873, 4035, 4185, 4299 | 321 | 527 |
| LNU354 | pUC19c | WHEAT *Triticum aestivum* L. EYAL | 3874, 4036, 4186, 4300 | 322 | 528 |
| LNU355 | pUC19d | WHEAT *Triticum aestivum* L. EYAL | 4187, 4301 | 323 | 529 |
| LNU356 | pUC19c | TOMATO *Lycopersicum esculentum* MD | 3875, 4037, 4188, 4302 | 324 | 530 |
| LNU357 | pUC19c | TOMATO *Lycopersicum esculentum* MD | 3876, 4038, 3876, 4303 | 325 | 531 |
| LNU359 | | | | 326 | 532 |
| LNU360 | Topo B | MAIZE *Zea mays* L. B73 | 3877, 4039, 4189, 4304 | 327 | 733 |
| LNU361 | pUC19c | MAIZE *Zea mays* L. B73 | 4190, 4305 | 328 | 734 |
| LNU362 | pUC19c | RICE *Oryza sativa* L. Japonica Nipponbare | 3878, 4040, 4191, 4306 | 329 | 535 |
| LNU363 | Topo B | RICE *Oryza sativa* L. Japonica Nipponbare | 3879, 4041, 4192, 4307 | 330 | 536 |
| LNU364 | pUC19c | RICE *Oryza sativa* L. Japonica Nipponbare | 3880, 4042, 4193, 4308 | 331 | 537 |
| LNU365 | pUC19c | RICE *Oryza sativa* L. Japonica Nipponbare | 4194, 4309 | 332 | 538 |
| LNU366 | Topo B | RICE *Oryza sativa* L. Japonica Nipponbare | 4195, 4310 | 333 | 539 |
| LNU367 | Topo B | RICE *Oryza sativa* L. Japonica Nipponbare | 4196, 4311 | 334 | 540 |
| LNU368 | pUC19c | WHEAT *Triticum aestivum* L. ND | 3881, 4043, 3881, 4312 | 335 | 735 |
| LNU369 | pUC19c | WHEAT *Triticum aestivum* L. ND | 3882, 4044 | 336 | 542 |
| LNU370 | pUC19c | TOMATO *Lycopersicum esculentum* MD | 3883, 4045, 3883, 4313 | 337 | 543 |
| LNU371 | pUC19c | MAIZE *Zea mays* L. B73 | 4197, 4314 | 338 | 736 |
| LNU372 | Topo B | WHEAT *Triticum aestivum* L. ND | 3884, 4046, 3884, 4315 | 339 | 737 |
| LNU373 | pUC19c | RICE *Oryza sativa* L. Indica Lebbonet | 3885, 4047, 4198, 4316 | 340 | 546 |
| LNU374 | pUC19c | RICE *Oryza sativa* L. Japonica Nipponbare | 3886, 4048, 4199, 4317 | 341 | 547 |
| LNU375 | pUC19c | TOMATO *Lycopersicum esculentum* MD | 3887, 4049, 4200, 4318 | 342 | 548 |
| LNU376 | pUC19c | MAIZE *Zea mays* L. B73 | 3888, 4050, 4201, 4319 | 343 | 549 |
| LNU377 | pUC19c | SORGHUM *Sorghum bicolor* ND | 3889, 4051, 3889, 4320 | 344 | 550 |
| LNU378 | pUC19c | WHEAT *Triticum aestivum* L. EYAL | 3890, 4052, 4202, 4052 | 235 | 738 |
| LNU379 | pUC19c | SORGHUM *Sorghum bicolor* ND | 3891, 4053, 3891, 4321 | 345 | 552 |
| LNU380 | Topo B | WHEAT *Triticum aestivum* L. ND | 3892, 4054 | 346 | 739 |
| LNU381 | pUC19c | SORGHUM *Sorghum bicolor* ND | 3893, 4055, 3893, 4322 | 347 | 554 |
| LNU382 | pUC19c | ARABIDOPSIS *Arabidopsis thaliana* Kondara | 3894, 4056, 4203, 4056 | 348 | 740 |
| LNU383 | pUC19c | TOMATO *Lycopersicum esculentum* MD | 3895, 4057, 4204, 4323 | 349 | 556 |
| LNU384 | Topo B | TOMATO *Lycopersicum esculentum* MD | 3896, 4058, 4205, 4324 | 350 | 741 |
| LNU385 | Topo B | RICE *Oryza sativa* L. Japonica Nipponbare | 3897, 4059, 4206, 4325 | 351 | 558 |
| LNU386 | pUC19c | RICE *Oryza sativa* L. Indica Lebbonet | 4207, 4326 | 352 | 559 |
| LNU387 | pUC19c | SORGHUM *Sorghum bicolor* ND | 3898, 4060 | 353 | 742 |
| LNU388 | | | | 354 | 561 |
| LNU390 | pUC19d | TOMATO *Lycopersicum esculentum* MD | 3899, 4061, 3899, 4327 | 355 | 743 |
| LNU391 | pUC19c | BARLEY *Hordeum vulgare* L. Manit | 3900, 4062, 4208, 4328 | 356 | 563 |
| LNU392 | pUC19c | RICE *Oryza sativa* L. Japonica Nipponbare | 3901, 4063, 4209, 4329 | 357 | 564 |
| LNU393 | pUC19c | SORGHUM *Sorghum bicolor* ND | 3902, 4064, 3902, 4330 | 358 | 744 |
| LNU395 | Topo B | SORGHUM *Sorghum bicolor* ND | 3903, 4065 | 359 | 566 |
| LNU396 | pUC19c | SORGHUM *Sorghum bicolor* ND | 3904, 4066, 4210, 4331 | 360 | 567 |
| LNU397 | Topo B | SORGHUM *Sorghum bicolor* ND | 4211, 4332 | 361 | 745 |
| LNU399 | pUC19c | WHEAT *Triticum aestivum* L. EYAL | 3905, 4067, 4212, 4333 | 362 | 569 |
| LNU401 | pUC19c | SORGHUM *Sorghum bicolor* ND | 3906, 4068, 4213, 4334 | 363 | 746 |
| LNU402 | pUC19c | WHEAT *Triticum aestivum* L. ND | 3907, 4069, 3907, 4335 | 364 | 747 |
| LNU403 | pUC19c | SORGHUM *Sorghum bicolor* ND | 3908, 4070 | 365 | 572 |
| LNU405 | pUC19c | TOMATO *Lycopersicum esculentum* MD | 3909, 4071, 3909, 4336 | 366 | 748 |
| LNU407 | Topo B | BARLEY *Hordeum vulgare* L. Manit | 3910, 4072, 4214, 4337 | 367 | 749 |
| LNU408 | pUC19c | BARLEY *Hordeum vulgare* L. Spontaneum | 3911, 4073 | 368 | 575 |
| LNU409 | Topo B | BARLEY *Hordeum vulgare* L. Manit | 3912, 4074, 3912, 4338 | 369 | 750 |
| LNU410 | pUC19c | WHEAT *Triticum aestivum* L. ND | 4215, 4339 | 370 | 577 |
| LNU411 | pUC19c | TOMATO *Lycopersicum esculentum* MD | 3913, 4075, 3913, 4340 | 371 | 578 |
| LNU412 | pUC19c | COTTON *Gossypium barbadense* Pima | 3914, 4076, 4216, 4341 | 372 | 751 |
| LNU413 | pUC19c | TOMATO *Lycopersicum esculentum* MD | 4217, 4342 | 373 | 752 |
| LNU414 | pUC19c | WHEAT *Triticum aestivum* L. ND | 3915, 4077 | 374 | 753 |
| LNU415 | pUC19c | SORGHUM *Sorghum bicolor* ND | 3916, 4078, 4218, 4343 | 375 | 582 |
| LNU416 | pUC19c | MUSTARD *Brassica juncea* ND | 3917, 4079 | 376 | 754 |
| LNU419 | pUC19c | TOMATO *Lycopersicum esculentum* MD | 3918, 4080, 4219, 4344 | 377 | 755 |
| LNU420 | pUC19c | SORGHUM *Sorghum bicolor* ND | 3919, 4081, 4220, 4345 | 378 | 586 |
| LNU421 | pUC19c | SORGHUM *Sorghum bicolor* ND | 3920, 4082, 3920, 4346 | 379 | 756 |
| LNU422 | pUC19c | SORGHUM *Sorghum bicolor* ND | 4221, 4347 | 380 | 588 |
| LNU423 | pUC19c | SORGHUM *Sorghum bicolor* ND | 4222, 4348 | 381 | 589 |
| LNU424 | pUC19c | ARABIDOPSIS *Arabidopsis thaliana* Kondara | 3921, 4083, 4223, 4349 | 382 | 590 |
| LNU425 | pUC19c | BARLEY *Hordeum vulgare* L. Manit | 3922, 4084, 4224, 4350 | 383 | 591 |
| LNU426 | | | | 384 | 592 |
| LNU427 | pUC19c | RICE *Oryza sativa* L. Japonica Nipponbare | 3923, 4085, 4225, 4351 | 385 | 593 |
| LNU429 | pUC19c | TOMATO *Lycopersicum esculentum* MD | 3924, 4086, 4226, 4086 | 386 | 594 |
| LNU430 | pUC19c | TOMATO *Lycopersicum esculentum* MD | 4227, 4352 | 387 | 595 |
| LNU432 | pUC19c | SORGHUM *Sorghum bicolor* ND | 3925, 4087, 4228, 4353 | 388 | 597 |
| LNU433 | Topo B | SORGHUM *Sorghum bicolor* ND | 3926, 4088, 4229, 4354 | 389 | 598 |
| LNU434 | | | | 390 | 599 |
| LNU435 | Topo B | BARLEY *Hordeum vulgare* L. Manit | 3927, 4089, 4230, 4355 | 391 | 600 |
| LNU436 | Topo B | BARLEY *Hordeum vulgare* L. Manit | 3928, 4090 | 392 | 601 |
| LNU437_H2 | Topo B | RICE *Oryza sativa* L. Japonica Nipponbare | 3929, 4091, 4231, 4356 | 465 | 679 |
| LNU438 | pUC19c | BARLEY *Hordeum vulgare* L. Manit | 3930, 4092, 3930, 4357 | 393 | 603 |

TABLE 68-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LNU439 | pUC19c | SORGHUM Sorghum bicolor ND | 3931, 4093, 4232, 4358 | 394 | 757 |
| LNU442 | pUC19c | TOMATO Lycopersicum esculentum MD | 3932, 4094, 4233, 4359 | 395 | 758 |
| LNU443 | Topo B | BRACHYPODIUM Brachypodiums distachyon ND | 3933, 4095, 3933, 4360 | 396 | 607 |
| LNU444 | pUC19c | COTTON Gossypium barbadense Pima | 3934, 4096 | 397 | 759 |
| LNU446 | pUC19c | SOYBEAN Glycine max 40-219 | 3935, 4097, 3935, 4361 | 398 | 610 |
| LNU447 | pUC19c | BARLEY Hordeum vulgare L. Manit | 3936, 4098, 3936, 4362 | 399 | 760 |
| LNU448 | pUC19c | BARLEY Hordeum vulgare L. Spontaneum | 3937, 4099, 4234, 4363 | 400 | 761 |
| LNU449 | pUC19c | COTTON Gossypium barbadense Pima | 3938, 4100 | 401 | 762 |
| LNU450 | pUC19c | COTTON Gossypium barbadense Pima | 3939, 4101, 4235, 4364 | 402 | 763 |
| LNU451 | pUC19c | TOMATO Lycopersicum esculentum MD | 3940, 4102, 4236, 4365 | 403 | 615 |
| LNU453 | | | | 404 | 616 |
| LNU454 | Topo B | TOMATO Lycopersicum esculentum MD | 3941, 4103 | 405 | 764 |
| LNU455 | pUC19c | TOMATO Lycopersicum esculentum MD | 3942, 4104, 3942, 4366 | 406 | 618 |
| LNU456 | pUC19c | BARLEY Hordeum vulgare L. Manit | 3943, 4105, 3943, 4367 | 407 | 619 |
| LNU458 | pUC19c | COTTON Gossypium barbadense Pima | 3944, 4106, 3944, 4368 | 408 | 621 |
| LNU459 | pUC19c | MAIZE Zea mays L. B73 | 3945, 4107, 4237, 4369 | 409 | 622 |
| LNU460 | pUC19c | MAIZE Zea mays L. B73 | 3946, 4108, 3946, 4370 | 410 | 765 |
| LNU461 | Topo B | TOMATO Lycopersicum esculentum MD | 3947, 4109, 4238, 4371 | 411 | 766 |
| LNU462 | pUC19c | TOMATO Lycopersicum esculentum MD | 3948, 4110, 4239, 4372 | 412 | 625 |
| LNU463 | pUC19c | GRAPE Vitis vinifera ND(red glob (red) x salt krik) | 3949, 4111 | 413 | 767 |
| LNU464 | | | | 414 | 627 |
| LNU465 | Topo B | SORGHUM Sorghum bicolor ND | 3950, 4112, 3950, 4373 | 415 | 768 |
| LNU466 | | | | 416 | 629 |
| LNU467 | pUC19c | BARLEY Hordeum vulgare L. Spontaneum | 3951, 4113, 4240, 4374 | 417 | 630 |
| LNU468 | pUC19c | TOMATO Lycopersicum esculentum MD | 3952, 4114, 4241, 4375 | 418 | 769 |
| LNU469 | pUC19c | MAIZE Zea mays L. B73 | 3953, 4115, 3953, 4376 | 419 | 632 |
| LNU470 | Topo B | BARLEY Hordeum vulgare L. Spontaneum | 3954, 4116, 4242, 4377 | 420 | 770 |
| LNU471 | Topo B | MAIZE Zea mays L. B73 | 3955, 4117, 4243, 4378 | 421 | 771 |
| LNU472 | pUC19c | BARLEY Hordeum vulgare L. Manit | 3956, 4118, 4244, 4379 | 422 | 772 |
| LNU473 | | | | 423 | 636 |
| LNU474 | pUC19c | SOYBEAN Glycine max 40-219 | 3957, 4119, 4245, 4119 | 424 | 773 |
| LNU476 | pUC19c | MAIZE Zea mays L. B73 | 3958, 4120, 3958, 4380 | 425 | 774 |
| LNU477 | pUC19c | SORGHUM Sorghum bicolor ND | 3959, 4121, 4246, 4381 | 426 | 639 |
| LNU479 | | | | 427 | 640 |
| LNU480 | Topo B | SORGHUM Sorghum bicolor ND | 3960, 4122, 3960, 4382 | 428 | 641 |
| LNU481 | Topo B | SORGHUM Sorghum bicolor ND | 3961, 4123, 4247, 4383 | 429 | 642 |
| LNU482 | Topo B | COTTON Gossypium barbadense Pima | 3962, 4124, 4248, 4384 | 430 | 775 |
| LNU483 | Topo B | RICE Oryza sativa L. Japonica Nipponbare | 4249, 4385 | 431 | 644 |
| LNU485 | pUC19c | RICE Oryza sativa L. Japonica Nipponbare | 3963, 4125, 4250, 4386 | 432 | 776 |
| LNU486 | pUC19c | RICE Oryza sativa L. Japonica Nipponbare | 3964, 4126 | 433 | 646 |
| LNU487 | pUC19c | BARLEY Hordeum vulgare L. Manit | 4251, 4387 | 469 | — |
| LNU488 | | | | 216 | — |
| LNU489 | pUC19c | TOMATO Lycopersicum esculentum MD | 3965, 4127, 4252, 4388 | 434 | 647 |
| LNU490 | | | | 435 | 648 |
| LNU491 | pUC19c | SORGHUM Sorghum bicolor ND | 3966, 4128, 4253, 4389 | 436 | 649 |
| LNU492 | pUC19c | RICE Oryza sativa L. Japonica Nipponbare | 3967, 4129 | 437 | 650 |
| LNU493 | pUC19c | RICE Oryza sativa L. Japonica Nipponbare | 3968, 4130 | 438 | 651 |
| LNU494 | | | | 439 | 652 |
| LNU495 | pUC19c | SORGHUM Sorghum bicolor ND | 3969, 4131, 3969, 4390 | 440 | 777 |
| LNU496 | pUC19c | WHEAT Triticum aestivum L. ND | 3970, 4132, 4254, 4391 | 441 | 778 |
| LNU497 | pUC19c | WHEAT Triticum aestivum L. ND | 3971, 4133, 4255, 4392 | 442 | 655 |
| LNU498 | pUC19c | SORGHUM Sorghum bicolor ND | 3972, 4134, 4256, 4393 | 443 | 656 |
| LNU499 | Topo B | BARLEY Hordeum vulgare L. Manit | 3973, 4135, 3973, 4394 | 444 | 779 |
| LNU500 | pUC19c | TOMATO Lycopersicum esculentum MD | 3974, 4136 | 445 | 658 |
| LNU501 | pUC19c | SORGHUM Sorghum bicolor ND | 3975, 4137, 3975, 4395 | 446 | 659 |
| LNU502 | pUC19c | BARLEY Hordeum vulgare L. Spontaneum | 3976, 4138, 3976, 4396 | 447 | 660 |
| LNU503 | pUC19c | RICE Oryza sativa L. Japonica Nipponbare | 3977, 4139 | 448 | 661 |
| LNU504 | pUC19c | ARABIDOPSIS Arabidopsis thaliana Kondara | 3978, 4140 | 449 | 780 |
| LNU507 | pUC19c | BARLEY Hordeum vulgare L. Manit | 3979, 4141 | 450 | 781 |
| LNU508 | Topo B | RICE Oryza sativa L. Japonica Nipponbare | 3980, 4142, 4257, 4257 | 451 | 665 |
| LNU509 | pUC19c | RICE Oryza sativa L. Japonica Nipponbare | 3981, 4143, 3981, 4397 | 452 | 666 |
| LNU510 | Topo B | RICE Oryza sativa L. Japonica Nipponbare | 3982, 4144, 4258, 4398 | 453 | 667 |
| LNU511 | pUC19c | RICE Oryza sativa L. Japonica Nipponbare | 4259, 4399 | 454 | 668 |
| LNU512 | pUC19c | ARABIDOPSIS Arabidopsis thaliana Kondara | 3983, 4145, 4260, 4400 | 455 | 669 |
| LNU513 | pUC19c | SOYBEAN Glycine max 40-219 | 3984, 4146, 3984, 4401 | 456 | 782 |
| LNU514 | Topo B | RICE Oryza sativa L. Japonica Nipponbare | 3985, 4147, 3985, 4402 | 457 | 671 |
| LNU517 | pUC19c | SOYBEAN Glycine max 40-219 | 3986, 4148, 4261, 4403 | 458 | 783 |
| LNU518 | Topo B | MAIZE Zea mays L. B73 | 3987, 4149 | 459 | 673 |
| LNU519 | Topo B | MAIZE Zea mays L. B73 | 3988, 4150, 4262, 4404 | 460 | 784 |
| LNU520 | Topo B | SORGHUM Sorghum bicolor ND | 3989, 4151 | 461 | 675 |
| LNU313 | pUC19c | SORGHUM Sorghum bicolor ND | 4263, 4405 | 466 | — |

TABLE 68-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LNU358 | | | | 212 | — |
| LNU394 | | | | 467 | — |
| LNU418 | pUC19c | MAIZE Zea mays L. B73 | 3990, 4152, 3990, 4406 | 468 | — |

Provided are the genes which were cloned in high copy plasmids, along with the primers used for cloning, the organisms from which the genes were cloned and the resulting polynucleotide ("polyn.") and polypeptide ("polyp.") sequences of the cloned gene.

Example 14

Transforming *Agrobacterium Tumefaciens* Cells with Binary Vectors Harboring Putative Genes Each of the binary vectors described in Example 13 above were used to transform *Agrobacterium* cells. Two additional binary constructs, having only the At6669, or the RootP promoter or no additional promoter were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. Abrobacterium colonies, which were developed on the selective media, were further analyzed by PCR using the primers designed to span the inserted sequence in the pPI plasmid. The resulting PCR products were isolated and sequenced as described in Example 13 above, to verify that the correct polynucleotide sequences of the invention are properly introduced to the *Agrobacterium* cells.

Example 15

Transformation of *Arabidopsis Thaliana* Plants with the Polynucleotides of the Invention

*Arabidopsis thaliana* Columbia plants ($T_0$ plants) were transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The $T_0$ plants were ready for transformation six days before anthesis.

Single colonies of *Agrobacterium* carrying the binary constructs, were generated as described in Examples 13 and 14 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the *Agrobacterium* cells were re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension, such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques are brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours, then transferred to a growth room at 25° C. for an additional week of incubation. Vital $T_1$ *Arabidopsis* plants were transferred to fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 16

Evaluating Transgenic *Arabidopsis* NUE Under Low or Normal Nitrogen Conditions Using In Vitro (Tissue Culture) Assays Assay 1: Plant Growth Under Low and Favorable Nitrogen Concentration Levels Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, is used for capturing images of plantlets sawn in agar plates.

The image capturing process is repeated every 3-4 days starting at day 1 till day 10. An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following Formulas VI (RGR of leaf area, above), XVIII (RGR root length, below) and Formula VII (RGR of root coverage, above).

Relative growth rate of root length=Regression coefficient of root length along time course      Formula XVIII At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results are used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events are examined in replicates.

Statistical Analyses—

To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value is calculated. Results were considered significant if p ≤0.1. The JMP statistics software package was used (Version 5.2.1, SAS Institute Inc., Cary, N.C., USA).

Experimental Results:

The genes presented in the following Tables were cloned under the regulation of a constitutive promoter (At6669). The evaluation of each gene was carried out by testing the performance of different number of events. Some of the genes were evaluated in more than one tissue culture assay. The results obtained in these second experiments were significantly positive as well. The evaluation of each gene was performed by testing the performance of different number of events. Event with p-value<0.1 was considered statistically significant.

The genes presented in Tables 69-72 showed a significant improvement in plant NUE since they produced larger plant biomass (plant fresh and dry weight; leaf area, root length and root coverage) in T2 generation (Tables 69-70) or T1 generation (Tables 71-72) when grown under limiting nitrogen growth conditions, compared to control plants. Plants producing larger root biomass have better possibilities to absorb larger amount of nitrogen from soil.

TABLE 69

| Genes showing improved plant performance at nitrogen deficient conditions (T2 generation) | | | | | | | |
|---|---|---|---|---|---|---|---|
| Gene | Event | Dry Weight [mg] | | | Fresh Weight [mg] | | |
| Name | # | Ave. | P-Val. | % Incr. | Ave. | P-Val. | % Incr. |
| LNU437_H2 | 66104.1 | 5.2 | 0.02 | 43 | 79.4 | 0.17 | 21 |
| LNU437_H2 | 66104.2 | 4.7 | 0.29 | 29 | — | — | — |
| LNU437_H2 | 66104.3 | 4.8 | 0.08 | 31 | 81.4 | 0.18 | 24 |
| LNU437_H2 | 66105.3 | 4.8 | 0.11 | 31 | 93.8 | 0.13 | 43 |
| LNU426 | 66147.3 | 6.6 | L | 80 | 120.6 | L | 84 |
| LNU420 | 64008.4 | 5.0 | 0.09 | 36 | — | — | — |
| LNU352 | 64199.1 | 6.3 | L | 71 | 106.9 | L | 63 |
| LNU292 | 64085.4 | 4.8 | 0.08 | 31 | 87.7 | 0.05 | 34 |
| CONT. | — | 3.7 | — | — | 65.5 | — | — |
| LNU483 | 64803.2 | 7.5 | 0.07 | 33 | 153.0 | L | 42 |
| LNU483 | 64805.1 | 8.6 | 0.03 | 52 | 139.3 | L | 29 |
| LNU483 | 64805.2 | 6.5 | 0.09 | 16 | 137.8 | L | 28 |
| LNU483 | 64806.2 | 7.3 | 0.12 | 29 | 141.4 | 0.04 | 31 |
| LNU477 | 63886.1 | 6.4 | 0.07 | 13 | 128.0 | 0.07 | 19 |
| LNU477 | 63888.1 | 6.4 | 0.20 | 14 | 123.2 | 0.18 | 14 |
| LNU464 | 65076.4 | 6.4 | 0.27 | 13 | 138.2 | 0.09 | 28 |

TABLE 69-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU447 | 65000.4 | 7.2 | 0.14 | 28 | 138.2 | 0.10 | 28 |
| LNU447 | 65002.2 | 6.4 | 0.18 | 13 | 138.8 | 0.07 | 29 |
| LNU447 | 65002.3 | — | — | — | 119.3 | 0.27 | 11 |
| LNU439 | 64616.2 | 7.6 | 0.04 | 35 | 148.7 | 0.11 | 38 |
| LNU439 | 64616.3 | 8.2 | 0.07 | 45 | 152.3 | 0.04 | 41 |
| LNU439 | 64618.3 | 7.1 | 0.11 | 26 | 134.1 | 0.11 | 24 |
| LNU425 | 63910.9 | — | — | — | 119.3 | 0.25 | 11 |
| LNU425 | 63911.9 | 8.7 | 0.04 | 55 | 172.5 | 0.03 | 60 |
| LNU414 | 64475.1 | 7.8 | 0.02 | 39 | 138.4 | L | 28 |
| LNU414 | 64479.1 | 8.1 | 0.02 | 44 | 150.5 | L | 40 |
| LNU414 | 64480.2 | 7.8 | 0.12 | 38 | 152.4 | 0.09 | 41 |
| LNU346 | 65008.2 | 7.1 | 0.14 | 26 | 136.5 | 0.01 | 27 |
| LNU336 | 64447.2 | — | — | — | 135.7 | 0.12 | 26 |
| LNU336 | 64448.2 | 8.4 | 0.10 | 50 | 163.0 | 0.03 | 51 |
| LNU336 | 64448.3 | 6.3 | 0.05 | 12 | 126.5 | 0.01 | 17 |
| LNU336 | 64449.3 | 7.4 | 0.03 | 31 | 135.3 | 0.25 | 26 |
| CONT. | — | 5.6 | — | — | 107.8 | — | — |
| LNU473 | 65770.4 | 5.4 | 0.13 | 21 | 102.8 | 0.26 | 18 |
| LNU470 | 64229.1 | 6.0 | 0.13 | 33 | 123.1 | 0.13 | 41 |
| LNU460 | 64359.4 | — | — | — | 95.3 | 0.26 | 9 |
| LNU421 | 64303.3 | 6.0 | 0.19 | 35 | 136.2 | 0.06 | 56 |
| LNU421 | 64304.4 | — | — | — | 95.8 | 0.24 | 10 |
| LNU408 | 64248.10 | 5.2 | 0.28 | 16 | 108.7 | 0.29 | 25 |
| LNU408 | 64250.8 | 6.0 | 0.17 | 35 | 125.6 | 0.25 | 44 |
| LNU380 | 65765.3 | — | — | — | 109.1 | 0.04 | 25 |
| LNU340 | 64290.7 | 6.1 | 0.17 | 36 | 124.9 | 0.08 | 43 |
| LNU331 | 64212.1 | — | — | — | 111.9 | 0.25 | 29 |
| LNU331 | 64214.2 | — | — | — | 122.7 | 0.04 | 41 |
| LNU331 | 64215.1 | 8.0 | L | 78 | 156.9 | L | 80 |
| LNU306 | 64132.6 | — | — | — | 99.3 | 0.21 | 14 |
| CONT. | — | 4.5 | — | — | 87.1 | — | — |
| LNU456 | 63991.8 | — | — | — | 85.1 | 0.26 | 23 |
| LNU456 | 63992.6 | — | — | — | 106.8 | 0.06 | 55 |
| LNU430 | 63934.3 | 6.4 | 0.04 | 67 | 129.1 | 0.04 | 87 |
| LNU430 | 63952.1 | — | — | — | 81.3 | 0.27 | 18 |
| LNU412 | 63940.1 | — | — | — | 93.1 | 0.08 | 35 |
| LNU412 | 63940.12 | — | — | — | 84.8 | 0.08 | 23 |
| LNU412 | 63940.8 | 5.3 | 0.29 | 39 | — | — | — |
| LNU407 | 64218.1 | 4.9 | 0.12 | 28 | 96.2 | 0.14 | 40 |
| LNU407 | 64218.2 | — | — | — | 93.1 | 0.11 | 35 |
| LNU407 | 64219.2 | 6.9 | L | 79 | 115.7 | L | 68 |
| LNU384 | 64161.1 | — | — | — | 78.9 | 0.27 | 14 |
| LNU384 | 64161.3 | — | — | — | 91.2 | 0.03 | 32 |
| LNU384 | 64161.7 | — | — | — | 82.2 | 0.13 | 19 |
| LNU360 | 64029.3 | — | — | — | 91.5 | 0.11 | 33 |
| LNU335 | 64168.18 | — | — | — | 82.2 | 0.22 | 19 |
| LNU335 | 64169.2 | 5.5 | 0.10 | 44 | 113.0 | 0.09 | 64 |
| LNU301 | 63927.3 | — | — | — | 167.8 | 0.01 | 143 |
| LNU301 | 63927.5 | — | — | — | 86.0 | 0.12 | 25 |
| LNU301 | 63950.3 | 7.2 | 0.02 | 88 | 136.0 | L | 97 |
| CONT. | — | 3.8 | — | — | 68.9 | — | — |
| LNU450 | 63708.3 | 6.8 | 0.14 | 34 | 136.4 | 0.05 | 63 |
| LNU450 | 63710.2 | 6.3 | 0.01 | 24 | 122.7 | L | 46 |
| LNU450 | 63712.3 | 7.0 | L | 39 | 117.8 | 0.12 | 40 |
| LNU429 | 63937.4 | — | — | — | 102.1 | 0.03 | 22 |
| LNU416 | 64134.2 | — | — | — | 95.7 | 0.10 | 14 |
| LNU416 | 64136.4 | 7.3 | 0.05 | 45 | 132.1 | 0.01 | 58 |
| LNU412 | 63940.12 | — | — | — | 136.8 | 0.15 | 63 |
| LNU412 | 63940.8 | — | — | — | 114.6 | 0.20 | 37 |
| LNU359 | 66154.5 | — | — | — | 97.3 | 0.06 | 16 |
| LNU359 | 66154.6 | — | — | — | 106.3 | 0.16 | 27 |
| LNU349 | 63990.4 | — | — | — | 101.5 | 0.02 | 21 |
| LNU293 | 65048.1 | — | — | — | 109.3 | L | 30 |
| LNU293 | 65050.3 | — | — | — | 97.5 | 0.11 | 16 |
| LNU293 | 65051.3 | — | — | — | 120.5 | 0.14 | 44 |
| CONT. | — | 5.1 | — | — | 83.8 | — | — |
| LNU498 | 64185.3 | 5.1 | 0.13 | 32 | 119.0 | 0.15 | 28 |
| LNU493 | 64190.3 | — | — | — | 108.9 | 0.26 | 17 |
| LNU493 | 64191.4 | — | — | — | 113.4 | 0.29 | 22 |
| LNU455 | 64187.5 | — | — | — | 109.8 | 0.30 | 18 |
| LNU343 | 64208.4 | 4.4 | 0.13 | 15 | — | — | — |
| LNU322 | 63918.1 | 4.6 | 0.09 | 21 | — | — | — |
| LNU305 | 64111.2 | 4.3 | 0.26 | 13 | — | — | — |
| CONT. | — | 3.8 | — | — | 93.1 | — | — |

TABLE 69-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU487 | 64706.2 | 4.8 | 0.02 | 22 | — | — | — |
| LNU465 | 64020.1 | 4.6 | 0.07 | 17 | 84.2 | 0.23 | 13 |
| LNU446 | 64546.2 | 4.6 | 0.26 | 18 | 91.9 | 0.13 | 23 |
| LNU446 | 64546.3 | 5.1 | 0.18 | 28 | — | — | — |
| LNU443 | 64023.2 | 5.0 | 0.18 | 26 | 82.5 | 0.29 | 11 |
| LNU443 | 64024.3 | 6.4 | L | 62 | — | — | — |
| LNU436 | 64240.1 | 4.9 | 0.03 | 24 | — | — | — |
| LNU436 | 64240.2 | 5.4 | 0.10 | 36 | 103.7 | 0.09 | 39 |
| LNU436 | 64242.2 | 5.6 | L | 43 | — | — | — |
| LNU379 | 64170.2 | 4.9 | 0.28 | 23 | 95.0 | 0.22 | 27 |
| LNU315 | 64224.1 | 4.8 | 0.09 | 20 | 82.9 | 0.28 | 11 |
| LNU315 | 64224.3 | 5.8 | 0.07 | 47 | 104.6 | L | 40 |
| LNU315 | 64225.1 | 4.8 | 0.02 | 22 | 88.2 | 0.16 | 18 |
| LNU315 | 64227.3 | 4.4 | 0.28 | 11 | — | — | — |
| CONT. | — | 4.0 | — | — | 74.6 | — | — |
| LNU449 | 63890.1 | 8.1 | 0.25 | 24 | — | — | — |
| LNU449 | 64571.3 | 9.1 | 0.23 | 39 | 188.3 | 0.13 | 43 |
| LNU435 | 64464.3 | 10.4 | 0.04 | 57 | 220.1 | L | 67 |
| LNU432 | 64559.2 | 9.9 | 0.19 | 50 | 201.3 | 0.21 | 53 |
| LNU367 | 64398.2 | 8.9 | 0.23 | 35 | 195.4 | 0.13 | 48 |
| LNU362 | 64324.3 | — | — | — | 148.4 | 0.25 | 13 |
| CONT. | — | 6.6 | — | — | 131.6 | — | — |
| LNU495 | 64697.2 | — | — | — | 99.4 | 0.03 | 63 |
| LNU495 | 64697.3 | — | — | — | 114.5 | 0.13 | 87 |
| LNU495 | 64698.2 | 4.7 | 0.26 | 14 | 95.0 | L | 55 |
| LNU495 | 64701.3 | — | — | — | 99.1 | 0.03 | 62 |
| LNU487 | 64702.1 | — | — | — | 89.5 | 0.26 | 46 |
| LNU487 | 64702.3 | — | — | — | 77.1 | 0.28 | 26 |
| LNU487 | 64704.2 | — | — | — | 106.3 | 0.19 | 74 |
| LNU487 | 64705.4 | — | — | — | 107.3 | L | 75 |
| LNU487 | 64706.2 | — | — | — | 93.0 | 0.07 | 52 |
| LNU474 | 64379.1 | — | — | — | 88.2 | 0.13 | 44 |
| LNU474 | 64381.1 | — | — | — | 84.8 | 0.11 | 39 |
| LNU474 | 64382.3 | — | — | — | 88.9 | 0.03 | 45 |
| LNU474 | 64383.2 | — | — | — | 92.4 | 0.03 | 51 |
| LNU465 | 64020.1 | — | — | — | 96.3 | 0.06 | 58 |
| LNU465 | 64020.4 | — | — | — | 80.2 | 0.11 | 31 |
| LNU465 | 64021.3 | — | — | — | 73.8 | 0.29 | 21 |
| LNU465 | 64021.7 | — | — | — | 93.1 | 0.04 | 52 |
| LNU446 | 64546.2 | — | — | — | 77.5 | 0.19 | 27 |
| LNU446 | 64546.3 | — | — | — | 123.7 | 0.12 | 102 |
| LNU446 | 64548.1 | — | — | — | 82.4 | 0.08 | 35 |
| LNU446 | 64548.2 | — | — | — | 101.7 | 0.29 | 66 |
| LNU446 | 64549.3 | — | — | — | 93.5 | 0.01 | 53 |
| LNU443 | 64023.2 | — | — | — | 91.8 | 0.01 | 50 |
| LNU443 | 64023.9 | — | — | — | 72.1 | 0.27 | 18 |
| LNU436 | 64240.1 | — | — | — | 96.7 | 0.02 | 58 |
| LNU436 | 64240.2 | — | — | — | 98.0 | 0.06 | 60 |
| LNU436 | 64241.3 | 5.6 | 0.22 | 36 | 124.6 | 0.02 | 104 |
| LNU436 | 64242.2 | — | — | — | 102.4 | 0.13 | 68 |
| LNU436 | 64243.1 | 5.0 | 0.26 | 23 | 134.4 | 0.06 | 120 |
| LNU379 | 64170.2 | — | — | — | 74.5 | 0.19 | 22 |
| LNU379 | 64170.3 | — | — | — | 76.5 | 0.15 | 25 |
| LNU379 | 64172.1 | — | — | — | 84.0 | 0.11 | 37 |
| LNU379 | 64172.2 | — | — | — | 77.3 | 0.14 | 26 |
| LNU315 | 64224.1 | — | — | — | 105.7 | 0.02 | 73 |
| LNU315 | 64225.2 | 5.3 | 0.09 | 29 | 139.4 | 0.04 | 128 |
| LNU315 | 64226.3 | 5.2 | 0.26 | 26 | 103.4 | 0.06 | 69 |
| LNU315 | 64227.3 | 5.2 | L | 27 | 110.2 | L | 80 |
| CONT. | — | 4.1 | — | — | 61.1 | — | — |
| LNU520 | 64156.7 | 6.1 | 0.16 | 22 | 114.8 | 0.25 | 15 |
| LNU405 | 64158.9 | 6.9 | 0.14 | 39 | 138.8 | L | 39 |
| LNU403 | 64239.1 | 6.7 | 0.26 | 33 | 125.2 | 0.18 | 26 |
| CONT. | — | 5.0 | — | — | 99.7 | — | — |
| LNU519 | 64678.1 | 4.0 | 0.30 | 16 | — | — | — |
| LNU519 | 64679.1 | — | — | — | 66.8 | 0.25 | 11 |
| LNU519 | 64681.8 | — | — | — | 76.5 | 0.13 | 27 |
| LNU500 | 64220.1 | — | — | — | 74.8 | 0.02 | 24 |
| LNU500 | 64223.1 | 4.0 | 0.29 | 16 | 82.8 | 0.09 | 37 |
| LNU459 | 64542.3 | — | — | — | 83.5 | 0.08 | 38 |
| LNU348 | 64472.2 | 4.1 | 0.17 | 19 | 86.7 | 0.04 | 44 |
| LNU348 | 64474.1 | — | — | — | 71.9 | 0.11 | 19 |
| LNU348 | 64474.2 | — | — | — | 83.8 | 0.14 | 39 |
| LNU329 | 63428.2 | — | — | — | 68.7 | 0.19 | 14 |

TABLE 69-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU329 | 63429.1 | — | — | — | 70.4 | 0.16 | 17 |
| CONT. | — | 3.4 | — | — | 60.4 | — | — |
| LNU499 | 64146.11 | 4.5 | 0.06 | 27 | — | — | — |
| LNU490 | 66095.2 | 4.1 | 0.05 | 17 | — | — | — |
| LNU437_H2 | 66104.1 | 5.5 | L | 54 | 98.0 | L | 40 |
| LNU437_H2 | 66104.2 | 4.3 | 0.06 | 23 | — | — | — |
| LNU433 | 64814.1 | 4.9 | 0.20 | 39 | — | — | — |
| LNU433 | 64816.1 | 4.9 | 0.08 | 39 | — | — | — |
| LNU433 | 64817.5 | 4.0 | 0.14 | 15 | — | — | — |
| LNU416 | 64134.1 | 4.3 | 0.01 | 22 | 79.6 | 0.21 | 14 |
| LNU416 | 64134.11 | 4.4 | L | 25 | 76.8 | 0.22 | 10 |
| LNU416 | 64134.2 | 4.5 | 0.16 | 27 | 90.6 | 0.02 | 30 |
| LNU395 | 64142.5 | 4.8 | 0.02 | 34 | 83.4 | 0.28 | 19 |
| LNU395 | 64143.6 | 5.5 | 0.12 | 56 | 94.2 | 0.19 | 35 |
| LNU312 | 64000.1 | 4.8 | L | 34 | — | — | — |
| LNU312 | 64000.2 | 4.2 | 0.05 | 20 | — | — | — |
| LNU312 | 64002.2 | 4.5 | 0.14 | 26 | — | — | — |
| LNU312 | 64002.3 | 4.3 | 0.13 | 22 | — | — | — |
| LNU312 | 64002.5 | 6.0 | L | 69 | 96.8 | 0.01 | 39 |
| LNU311 | 66099.1 | 4.5 | 0.18 | 27 | — | — | — |
| LNU311 | 66100.3 | 4.4 | 0.14 | 25 | 88.2 | 0.23 | 26 |
| CONT. | — | 3.5 | — | — | 69.8 | — | — |
| LNU468 | 63491.1 | — | — | — | 143.7 | 0.04 | 24 |
| LNU467 | 63718.2 | — | — | — | 152.4 | 0.21 | 32 |
| LNU347 | 63510.2 | 7.4 | 0.05 | 16 | 145.8 | 0.10 | 26 |
| LNU347 | 63513.3 | 9.3 | 0.06 | 45 | 178.1 | L | 54 |
| CONT. | — | 6.4 | — | — | 115.5 | — | — |
| LNU497 | 64207.2 | 6.2 | 0.05 | 47 | 119.8 | 0.07 | 31 |
| LNU491 | 64404.3 | 5.5 | 0.27 | 29 | 122.7 | 0.24 | 34 |
| LNU491 | 64404.6 | 5.5 | 0.03 | 29 | 108.6 | 0.17 | 19 |
| LNU449 | 63890.1 | 4.8 | 0.26 | 13 | — | — | — |
| LNU449 | 63892.1 | 5.6 | 0.07 | 32 | 125.4 | 0.04 | 37 |
| LNU432 | 64066.2 | 6.0 | 0.23 | 42 | 122.2 | 0.22 | 34 |
| CONT. | — | 4.2 | — | — | 91.5 | — | — |
| LNU438 | 63994.5 | 7.7 | 0.14 | 24 | — | — | — |
| LNU354 | 63970.7 | 8.0 | 0.15 | 27 | — | — | — |
| LNU295 | 63899.5 | 7.6 | 0.13 | 22 | — | — | — |
| CONT. | — | 6.2 | — | — | — | — | — |
| LNU483 | 64803.2 | 5.0 | 0.13 | 24 | — | — | — |
| LNU483 | 64803.3 | 5.9 | 0.07 | 45 | 125.1 | 0.13 | 31 |
| LNU483 | 64805.2 | 5.3 | 0.05 | 30 | — | — | — |
| LNU414 | 64475.1 | 4.7 | 0.18 | 16 | — | — | — |
| LNU378 | 64494.2 | 5.1 | 0.13 | 25 | — | — | — |
| LNU364 | 64441.3 | 4.9 | 0.09 | 21 | — | — | — |
| LNU346 | 65008.2 | 5.9 | 0.08 | 44 | — | — | — |
| CONT. | — | 4.1 | — | — | 95.3 | — | — |
| LNU510 | 64152.1 | — | — | — | 80.1 | 0.12 | 15 |
| LNU510 | 64154.2 | — | — | — | 101.7 | 0.27 | 46 |
| LNU438 | 63994.12 | — | — | — | 83.5 | 0.27 | 20 |
| LNU354 | 63970.7 | 4.8 | 0.28 | 14 | 84.6 | 0.23 | 21 |
| LNU310 | 63904.1 | — | — | — | 77.8 | 0.27 | 12 |
| LNU295 | 63899.5 | — | — | — | 79.2 | 0.28 | 14 |
| LNU295 | 63899.8 | 6.1 | 0.01 | 45 | 109.6 | 0.03 | 57 |
| CONT. | — | 4.2 | — | — | 69.8 | — | — |
| LNU490 | 66092.3 | — | — | — | 76.4 | 0.18 | 23 |
| LNU443 | 64024.4 | 4.3 | 0.18 | 43 | 97.2 | 0.08 | 57 |
| LNU443 | 64024.7 | 4.6 | 0.04 | 50 | 95.4 | 0.11 | 54 |
| LNU439 | 64616.2 | 4.2 | 0.12 | 36 | 80.7 | 0.13 | 30 |
| LNU439 | 64618.3 | 4.9 | 0.03 | 60 | 95.2 | 0.04 | 54 |
| LNU437_H2 | 66104.1 | 3.9 | 0.15 | 29 | 78.8 | 0.15 | 27 |
| LNU436 | 64240.2 | 4.3 | 0.05 | 41 | 85.2 | 0.04 | 38 |
| LNU436 | 64242.2 | 4.2 | 0.07 | 37 | 79.9 | 0.09 | 29 |
| LNU436 | 64243.1 | 3.9 | 0.21 | 28 | 83.4 | 0.17 | 35 |
| LNU433 | 64815.1 | 4.8 | 0.11 | 56 | 95.2 | 0.08 | 54 |
| LNU433 | 64815.2 | 4.6 | 0.15 | 52 | 88.2 | 0.09 | 43 |
| LNU433 | 64816.1 | 5.8 | L | 90 | 97.0 | 0.03 | 57 |
| LNU298 | 66089.1 | — | — | — | 73.5 | 0.25 | 19 |

TABLE 69-continued

Genes showing improved plant performance at nitrogen deficient conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU293 | 65050.3 | 3.8 | 0.20 | 24 | — | — | — |
| LNU293 | 65051.3 | 5.0 | 0.08 | 63 | 91.2 | 0.05 | 47 |
| CONT. | — | 3.0 | — | — | 61.9 | — | — |

Table 69: "CONT."—Control;
"Ave."—Average;
"% Incr." = % increment;
"p-val."—p-value;
L means that p-value is less than 0.01, p < 0.1 was considered as significant.

TABLE 70

Genes showing improved plant performance at nitrogen deficient conditions (T2 generation)

| Gene Name | Event # | Leaf Area [cm²] Ave. | P-Val. | % Incr. | Roots Coverage [cm²] Ave. | P-Val. | % Incr. | Roots Length [cm²] Ave. | P-Val. | % Incr. |
|---|---|---|---|---|---|---|---|---|---|---|
| LNU437_H2 | 66104.1 | 0.4 | 0.05 | 28 | 9.0 | 0.10 | 26 | — | — | — |
| LNU437_H2 | 66104.2 | 0.5 | 0.16 | 34 | — | — | — | — | — | — |
| LNU437_H2 | 66104.3 | 0.5 | 0.02 | 42 | — | — | — | — | — | — |
| LNU437_H2 | 66105.3 | 0.5 | 0.02 | 43 | 10.1 | 0.05 | 40 | — | — | — |
| LNU426 | 66147.3 | 0.6 | L | 72 | 10.0 | 0.03 | 38 | — | — | — |
| LNU420 | 64006.3 | — | — | — | — | — | — | 7.4 | 0.16 | 8 |
| LNU420 | 64007.3 | 0.4 | 0.07 | 26 | 9.1 | 0.06 | 27 | 7.6 | 0.04 | 10 |
| LNU352 | 64199.1 | 0.6 | L | 88 | 12.9 | L | 79 | 8.1 | L | 17 |
| LNU352 | 64200.1 | 0.5 | 0.04 | 37 | — | — | — | — | — | — |
| LNU352 | 64200.10 | — | — | — | — | — | — | 7.3 | 0.21 | 6 |
| LNU352 | 64200.4 | 0.4 | 0.06 | 32 | 10.0 | 0.03 | 39 | 7.6 | 0.07 | 10 |
| LNU292 | 64084.1 | — | — | — | — | — | — | 7.3 | 0.22 | 5 |
| LNU292 | 64085.4 | 0.4 | 0.15 | 20 | 8.5 | 0.21 | 18 | 7.6 | 0.10 | 10 |
| CONT. | — | 0.3 | — | — | 7.2 | — | — | 6.9 | — | — |
| LNU483 | 64803.2 | — | — | — | 17.0 | 0.01 | 38 | — | — | — |
| LNU483 | 64803.3 | — | — | — | 15.9 | 0.08 | 30 | — | — | — |
| LNU483 | 64805.1 | — | — | — | 21.9 | L | 79 | 7.8 | L | 9 |
| LNU483 | 64805.2 | — | — | — | 20.9 | L | 71 | — | — | — |
| LNU483 | 64806.2 | — | — | — | 17.4 | 0.08 | 42 | — | — | — |
| LNU477 | 63889.2 | — | — | — | — | — | — | 7.4 | 0.22 | 3 |
| LNU464 | 65073.1 | — | — | — | — | — | — | 7.7 | 0.02 | 7 |
| LNU464 | 65076.1 | — | — | — | — | — | — | 7.6 | 0.02 | 6 |
| LNU464 | 65076.4 | 0.7 | 0.29 | 10 | — | — | — | — | — | — |
| LNU447 | 65000.1 | — | — | — | — | — | — | 7.4 | 0.22 | 4 |
| LNU447 | 65002.3 | — | — | — | 13.1 | 0.18 | 7 | — | — | — |
| LNU439 | 64616.2 | 0.7 | 0.24 | 16 | — | — | — | — | — | — |
| LNU439 | 64616.3 | 0.8 | 0.05 | 17 | 14.2 | 0.13 | 16 | — | — | — |
| LNU439 | 64618.3 | 0.7 | 0.26 | 8 | — | — | — | — | — | — |
| LNU425 | 63911.9 | 0.8 | L | 19 | — | — | — | 7.5 | 0.22 | 4 |
| LNU414 | 64475.1 | 0.7 | 0.09 | 7 | — | — | — | — | — | — |
| LNU414 | 64479.1 | 0.8 | L | 21 | — | — | — | — | — | — |
| LNU414 | 64480.2 | 0.8 | 0.14 | 23 | — | — | — | 7.5 | 0.13 | 5 |
| LNU346 | 65007.3 | — | — | — | — | — | — | 7.4 | 0.18 | 4 |
| LNU346 | 65008.2 | 0.7 | L | 15 | — | — | — | 7.5 | 0.06 | 5 |
| LNU346 | 65009.2 | — | — | — | — | — | — | 7.5 | 0.13 | 4 |
| LNU336 | 64448.2 | 0.9 | 0.03 | 34 | 14.0 | 0.23 | 14 | — | — | — |
| LNU336 | 64448.3 | 0.7 | 0.26 | 6 | — | — | — | — | — | — |
| CONT. | — | 0.6 | — | — | 12.2 | — | — | 7.2 | — | — |
| LNU473 | 65770.4 | 0.6 | 0.23 | 12 | 12.8 | 0.25 | 9 | 7.5 | 0.17 | 5 |
| LNU470 | 64228.3 | — | — | — | 13.7 | 0.06 | 16 | — | — | — |
| LNU470 | 64229.1 | 0.7 | 0.06 | 27 | 14.4 | 0.06 | 22 | 7.9 | 0.03 | 9 |
| LNU460 | 64359.3 | — | — | — | 14.8 | 0.20 | 25 | 8.0 | 0.04 | 12 |
| LNU460 | 64361.4 | 0.6 | 0.24 | 13 | — | — | — | — | — | — |
| LNU460 | 64362.1 | — | — | — | 13.4 | 0.14 | 13 | — | — | — |
| LNU421 | 64302.7 | 0.6 | 0.25 | 12 | 13.3 | 0.02 | 13 | 7.8 | 0.01 | 9 |
| LNU421 | 64303.3 | 0.7 | 0.12 | 26 | — | — | — | 7.6 | 0.28 | 5 |
| LNU421 | 64304.4 | — | — | — | — | — | — | 7.6 | 0.06 | 6 |
| LNU421 | 64305.11 | — | — | — | — | — | — | 7.9 | 0.01 | 10 |
| LNU408 | 64248.10 | 0.6 | 0.09 | 19 | 13.6 | 0.10 | 15 | 7.4 | 0.22 | 4 |
| LNU408 | 64248.12 | — | — | — | — | — | — | 7.6 | 0.07 | 5 |
| LNU408 | 64248.16 | — | — | — | — | — | — | 7.8 | 0.07 | 9 |
| LNU380 | 65764.2 | — | — | — | — | — | — | 7.4 | 0.10 | 3 |

TABLE 70-continued

Genes showing improved plant performance at nitrogen deficient conditions (T2 generation)

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU380 | 65764.3 | — | — | — | 13.2 | 0.15 | 12 | 7.4 | 0.22 | 3 |
| LNU380 | 65765.4 | — | — | — | — | — | — | 7.4 | 0.23 | 3 |
| LNU340 | 64290.7 | 0.6 | 0.10 | 23 | 15.4 | 0.03 | 30 | 8.1 | L | 13 |
| LNU340 | 64291.10 | — | — | — | — | — | — | 7.8 | L | 8 |
| LNU340 | 64292.5 | — | — | — | 13.1 | 0.25 | 11 | 7.8 | L | 9 |
| LNU331 | 64212.1 | — | — | — | — | — | — | 7.6 | 0.07 | 6 |
| LNU331 | 64212.3 | — | — | — | — | — | — | 7.7 | 0.10 | 7 |
| LNU331 | 64214.2 | 0.7 | 0.03 | 29 | 14.1 | 0.02 | 19 | 7.8 | 0.04 | 9 |
| LNU331 | 64215.1 | 0.8 | L | 46 | 17.1 | L | 44 | 8.1 | 0.03 | 13 |
| LNU331 | 64215.3 | — | — | — | — | — | — | 7.4 | 0.16 | 3 |
| CONT. | — | 0.5 | — | — | 11.8 | — | — | 7.2 | — | — |
| LNU456 | 63991.8 | — | — | — | — | — | — | 7.7 | 0.23 | 7 |
| LNU430 | 63934.3 | 0.5 | 0.07 | 20 | — | — | — | — | — | — |
| LNU430 | 63936.2 | 0.5 | 0.20 | 12 | — | — | — | 7.7 | 0.24 | 6 |
| LNU407 | 64218.1 | — | — | — | 10.2 | 0.26 | 12 | — | — | — |
| LNU407 | 64219.1 | — | — | — | 10.4 | 0.11 | 15 | 7.9 | 0.11 | 8 |
| LNU407 | 64219.2 | 0.6 | 0.05 | 35 | — | — | — | — | — | — |
| LNU402 | 63914.2 | 0.5 | 0.14 | 16 | 11.5 | 0.15 | 27 | 8.1 | 0.07 | 12 |
| LNU360 | 64029.3 | — | — | — | 10.6 | 0.23 | 17 | — | — | — |
| LNU335 | 64168.15 | — | — | — | — | — | — | 8.0 | 0.10 | 11 |
| LNU335 | 64169.2 | 0.5 | 0.04 | 21 | — | — | — | — | — | — |
| LNU301 | 63927.3 | 0.6 | 0.19 | 40 | — | — | — | — | — | — |
| LNU301 | 63950.3 | 0.6 | L | 57 | 13.0 | 0.03 | 44 | — | — | — |
| CONT. | — | 0.4 | — | — | 9.0 | — | — | 7.3 | — | — |
| LNU450 | 63708.3 | 0.7 | 0.02 | 32 | 14.5 | 0.10 | 20 | 7.7 | 0.22 | 7 |
| LNU450 | 63710.2 | 0.7 | 0.03 | 22 | — | — | — | 7.7 | 0.21 | 7 |
| LNU450 | 63712.3 | 0.7 | 0.04 | 28 | 14.7 | 0.03 | 22 | 7.5 | 0.26 | 5 |
| LNU429 | 63937.4 | — | — | — | — | — | — | 8.1 | 0.01 | 12 |
| LNU429 | 63938.2 | — | — | — | — | — | — | 7.6 | 0.25 | 5 |
| LNU416 | 64134.2 | 0.6 | 0.22 | 6 | — | — | — | 7.5 | 0.29 | 4 |
| LNU416 | 64136.4 | 0.7 | 0.03 | 20 | 15.4 | 0.04 | 27 | 7.8 | 0.05 | 9 |
| LNU412 | 63940.12 | 0.7 | 0.27 | 25 | — | — | — | — | — | — |
| LNU412 | 63940.8 | 0.7 | 0.20 | 18 | — | — | — | 7.6 | 0.27 | 6 |
| LNU359 | 66154.6 | 0.7 | L | 20 | — | — | — | 7.5 | 0.29 | 4 |
| LNU349 | 63989.5 | — | — | — | — | — | — | 7.5 | 0.28 | 4 |
| LNU349 | 63990.2 | — | — | — | — | — | — | 7.5 | 0.24 | 5 |
| LNU293 | 65048.1 | 0.6 | 0.25 | 8 | — | — | — | — | — | — |
| LNU293 | 65051.3 | 0.7 | 0.21 | 20 | — | — | — | — | — | — |
| CONT. | — | 0.6 | — | — | 12.1 | — | — | 7.2 | — | — |
| LNU498 | 64184.3 | — | — | — | 9.4 | 0.06 | 25 | 7.3 | 0.12 | 10 |
| LNU498 | 64186.1 | — | — | — | 8.3 | 0.07 | 11 | — | — | — |
| LNU498 | 64186.2 | — | — | — | 9.9 | L | 33 | 7.4 | 0.02 | 11 |
| LNU498 | 64186.3 | — | — | — | 8.5 | 0.02 | 14 | 7.3 | 0.04 | 9 |
| LNU493 | 64190.1 | — | — | — | 9.8 | L | 31 | 7.3 | 0.01 | 10 |
| LNU493 | 64190.3 | — | — | — | 9.4 | 0.02 | 26 | 7.0 | 0.24 | 4 |
| LNU493 | 64191.2 | 0.5 | 0.14 | 20 | 9.6 | 0.07 | 28 | 7.1 | 0.19 | 7 |
| LNU493 | 64191.3 | — | — | — | — | — | — | 7.4 | L | 11 |
| LNU493 | 64191.4 | — | — | — | — | — | — | 7.2 | 0.15 | 8 |
| LNU455 | 64187.5 | 0.5 | 0.06 | 16 | 10.1 | L | 34 | 7.5 | 0.05 | 12 |
| LNU455 | 64189.4 | — | — | — | 9.9 | 0.01 | 33 | 7.2 | 0.05 | 7 |
| LNU455 | 64189.7 | — | — | — | — | — | — | 7.0 | 0.19 | 5 |
| LNU343 | 64208.4 | — | — | — | 8.5 | 0.29 | 14 | 7.3 | 0.02 | 10 |
| LNU328 | 64150.1 | — | — | — | 9.4 | 0.06 | 26 | 7.4 | 0.07 | 11 |
| LNU328 | 64150.2 | — | — | — | 9.4 | 0.19 | 26 | 7.0 | 0.21 | 5 |
| LNU328 | 64150.4 | — | — | — | 8.6 | 0.02 | 15 | 7.3 | 0.01 | 10 |
| LNU328 | 64151.1 | — | — | — | 8.9 | L | 19 | 7.2 | 0.11 | 8 |
| LNU322 | 63917.2 | — | — | — | 9.5 | 0.01 | 28 | 7.3 | 0.02 | 10 |
| LNU322 | 63918.1 | 0.5 | 0.05 | 15 | 9.1 | 0.02 | 21 | — | — | — |
| LNU322 | 63918.4 | — | — | — | — | — | — | 7.1 | 0.11 | 7 |
| LNU317 | 64097.2 | — | — | — | 9.0 | 0.12 | 20 | 7.5 | 0.03 | 12 |
| LNU305 | 64114.1 | — | — | — | — | — | — | 7.2 | 0.05 | 8 |
| LNU305 | 64115.1 | — | — | — | 9.4 | 0.22 | 25 | 7.3 | 0.02 | 9 |
| CONT. | — | 0.4 | — | — | 7.5 | — | — | 6.7 | — | — |
| LNU495 | 64697.3 | — | — | — | — | — | — | 7.6 | 0.06 | 6 |
| LNU495 | 64701.3 | — | — | — | 10.2 | 0.10 | 11 | — | — | — |
| LNU487 | 64702.3 | — | — | — | — | — | — | 7.6 | L | 7 |
| LNU487 | 64706.2 | 0.5 | 0.25 | 8 | — | — | — | — | — | — |
| LNU474 | 64381.1 | — | — | — | — | — | — | 7.5 | 0.25 | 5 |
| LNU474 | 64383.2 | — | — | — | — | — | — | 7.5 | 0.19 | 5 |
| LNU465 | 64020.1 | 0.5 | 0.12 | 17 | — | — | — | — | — | — |
| LNU465 | 64020.4 | 0.5 | 0.19 | 18 | 10.5 | 0.30 | 14 | — | — | — |
| LNU446 | 64546.2 | 0.5 | 0.16 | 15 | 13.6 | 0.02 | 48 | 7.5 | 0.05 | 6 |

TABLE 70-continued

Genes showing improved plant performance at nitrogen deficient conditions (T2 generation)

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU446 | 64546.3 | — | — | — | — | — | — | 7.3 | 0.24 | 2 |
| LNU446 | 64548.2 | — | — | — | — | — | — | 7.6 | 0.20 | 6 |
| LNU446 | 64549.2 | — | — | — | 10.8 | 0.11 | 18 | 7.9 | 0.03 | 11 |
| LNU443 | 64023.2 | — | — | — | 11.6 | 0.09 | 26 | 7.8 | L | 9 |
| LNU443 | 64023.9 | — | — | — | — | — | — | 7.7 | 0.07 | 8 |
| LNU443 | 64024.7 | — | — | — | 10.3 | 0.16 | 13 | 7.6 | 0.14 | 7 |
| LNU436 | 64240.1 | 0.6 | 0.18 | 23 | — | — | — | 7.5 | 0.09 | 5 |
| LNU436 | 64240.2 | — | — | — | 11.2 | 0.28 | 23 | — | — | — |
| LNU436 | 64243.1 | 0.6 | L | 21 | 10.9 | 0.07 | 19 | 7.6 | 0.05 | 6 |
| LNU379 | 64170.2 | — | — | — | 12.0 | 0.20 | 31 | — | — | — |
| LNU379 | 64170.4 | — | — | — | — | — | — | 7.7 | 0.12 | 8 |
| LNU315 | 64224.3 | 0.5 | 0.06 | 16 | 13.1 | L | 43 | 7.6 | 0.07 | 7 |
| LNU315 | 64225.1 | 0.5 | 0.28 | 11 | — | — | — | — | — | — |
| CONT. | — | 0.5 | — | — | 9.2 | — | — | 7.1 | — | — |
| LNU497 | 64206.2 | — | — | — | — | — | — | 7.1 | 0.27 | 7 |
| LNU497 | 64207.3 | — | — | — | — | — | — | 7.2 | 0.14 | 9 |
| LNU491 | 64404.3 | — | — | — | — | — | — | 6.9 | 0.18 | 4 |
| LNU491 | 64405.2 | 0.7 | 0.13 | 31 | 11.2 | 0.16 | 21 | 7.4 | 0.01 | 13 |
| LNU491 | 64406.4 | 0.7 | 0.08 | 31 | 12.8 | 0.05 | 38 | 7.9 | 0.01 | 20 |
| LNU449 | 64570.1 | — | — | — | — | — | — | 7.4 | 0.07 | 12 |
| LNU449 | 64571.3 | 0.7 | 0.03 | 35 | 13.7 | 0.13 | 48 | 7.5 | 0.01 | 14 |
| LNU435 | 64464.3 | 0.9 | 0.04 | 66 | 13.1 | 0.08 | 41 | 7.4 | 0.02 | 13 |
| LNU432 | 64065.2 | 0.6 | 0.24 | 8 | — | — | — | 7.2 | L | 10 |
| LNU432 | 64559.2 | 0.7 | L | 30 | 13.1 | 0.04 | 41 | 7.5 | L | 15 |
| LNU432 | 64560.3 | 0.6 | 0.26 | 13 | — | — | — | — | — | — |
| LNU432 | 64560.5 | 0.6 | 0.21 | 17 | 12.2 | 0.24 | 32 | 6.9 | 0.27 | 5 |
| LNU378 | 64493.3 | — | — | — | — | — | — | 7.0 | 0.28 | 6 |
| LNU378 | 64495.2 | — | — | — | — | — | — | 7.1 | 0.17 | 8 |
| LNU378 | 64495.4 | — | — | — | — | — | — | 7.4 | 0.07 | 12 |
| LNU367 | 64397.1 | 0.6 | 0.28 | 10 | — | — | — | — | — | — |
| LNU367 | 64398.2 | 0.7 | 0.19 | 28 | 12.2 | 0.20 | 32 | 7.4 | 0.04 | 13 |
| LNU367 | 64399.1 | — | — | — | — | — | — | 7.4 | 0.05 | 13 |
| LNU364 | 64441.2 | — | — | — | 12.0 | 0.26 | 29 | 7.3 | 0.19 | 11 |
| LNU362 | 64323.1 | — | — | — | — | — | — | 7.0 | 0.06 | 6 |
| LNU362 | 64324.3 | 0.6 | 0.20 | 20 | — | — | — | — | — | — |
| CONT. | — | 0.5 | — | — | 9.3 | — | — | 6.6 | — | — |
| LNU495 | 64697.2 | 0.5 | 0.07 | 12 | — | — | — | — | — | — |
| LNU495 | 64697.3 | 0.6 | 0.11 | 28 | 10.9 | 0.13 | 22 | 7.6 | 0.06 | 10 |
| LNU495 | 64698.2 | 0.5 | 0.15 | 16 | — | — | — | — | — | — |
| LNU487 | 64702.1 | — | — | — | — | — | — | 7.5 | 0.17 | 8 |
| LNU487 | 64705.4 | 0.6 | 0.10 | 25 | — | — | — | — | — | — |
| LNU487 | 64706.2 | — | — | — | 12.9 | 0.07 | 44 | 7.4 | 0.12 | 6 |
| LNU474 | 64379.1 | — | — | — | — | — | — | 7.6 | 0.11 | 9 |
| LNU474 | 64382.2 | — | — | — | — | — | — | 7.4 | 0.21 | 7 |
| LNU474 | 64382.3 | 0.5 | 0.08 | 16 | — | — | — | 7.5 | 0.07 | 8 |
| LNU474 | 64383.2 | 0.5 | 0.04 | 20 | — | — | — | 7.3 | 0.27 | 5 |
| LNU465 | 64020.1 | 0.5 | 0.08 | 17 | — | — | — | — | — | — |
| LNU446 | 64546.2 | — | — | — | — | — | — | 7.2 | 0.20 | 4 |
| LNU446 | 64548.2 | — | — | — | — | — | — | 7.2 | 0.27 | 3 |
| LNU446 | 64549.3 | 0.5 | 0.04 | 15 | — | — | — | — | — | — |
| LNU443 | 64023.2 | 0.6 | 0.02 | 20 | 10.5 | 0.16 | 18 | 7.5 | 0.17 | 9 |
| LNU443 | 64024.4 | — | — | — | — | — | — | 7.3 | 0.19 | 5 |
| LNU443 | 64024.7 | — | — | — | — | — | — | 7.8 | 0.01 | 13 |
| LNU436 | 64240.2 | 0.6 | 0.14 | 20 | 11.1 | 0.11 | 24 | 7.5 | 0.07 | 8 |
| LNU436 | 64241.3 | 0.7 | 0.02 | 49 | 11.5 | 0.26 | 28 | 7.3 | 0.16 | 5 |
| LNU436 | 64243.1 | 0.6 | 0.04 | 23 | — | — | — | — | — | — |
| LNU379 | 64170.2 | — | — | — | — | — | — | 7.7 | 0.09 | 11 |
| LNU315 | 64224.1 | 0.6 | 0.24 | 22 | — | — | — | — | — | — |
| LNU315 | 64225.2 | 0.6 | 0.06 | 40 | — | — | — | — | — | — |
| LNU315 | 64226.3 | 0.6 | 0.09 | 36 | 11.5 | 0.25 | 29 | — | — | — |
| LNU315 | 64227.3 | 0.6 | 0.04 | 34 | — | — | — | — | — | — |
| CONT. | — | 0.5 | — | — | 8.9 | — | — | 6.9 | — | — |
| LNU520 | 64156.13 | — | — | — | 10.9 | 0.19 | 11 | 7.9 | 0.16 | 7 |
| LNU520 | 64156.7 | — | — | — | 11.3 | 0.11 | 16 | — | — | — |
| LNU518 | 64015.4 | — | — | — | — | — | — | 7.9 | 0.10 | 7 |
| LNU518 | 64016.3 | — | — | — | — | — | — | 7.8 | 0.01 | 6 |
| LNU502 | 64038.2 | — | — | — | — | — | — | 7.6 | 0.23 | 4 |
| LNU502 | 64039.3 | — | — | — | 10.9 | 0.26 | 11 | 7.8 | 0.08 | 6 |
| LNU482 | 64164.8 | — | — | — | 12.3 | 0.08 | 26 | — | — | — |
| LNU405 | 64158.9 | 0.9 | 0.04 | 43 | 14.9 | 0.04 | 52 | 8.0 | 0.25 | 8 |
| LNU405 | 64159.8 | — | — | — | — | — | — | 7.9 | 0.20 | 8 |
| LNU403 | 64239.1 | 0.8 | 0.07 | 35 | 12.2 | 0.18 | 24 | — | — | — |

TABLE 70-continued

Genes showing improved plant performance at nitrogen deficient conditions (T2 generation)

| Gene Name | Event # | Leaf Area [cm$^2$] | | | Roots Coverage [cm$^2$] | | | Roots Length [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LNU393 | 63977.6 | — | — | — | 12.3 | 0.12 | 25 | — | — | — |
| LNU385 | 64245.3 | — | — | — | 11.8 | 0.03 | 20 | 7.7 | 0.13 | 4 |
| LNU374 | 63997.2 | — | — | — | — | — | — | 7.9 | 0.10 | 7 |
| CONT. | — | 0.6 | — | — | 9.8 | — | — | 7.4 | — | — |
| LNU519 | 64678.1 | 0.5 | 0.02 | 32 | 10.3 | 0.12 | 29 | — | — | — |
| LNU519 | 64679.1 | 0.5 | 0.11 | 18 | — | — | — | — | — | — |
| LNU519 | 64680.2 | — | — | — | 9.9 | 0.16 | 25 | 7.5 | 0.06 | 9 |
| LNU519 | 64681.3 | — | — | — | 10.5 | 0.14 | 32 | 7.4 | 0.20 | 7 |
| LNU519 | 64681.8 | 0.4 | 0.10 | 17 | 10.2 | 0.05 | 29 | 7.7 | 0.02 | 12 |
| LNU500 | 64220.1 | 0.5 | 0.09 | 18 | — | — | — | — | — | — |
| LNU500 | 64221.2 | — | — | — | 10.3 | 0.08 | 30 | 7.8 | 0.14 | 13 |
| LNU500 | 64221.6 | 0.4 | 0.23 | 11 | — | — | — | — | — | — |
| LNU500 | 64223.1 | 0.6 | 0.02 | 53 | 11.0 | 0.05 | 39 | 7.8 | 0.04 | 13 |
| LNU500 | 64223.2 | 0.4 | 0.18 | 15 | 9.9 | 0.07 | 25 | 7.9 | L | 15 |
| LNU459 | 64541.4 | — | — | — | — | — | — | 7.5 | 0.08 | 9 |
| LNU459 | 64542.1 | — | — | — | — | — | — | 7.5 | 0.07 | 9 |
| LNU459 | 64542.3 | 0.5 | 0.01 | 36 | 10.4 | 0.07 | 32 | — | — | — |
| LNU459 | 64542.4 | — | — | — | 9.6 | 0.28 | 21 | 7.3 | 0.24 | 6 |
| LNU459 | 64543.2 | — | — | — | 9.4 | 0.26 | 19 | 7.6 | 0.06 | 10 |
| LNU348 | 64472.2 | 0.5 | 0.01 | 29 | 10.3 | 0.05 | 29 | 7.5 | 0.08 | 8 |
| LNU348 | 64472.3 | 0.5 | 0.16 | 20 | — | — | — | — | — | — |
| LNU348 | 64474.1 | 0.5 | L | 29 | — | — | — | — | — | — |
| LNU348 | 64474.2 | 0.5 | 0.13 | 30 | 12.2 | 0.09 | 54 | 7.4 | 0.13 | 8 |
| LNU329 | 63427.3 | 0.4 | 0.23 | 12 | 10.0 | 0.05 | 26 | — | — | — |
| LNU329 | 63429.1 | 0.5 | L | 35 | 12.6 | L | 59 | 8.4 | L | 22 |
| LNU329 | 63430.3 | 0.4 | 0.27 | 11 | — | — | — | — | — | — |
| LNU316 | 64068.1 | 0.4 | 0.15 | 14 | — | — | — | — | — | — |
| LNU316 | 64564.5 | — | — | — | — | — | — | 7.7 | 0.02 | 12 |
| CONT. | — | 0.4 | — | — | 7.9 | — | — | 6.9 | — | — |
| LNU437_H2 | 66104.1 | 0.6 | L | 36 | 10.8 | 0.02 | 43 | 6.9 | 0.07 | 12 |
| LNU312 | 64002.3 | 0.5 | 0.15 | 16 | — | — | — | — | — | — |
| LNU312 | 64002.5 | 0.5 | 0.18 | 18 | 9.8 | 0.07 | 30 | 6.7 | 0.12 | 9 |
| CONT. | — | 0.4 | — | — | 7.6 | — | — | 6.1 | — | — |
| LNU347 | 63513.3 | 0.8 | 0.05 | 21 | 12.5 | 0.12 | 17 | — | — | — |
| CONT. | — | 0.7 | — | — | 10.7 | — | — | — | — | — |
| LNU497 | 64206.2 | — | — | — | — | — | — | 7.9 | 0.10 | 7 |
| LNU497 | 64207.2 | 0.7 | 0.04 | 25 | — | — | — | — | — | — |
| LNU497 | 64207.3 | — | — | — | 15.4 | L | 37 | 7.8 | 0.13 | 5 |
| LNU491 | 64404.3 | 0.7 | 0.02 | 25 | 14.9 | L | 32 | 7.9 | 0.15 | 7 |
| LNU491 | 64404.6 | 0.7 | 0.04 | 28 | 14.5 | 0.03 | 29 | 8.1 | 0.04 | 10 |
| LNU491 | 64406.4 | — | — | — | — | — | — | 7.8 | 0.17 | 5 |
| LNU449 | 63892.1 | 0.7 | 0.05 | 22 | — | — | — | — | — | — |
| LNU432 | 64066.2 | 0.7 | 0.14 | 28 | — | — | — | — | — | — |
| CONT. | — | 0.5 | — | — | 11.2 | — | — | 7.4 | — | — |
| LNU510 | 64152.1 | — | — | — | — | — | — | 7.7 | 0.03 | 8 |
| LNU489 | 64012.1 | — | — | — | 12.1 | 0.18 | 14 | 8.0 | 0.02 | 12 |
| LNU438 | 63994.3 | — | — | — | — | — | — | 7.5 | 0.14 | 5 |
| LNU438 | 63994.5 | — | — | — | 13.1 | 0.02 | 22 | 7.7 | 0.05 | 7 |
| LNU383 | 63982.1 | — | — | — | — | — | — | 7.9 | 0.03 | 11 |
| LNU383 | 63982.7 | — | — | — | — | — | — | 7.8 | 0.02 | 10 |
| LNU354 | 63970.6 | — | — | — | — | — | — | 7.7 | 0.05 | 8 |
| LNU354 | 63970.7 | 0.7 | 0.16 | 18 | — | — | — | — | — | — |
| LNU354 | 63972.8 | — | — | — | — | — | — | 7.9 | 0.06 | 11 |
| LNU310 | 63904.1 | — | — | — | — | — | — | 7.9 | 0.11 | 11 |
| LNU310 | 63904.3 | — | — | — | 13.0 | 0.30 | 22 | 8.1 | 0.02 | 13 |
| LNU299 | 64326.2 | — | — | — | 12.3 | 0.28 | 16 | 7.7 | 0.05 | 8 |
| LNU299 | 64328.2 | 0.7 | 0.26 | 11 | — | — | — | 7.5 | 0.16 | 5 |
| LNU295 | 63899.5 | — | — | — | 12.9 | 0.10 | 21 | 7.9 | 0.02 | 11 |
| LNU295 | 63899.8 | — | — | — | — | — | — | 8.0 | 0.03 | 12 |
| LNU295 | 63901.3 | — | — | — | — | — | — | 7.5 | 0.14 | 5 |
| LNU295 | 63902.3 | — | — | — | — | — | — | 7.9 | L | 11 |
| CONT. | — | 0.6 | — | — | 10.7 | — | — | 7.1 | — | — |
| LNU483 | 64803.2 | 0.6 | 0.08 | 19 | 13.4 | L | 42 | — | — | — |
| LNU483 | 64803.3 | 0.6 | 0.02 | 39 | 14.8 | 0.06 | 58 | — | — | — |
| LNU483 | 64805.1 | — | — | — | 13.0 | 0.02 | 39 | — | — | — |
| LNU483 | 64805.2 | — | — | — | 15.0 | 0.29 | 60 | — | — | — |
| LNU483 | 64806.2 | — | — | — | 11.7 | 0.15 | 25 | — | — | — |
| LNU378 | 64494.2 | — | — | — | 10.9 | 0.25 | 17 | — | — | — |
| LNU378 | 64495.4 | 0.5 | 0.19 | 16 | — | — | — | — | — | — |
| LNU346 | 65008.2 | 0.6 | 0.23 | 19 | — | — | — | — | — | — |
| LNU346 | 65008.3 | 0.5 | 0.30 | 12 | — | — | — | — | — | — |
| LNU290 | 64369.6 | 0.5 | 0.27 | 11 | — | — | — | — | — | — |

TABLE 70-continued

Genes showing improved plant performance at nitrogen deficient conditions (T2 generation)

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.5 | — | — | 9.4 | — | — | — | — | — |
| LNU510 | 64152.1 | 0.5 | 0.25 | 18 | 9.8 | 0.25 | 11 | — | — | — |
| LNU510 | 64154.2 | 0.5 | 0.27 | 20 | 11.0 | 0.07 | 25 | 7.7 | 0.09 | 8 |
| LNU489 | 64010.8 | — | — | — | 10.3 | 0.19 | 17 | — | — | — |
| LNU489 | 64012.1 | — | — | — | 10.1 | 0.27 | 15 | 8.3 | L | 18 |
| LNU489 | 64013.1 | — | — | — | — | — | — | 7.5 | 0.28 | 6 |
| LNU438 | 63994.1 | — | — | — | — | — | — | 7.5 | 0.29 | 6 |
| LNU438 | 63994.12 | — | — | — | 10.4 | 0.07 | 18 | 8.0 | 0.02 | 13 |
| LNU438 | 63994.3 | — | — | — | — | — | — | 7.5 | 0.16 | 7 |
| LNU427 | 64178.6 | — | — | — | — | — | — | 7.5 | 0.22 | 6 |
| LNU383 | 63982.7 | — | — | — | — | — | — | 7.7 | 0.12 | 9 |
| LNU383 | 63983.1 | — | — | — | — | — | — | 7.7 | 0.17 | 8 |
| LNU354 | 63971.5 | — | — | — | — | — | — | 7.5 | 0.28 | 6 |
| LNU354 | 63972.8 | — | — | — | 9.9 | 0.20 | 12 | 7.7 | 0.07 | 9 |
| LNU310 | 63905.1 | 0.5 | 0.17 | 16 | 12.4 | 0.05 | 41 | 7.9 | 0.03 | 12 |
| LNU295 | 63899.5 | — | — | — | 11.1 | 0.05 | 26 | 7.9 | 0.03 | 11 |
| LNU295 | 63899.8 | 0.6 | L | 35 | 12.3 | 0.04 | 40 | 8.0 | 0.05 | 13 |
| LNU295 | 63901.3 | — | — | — | — | — | — | 7.9 | 0.07 | 12 |
| LNU295 | 63902.3 | — | — | — | — | — | — | 7.6 | 0.17 | 8 |
| CONT. | — | 0.4 | — | — | 8.8 | — | — | 7.1 | — | — |
| LNU490 | 66092.3 | 0.4 | 0.24 | 19 | — | — | — | — | — | — |
| LNU490 | 66093.1 | — | — | — | 7.0 | 0.22 | 18 | 6.6 | 0.25 | 4 |
| LNU490 | 66093.2 | — | — | — | 6.8 | 0.26 | 15 | 6.7 | 0.10 | 6 |
| LNU490 | 66096.1 | — | — | — | 8.2 | 0.03 | 38 | 7.2 | L | 14 |
| LNU443 | 64023.2 | — | — | — | 8.2 | 0.08 | 37 | — | — | — |
| LNU443 | 64024.4 | 0.5 | 0.07 | 35 | 8.4 | 0.08 | 41 | 6.8 | 0.11 | 9 |
| LNU443 | 64024.7 | 0.5 | 0.01 | 49 | 8.1 | 0.10 | 37 | 6.6 | 0.30 | 6 |
| LNU439 | 64615.4 | — | — | — | — | — | — | 6.6 | 0.24 | 6 |
| LNU439 | 64616.2 | 0.4 | 0.12 | 29 | 8.0 | 0.12 | 34 | 6.9 | 0.06 | 9 |
| LNU439 | 64618.3 | 0.6 | L | 61 | 9.5 | 0.01 | 60 | 6.9 | 0.03 | 9 |
| LNU437_H2 | 66104.1 | 0.5 | 0.09 | 30 | 8.7 | L | 46 | 6.8 | 0.13 | 9 |
| LNU437_H2 | 66104.2 | — | — | — | 7.5 | 0.16 | 27 | 6.7 | 0.13 | 6 |
| LNU437_H2 | 66104.3 | 0.4 | 0.27 | 17 | 7.6 | 0.03 | 27 | 6.7 | 0.15 | 6 |
| LNU436 | 64240.1 | — | — | — | 8.1 | 0.02 | 36 | 7.0 | 0.01 | 11 |
| LNU436 | 64240.2 | 0.4 | 0.09 | 29 | 8.4 | 0.03 | 41 | 6.9 | 0.05 | 9 |
| LNU436 | 64241.3 | — | — | — | 8.2 | 0.01 | 37 | 6.8 | 0.05 | 8 |
| LNU436 | 64242.2 | 0.5 | 0.09 | 30 | — | — | — | — | — | — |
| LNU436 | 64243.1 | 0.4 | 0.17 | 28 | — | — | — | — | — | — |
| LNU433 | 64815.1 | 0.5 | 0.04 | 50 | — | — | — | — | — | — |
| LNU433 | 64816.1 | — | — | — | 10.1 | 0.07 | 70 | — | — | — |
| LNU311 | 66099.1 | — | — | — | 8.4 | 0.15 | 42 | — | — | — |
| LNU311 | 66099.2 | 0.4 | 0.22 | 20 | 7.0 | 0.13 | 18 | 6.8 | 0.12 | 9 |
| LNU298 | 66086.4 | 0.4 | 0.24 | 19 | 8.8 | L | 48 | 7.0 | 0.01 | 12 |
| LNU298 | 66088.3 | — | — | — | 8.8 | 0.02 | 48 | 6.7 | 0.13 | 7 |
| LNU298 | 66089.1 | 0.4 | 0.14 | 26 | 8.0 | 0.01 | 34 | 6.7 | 0.12 | 6 |
| LNU298 | 66089.3 | — | — | — | 8.0 | 0.19 | 34 | 6.8 | 0.19 | 8 |
| LNU293 | 65048.1 | — | — | — | 7.2 | 0.20 | 22 | — | — | — |
| LNU293 | 65049.1 | — | — | — | 8.5 | L | 44 | — | — | — |
| LNU293 | 65050.3 | 0.5 | 0.07 | 34 | 8.8 | 0.06 | 48 | — | — | — |
| LNU293 | 65051.3 | 0.5 | 0.10 | 40 | 8.9 | 0.09 | 49 | 6.6 | 0.29 | 4 |
| CONT. | — | 0.3 | — | — | 5.9 | — | — | 6.3 | — | — |

Table 70: "CONT."—Control;
"Ave."—Average;
"% Incr." = % increment;
"p-val."—p-value;
L means that p-value is less than 0.01, p < 0.1 was considered as significant.

TABLE 71

Genes showing improved plant performance at nitrogen deficient conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LNU488 | 54.5 | 0.06 | 51 | 115.3 | 0.06 | 39 |
| LNU466 | 50.5 | 0.13 | 40 | 107.7 | 0.14 | 30 |
| LNU453 | 57.0 | 0.02 | 58 | 113.2 | 0.10 | 36 |
| LNU359 | 52.2 | 0.22 | 45 | 110.4 | 0.08 | 33 |
| LNU358 | — | — | — | 108.4 | 0.08 | 30 |
| LNU341 | — | — | — | 107.6 | 0.11 | 29 |
| LNU309_H3 | — | — | — | 138.0 | L | 66 |
| CONT. | 36.0 | — | — | 83.2 | — | — |

Table 71:
"CONT."—Control;
"Ave."—Average;
"% Incr." = % increment.
"p-val."—p-value;
L means that p-value is less than 0.01, p < 0.1 was considered as significant.

TABLE 72

Genes showing improved plant performance at nitrogen deficient conditions (T1 generation)

| Gene Name | Leaf Area [cm$^2$] | | | Roots Coverage [cm$^2$] | | | Roots Length [cm$^2$] | | |
|---|---|---|---|---|---|---|---|---|---|
| | Ave. | P-Val. | % Incr. | Ave. | P-Val. | % Incr. | Ave. | P-Val. | % Incr. |
| LNU490 | — | — | — | 6.6 | 0.15 | 83 | 5.3 | 0.03 | 27 |
| LNU417_H4 | — | — | — | — | — | — | 4.8 | 0.08 | 14 |
| LNU394 | — | — | — | 4.9 | 0.12 | 36 | 4.8 | 0.03 | 16 |
| CONT. | — | — | — | 3.6 | — | — | 4.2 | — | — |
| LNU488 | 0.6 | 0.02 | 42 | 8.7 | 0.03 | 81 | 6.5 | L | 28 |
| LNU466 | — | — | — | 6.7 | 0.06 | 38 | 6.2 | 0.03 | 22 |
| LNU453 | 0.7 | 0.04 | 43 | 6.5 | 0.20 | 35 | — | — | — |
| LNU359 | 0.6 | 0.25 | 29 | 7.2 | 0.10 | 50 | 6.3 | 0.10 | 25 |
| LNU358 | 0.6 | 0.06 | 22 | 7.8 | L | 62 | 6.3 | L | 24 |
| LNU341 | 0.6 | 0.01 | 26 | 5.4 | 0.28 | 11 | — | — | — |
| LNU309_H3 | 0.7 | L | 55 | 9.3 | L | 93 | 7.0 | L | 37 |
| CONT. | 0.5 | — | — | 4.8 | — | — | 5.1 | — | — |

Table 72:
"CONT."—Control;
"Ave."—Average;
"% Incr." = % increment;
"p-val."—p-value;
L means that p-value is less than 0.01, p < 0.1 was considered as significant.

The genes listed in Tables 73-74 have improved plant relative growth rate (relative growth rate of the leaf area, root coverage and root length) when grown under limiting nitrogen growth conditions, compared to control plants (T2 and T1 generations). Plants showing fast growth rate show a better plant establishment in soil under nitrogen deficient conditions. Faster growth was observed when growth rate of leaf area and root length and coverage was measured.

TABLE 73

Genes showing improved plant growth rate at nitrogen deficient conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU437_H2 | 66104.1 | 0.0 | 0.13 | 31 | — | — | — | — | — | — |
| LNU437_H2 | 66104.2 | 0.0 | 0.09 | 41 | — | — | — | — | — | — |
| LNU437_H2 | 66104.3 | 0.1 | 0.05 | 44 | — | — | — | — | — | — |
| LNU437_H2 | 66105.3 | 0.1 | 0.05 | 44 | — | — | — | — | — | — |
| LNU426 | 66147.3 | 0.1 | L | 73 | — | — | — | — | — | — |
| LNU420 | 64006.3 | 0.0 | 0.29 | 26 | — | — | — | — | — | — |
| LNU420 | 64007.3 | 0.0 | 0.16 | 29 | — | — | — | — | — | — |
| LNU352 | 64199.1 | 0.1 | L | 92 | — | — | — | 0.8 | 0.08 | 13 |

TABLE 73-continued

Genes showing improved plant growth rate at nitrogen deficient conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU352 | 64200.1 | 0.0 | 0.07 | 41 | — | — | — | — | — | — |
| LNU352 | 64200.4 | 0.0 | 0.10 | 37 | — | — | — | 0.8 | 0.07 | 13 |
| LNU292 | 64085.4 | 0.0 | 0.29 | 22 | — | — | — | 0.7 | 0.18 | 9 |
| CONT. | — | 0.0 | — | — | — | — | — | 0.7 | — | — |
| LNU483 | 64805.2 | — | — | — | — | — | — | 0.7 | 0.17 | 11 |
| LNU464 | 65076.1 | — | — | — | — | — | — | 0.7 | 0.24 | 9 |
| LNU439 | 64616.2 | 0.1 | 0.25 | 15 | — | — | — | — | — | — |
| LNU439 | 64616.3 | 0.1 | 0.18 | 15 | — | — | — | — | — | — |
| LNU439 | 64618.3 | 0.1 | 0.25 | 13 | — | — | — | — | — | — |
| LNU425 | 63911.9 | 0.1 | 0.05 | 21 | — | — | — | — | — | — |
| LNU414 | 64479.1 | 0.1 | 0.03 | 25 | — | — | — | — | — | — |
| LNU414 | 64480.2 | 0.1 | 0.06 | 26 | — | — | — | — | — | — |
| LNU346 | 65008.2 | 0.1 | 0.09 | 20 | — | — | — | — | — | — |
| LNU336 | 64448.2 | 0.1 | L | 40 | — | — | — | — | — | — |
| CONT. | — | 0.1 | — | — | — | — | — | 0.6 | — | — |
| LNU473 | 65770.4 | 0.1 | 0.28 | 14 | — | — | — | 0.8 | 0.02 | 14 |
| LNU470 | 64228.3 | — | — | — | — | — | — | 0.7 | 0.16 | 9 |
| LNU470 | 64229.1 | 0.1 | 0.14 | 18 | — | — | — | 0.8 | 0.08 | 11 |
| LNU460 | 64359.3 | — | — | — | — | — | — | 0.8 | 0.02 | 15 |
| LNU421 | 64303.3 | 0.1 | 0.08 | 24 | — | — | — | — | — | — |
| LNU408 | 64248.10 | 0.1 | 0.17 | 16 | — | — | — | — | — | — |
| LNU380 | 65764.1 | — | — | — | — | — | — | 0.7 | 0.13 | 8 |
| LNU380 | 65764.2 | — | — | — | — | — | — | 0.7 | 0.24 | 5 |
| LNU380 | 65764.3 | — | — | — | — | — | — | 0.8 | 0.03 | 11 |
| LNU380 | 65765.4 | — | — | — | — | — | — | 0.8 | 0.05 | 10 |
| LNU340 | 64290.7 | 0.1 | 0.10 | 21 | — | — | — | 0.8 | 0.05 | 12 |
| LNU340 | 64292.5 | — | — | — | — | — | — | 0.7 | 0.16 | 6 |
| LNU331 | 64214.2 | 0.1 | 0.01 | 31 | — | — | — | 0.7 | 0.07 | 10 |
| LNU331 | 64215.1 | 0.1 | L | 44 | — | — | — | 0.8 | 0.02 | 14 |
| CONT. | — | 0.1 | — | — | — | — | — | 0.7 | — | — |
| LNU430 | 63934.3 | 0.0 | 0.20 | 18 | — | — | — | — | — | — |
| LNU407 | 64219.2 | 0.1 | 0.18 | 22 | — | — | — | — | — | — |
| LNU402 | 63914.2 | 0.0 | 0.29 | 16 | — | — | — | — | — | — |
| LNU335 | 64168.15 | — | — | — | — | — | — | 0.7 | 0.30 | 10 |
| LNU335 | 64169.2 | 0.0 | 0.17 | 20 | — | — | — | — | — | — |
| LNU301 | 63927.3 | 0.1 | 0.16 | 29 | — | — | — | — | — | — |
| LNU301 | 63950.3 | 0.1 | L | 64 | — | — | — | — | — | — |
| CONT. | — | 0.0 | — | — | — | — | — | 0.7 | — | — |
| LNU450 | 63708.3 | 0.1 | 0.02 | 29 | — | — | — | — | — | — |
| LNU450 | 63710.2 | 0.1 | 0.07 | 21 | — | — | — | — | — | — |
| LNU450 | 63712.3 | 0.1 | 0.04 | 28 | — | — | — | — | — | — |
| LNU416 | 64136.4 | 0.1 | 0.09 | 21 | — | — | — | 0.8 | 0.20 | 11 |
| LNU412 | 63940.12 | 0.1 | 0.20 | 22 | — | — | — | — | — | — |
| LNU412 | 63940.8 | 0.1 | 0.25 | 16 | — | — | — | — | — | — |
| LNU359 | 66154.6 | 0.1 | 0.13 | 16 | — | — | — | — | — | — |
| LNU293 | 65051.3 | 0.1 | 0.19 | 18 | — | — | — | — | — | — |
| CONT. | — | 0.1 | — | — | — | — | — | 0.7 | — | — |
| LNU498 | 64186.2 | — | — | — | — | — | — | 0.7 | 0.23 | 8 |
| LNU498 | 64186.3 | — | — | — | — | — | — | 0.7 | 0.14 | 9 |
| LNU493 | 64191.2 | 0.0 | 0.14 | 17 | — | — | — | — | — | — |
| LNU455 | 64187.5 | 0.0 | 0.13 | 16 | — | — | — | — | — | — |
| LNU328 | 64150.4 | — | — | — | — | — | — | 0.7 | 0.07 | 11 |
| LNU328 | 64151.1 | 0.0 | 0.21 | 15 | — | — | — | — | — | — |
| LNU322 | 63917.2 | — | — | — | — | — | — | 0.7 | 0.30 | 7 |
| LNU322 | 63918.1 | 0.0 | 0.16 | 14 | — | — | — | — | — | — |
| LNU317 | 64097.2 | — | — | — | — | — | — | 0.7 | 0.11 | 11 |
| LNU305 | 64114.1 | — | — | — | — | — | — | 0.7 | 0.28 | 6 |
| CONT. | — | 0.0 | — | — | — | — | — | 0.7 | — | — |
| LNU495 | 64697.3 | — | — | — | — | — | — | 0.7 | 0.04 | 14 |
| LNU495 | 64698.2 | — | — | — | — | — | — | 0.7 | 0.12 | 11 |
| LNU487 | 64702.3 | — | — | — | — | — | — | 0.7 | 0.07 | 17 |
| LNU487 | 64705.4 | — | — | — | — | — | — | 0.7 | 0.20 | 8 |
| LNU487 | 64706.2 | 0.1 | 0.11 | 16 | — | — | — | — | — | — |
| LNU474 | 64381.1 | — | — | — | — | — | — | 0.7 | 0.17 | 10 |
| LNU465 | 64020.1 | 0.1 | 0.14 | 17 | — | — | — | 0.7 | 0.11 | 14 |
| LNU465 | 64020.4 | 0.1 | 0.08 | 22 | — | — | — | 0.7 | 0.14 | 10 |
| LNU446 | 64546.2 | 0.1 | 0.03 | 24 | — | — | — | — | — | — |
| LNU446 | 64549.2 | — | — | — | — | — | — | 0.7 | 0.10 | 11 |
| LNU443 | 64023.2 | 0.1 | 0.06 | 24 | — | — | — | 0.7 | 0.16 | 11 |
| LNU443 | 64023.9 | — | — | — | — | — | — | 0.7 | 0.04 | 15 |
| LNU443 | 64024.7 | — | — | — | — | — | — | 0.7 | 0.07 | 13 |
| LNU436 | 64240.1 | 0.1 | 0.13 | 20 | — | — | — | — | — | — |

TABLE 73-continued

Genes showing improved plant growth rate at nitrogen deficient conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU436 | 64240.2 | — | — | — | — | — | — | 0.7 | 0.26 | 9 |
| LNU436 | 64241.3 | 0.1 | 0.14 | 17 | — | — | — | — | — | — |
| LNU436 | 64243.1 | 0.1 | 0.01 | 24 | — | — | — | 0.7 | 0.07 | 13 |
| LNU379 | 64170.2 | — | — | — | — | — | — | 0.7 | 0.23 | 10 |
| LNU379 | 64170.3 | — | — | — | — | — | — | 0.7 | 0.20 | 8 |
| LNU379 | 64170.4 | — | — | — | — | — | — | 0.7 | 0.25 | 9 |
| LNU379 | 64172.2 | — | — | — | — | — | — | 0.7 | 0.18 | 9 |
| LNU315 | 64224.3 | 0.1 | 0.18 | 14 | — | — | — | 0.8 | 0.01 | 23 |
| LNU315 | 64225.1 | 0.1 | 0.21 | 13 | — | — | — | — | — | — |
| CONT. | — | 0.0 | — | — | — | — | — | 0.6 | — | — |
| LNU497 | 64207.3 | — | — | — | — | — | — | 0.6 | 0.28 | 7 |
| LNU491 | 64405.2 | 0.1 | 0.04 | 38 | — | — | — | 0.7 | 0.06 | 12 |
| LNU491 | 64406.4 | 0.1 | 0.04 | 37 | — | — | — | 0.7 | L | 24 |
| LNU449 | 64571.3 | 0.1 | 0.06 | 32 | — | — | — | 0.7 | 0.01 | 19 |
| LNU435 | 64464.3 | 0.1 | L | 67 | — | — | — | 0.7 | 0.04 | 12 |
| LNU435 | 64465.1 | — | — | — | — | — | — | 0.7 | 0.29 | 10 |
| LNU432 | 64065.2 | — | — | — | — | — | — | 0.7 | 0.03 | 11 |
| LNU432 | 64559.2 | 0.1 | 0.05 | 31 | — | — | — | 0.7 | L | 19 |
| LNU432 | 64560.3 | 0.1 | 0.22 | 19 | — | — | — | — | — | — |
| LNU432 | 64560.5 | 0.1 | 0.13 | 24 | — | — | — | 0.7 | L | 17 |
| LNU367 | 64398.2 | 0.1 | 0.18 | 25 | — | — | — | 0.7 | 0.15 | 10 |
| LNU367 | 64399.1 | — | — | — | — | — | — | 0.7 | 0.26 | 8 |
| LNU364 | 64441.2 | 0.1 | 0.21 | 22 | — | — | — | 0.7 | 0.20 | 12 |
| LNU362 | 64324.3 | 0.1 | 0.27 | 19 | — | — | — | — | — | — |
| CONT. | — | 0.1 | — | — | — | — | — | 0.6 | — | — |
| LNU495 | 64697.2 | 0.1 | 0.01 | 21 | — | — | — | — | — | — |
| LNU495 | 64697.3 | 0.1 | L | 42 | — | — | — | 0.7 | 0.01 | 25 |
| LNU495 | 64698.2 | 0.1 | 0.01 | 31 | — | — | — | — | — | — |
| LNU495 | 64701.3 | 0.1 | 0.10 | 23 | — | — | — | 0.7 | 0.06 | 15 |
| LNU487 | 64702.1 | — | — | — | — | — | — | 0.7 | 0.05 | 17 |
| LNU487 | 64702.3 | — | — | — | — | — | — | 0.6 | 0.26 | 10 |
| LNU487 | 64704.2 | — | — | — | — | — | — | 0.6 | 0.23 | 11 |
| LNU487 | 64705.4 | 0.1 | L | 38 | — | — | — | — | — | — |
| LNU487 | 64706.2 | 0.1 | 0.04 | 22 | — | — | — | — | — | — |
| LNU474 | 64379.1 | — | — | — | — | — | — | 0.7 | 0.18 | 13 |
| LNU474 | 64382.3 | 0.1 | 0.02 | 26 | — | — | — | — | — | — |
| LNU474 | 64383.2 | 0.1 | L | 29 | — | — | — | 0.7 | 0.18 | 13 |
| LNU465 | 64020.1 | 0.1 | 0.10 | 19 | — | — | — | — | — | — |
| LNU465 | 64021.7 | 0.0 | 0.30 | 11 | — | — | — | — | — | — |
| LNU446 | 64546.3 | 0.1 | 0.15 | 21 | — | — | — | — | — | — |
| LNU446 | 64549.3 | 0.1 | 0.04 | 21 | — | — | — | — | — | — |
| LNU443 | 64023.2 | 0.1 | L | 31 | — | — | — | 0.7 | 0.27 | 12 |
| LNU443 | 64024.7 | — | — | — | — | — | — | 0.7 | L | 23 |
| LNU436 | 64240.1 | 0.0 | 0.15 | 13 | — | — | — | — | — | — |
| LNU436 | 64240.2 | 0.1 | 0.04 | 29 | — | — | — | 0.7 | 0.13 | 15 |
| LNU436 | 64241.3 | 0.1 | L | 55 | — | — | — | — | — | — |
| LNU436 | 64242.2 | 0.1 | 0.14 | 17 | — | — | — | — | — | — |
| LNU436 | 64243.1 | 0.1 | 0.01 | 31 | — | — | — | — | — | — |
| LNU379 | 64170.2 | — | — | — | — | — | — | 0.7 | 0.07 | 19 |
| LNU379 | 64172.1 | 0.0 | 0.20 | 15 | — | — | — | 0.6 | 0.24 | 10 |
| LNU315 | 64224.1 | 0.1 | 0.13 | 25 | — | — | — | — | — | — |
| LNU315 | 64225.2 | 0.1 | 0.01 | 45 | — | — | — | — | — | — |
| LNU315 | 64226.3 | 0.1 | 0.01 | 45 | — | — | — | — | — | — |
| LNU315 | 64227.3 | 0.1 | L | 36 | — | — | — | — | — | — |
| CONT. | — | 0.0 | — | — | — | — | — | 0.6 | — | — |
| LNU518 | 64015.4 | — | — | — | — | — | — | 0.7 | 0.21 | 10 |
| LNU502 | 64039.3 | — | — | — | — | — | — | 0.7 | 0.25 | 9 |
| LNU482 | 64164.1 | — | — | — | — | — | — | 0.7 | 0.12 | 12 |
| LNU405 | 64158.9 | 0.1 | 0.06 | 42 | — | — | — | 0.7 | 0.28 | 13 |
| LNU403 | 64237.6 | — | — | — | — | — | — | 0.7 | 0.21 | 9 |
| LNU403 | 64239.1 | 0.1 | 0.13 | 33 | — | — | — | — | — | — |
| LNU374 | 63997.2 | — | — | — | — | — | — | 0.7 | 0.18 | 12 |
| CONT. | — | 0.1 | — | — | — | — | — | 0.6 | — | — |
| LNU519 | 64678.1 | 0.1 | 0.03 | 33 | — | — | — | — | — | — |
| LNU519 | 64679.1 | 0.0 | 0.29 | 15 | — | — | — | — | — | — |
| LNU519 | 64680.2 | — | — | — | — | — | — | 0.7 | 0.27 | 10 |
| LNU519 | 64681.3 | — | — | — | — | — | — | 0.7 | 0.29 | 10 |
| LNU519 | 64681.8 | 0.0 | 0.18 | 18 | — | — | — | 0.7 | 0.27 | 11 |
| LNU500 | 64220.1 | 0.0 | 0.22 | 17 | — | — | — | — | — | — |
| LNU500 | 64223.1 | 0.1 | L | 59 | — | — | — | 0.8 | 0.11 | 15 |
| LNU500 | 64223.2 | 0.0 | 0.24 | 17 | — | — | — | 0.8 | 0.04 | 18 |
| LNU459 | 64542.1 | — | — | — | — | — | — | 0.8 | 0.16 | 12 |

TABLE 73-continued

Genes showing improved plant growth rate at nitrogen deficient conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU459 | 64542.3 | 0.1 | 0.01 | 38 | — | — | — | — | — | — |
| LNU459 | 64542.4 | — | — | — | — | — | — | 0.7 | 0.21 | 11 |
| LNU459 | 64543.2 | — | — | — | — | — | — | 0.8 | 0.14 | 13 |
| LNU348 | 64472.2 | 0.1 | 0.03 | 31 | — | — | — | — | — | — |
| LNU348 | 64472.3 | 0.0 | 0.13 | 23 | — | — | — | — | — | — |
| LNU348 | 64474.1 | 0.1 | 0.04 | 31 | — | — | — | — | — | — |
| LNU348 | 64474.2 | 0.1 | 0.06 | 33 | — | — | — | — | — | — |
| LNU329 | 63429.1 | 0.1 | 0.01 | 35 | — | — | — | 0.8 | 0.05 | 19 |
| LNU316 | 64068.1 | 0.0 | 0.24 | 16 | — | — | — | — | — | — |
| CONT. | — | 0.0 | — | — | — | — | — | 0.7 | — | — |
| LNU499 | 64146.11 | — | — | — | — | — | — | 0.6 | 0.24 | 11 |
| LNU490 | 66093.2 | — | — | — | — | — | — | 0.6 | 0.07 | 18 |
| LNU490 | 66095.2 | — | — | — | — | — | — | 0.6 | 0.17 | 14 |
| LNU437_H2 | 66104.1 | 0.1 | 0.04 | 38 | — | — | — | 0.6 | 0.11 | 17 |
| LNU437_H2 | 66104.2 | — | — | — | — | — | — | 0.6 | 0.17 | 14 |
| LNU395 | 64143.6 | — | — | — | — | — | — | 0.6 | 0.07 | 17 |
| LNU312 | 64002.5 | — | — | — | — | — | — | 0.7 | 0.04 | 21 |
| CONT. | — | 0.0 | — | — | — | — | — | 0.5 | — | — |
| LNU392 | 63696.1 | — | — | — | — | — | — | 0.7 | 0.23 | 11 |
| LNU347 | 63510.4 | — | — | — | — | — | — | 0.7 | 0.22 | 11 |
| LNU347 | 63513.3 | 0.1 | 0.01 | 25 | — | — | — | — | — | — |
| CONT. | — | 0.1 | — | — | — | — | — | 0.6 | — | — |
| LNU497 | 64207.2 | 0.1 | 0.16 | 19 | — | — | — | — | — | — |
| LNU491 | 64404.3 | 0.1 | 0.08 | 21 | — | — | — | — | — | — |
| LNU491 | 64404.6 | 0.1 | 0.09 | 23 | — | — | — | — | — | — |
| LNU449 | 63892.1 | 0.1 | 0.24 | 15 | — | — | — | — | — | — |
| LNU432 | 64066.2 | 0.1 | 0.19 | 20 | — | — | — | — | — | — |
| CONT. | — | 0.1 | — | — | — | — | — | — | — | — |
| LNU489 | 64012.1 | — | — | — | — | — | — | 0.8 | 0.29 | 9 |
| LNU354 | 63970.6 | — | — | — | — | — | — | 0.8 | 0.17 | 11 |
| LNU354 | 63972.8 | — | — | — | — | — | — | 0.8 | 0.25 | 10 |
| LNU299 | 64328.2 | 0.1 | 0.30 | 13 | — | — | — | — | — | — |
| LNU295 | 63901.3 | 0.1 | 0.15 | 19 | — | — | — | 0.8 | 0.26 | 9 |
| CONT. | — | 0.1 | — | — | — | — | — | 0.7 | — | — |
| LNU483 | 64803.3 | 0.1 | 0.09 | 34 | — | — | — | — | — | — |
| CONT. | — | 0.0 | — | — | — | — | — | — | — | — |
| LNU510 | 64154.2 | 0.1 | 0.12 | 30 | — | — | — | 0.7 | 0.24 | 10 |
| LNU489 | 64012.1 | — | — | — | — | — | — | 0.8 | 0.04 | 18 |
| LNU438 | 63994.1 | — | — | — | — | — | — | 0.7 | 0.26 | 9 |
| LNU438 | 63994.12 | — | — | — | — | — | — | 0.8 | 0.05 | 16 |
| LNU438 | 63994.3 | — | — | — | — | — | — | 0.7 | 0.18 | 11 |
| LNU438 | 63994.5 | — | — | — | — | — | — | 0.7 | 0.20 | 11 |
| LNU427 | 64178.6 | — | — | — | — | — | — | 0.7 | 0.24 | 9 |
| LNU427 | 64180.3 | — | — | — | — | — | — | 0.7 | 0.27 | 11 |
| LNU383 | 63982.7 | — | — | — | — | — | — | 0.7 | 0.24 | 10 |
| LNU383 | 63983.1 | — | — | — | — | — | — | 0.7 | 0.23 | 10 |
| LNU354 | 63972.8 | — | — | — | — | — | — | 0.7 | 0.29 | 8 |
| LNU310 | 63905.1 | 0.1 | 0.13 | 29 | — | — | — | 0.8 | 0.09 | 16 |
| LNU310 | 63906.2 | — | — | — | — | — | — | 0.7 | 0.18 | 12 |
| LNU295 | 63899.8 | 0.1 | 0.03 | 39 | — | — | — | 0.8 | 0.04 | 18 |
| LNU295 | 63901.3 | — | — | — | — | — | — | 0.8 | 0.04 | 17 |
| LNU295 | 63902.3 | — | — | — | — | — | — | 0.7 | 0.25 | 10 |
| CONT. | — | 0.0 | — | — | — | — | — | 0.7 | — | — |
| LNU490 | 66092.3 | 0.0 | 0.29 | 25 | — | — | — | — | — | — |
| LNU490 | 66093.1 | — | — | — | — | — | — | 0.6 | 0.12 | 10 |
| LNU443 | 64023.2 | — | — | — | — | — | — | 0.6 | 0.23 | 9 |
| LNU443 | 64024.4 | 0.0 | 0.15 | 36 | — | — | — | 0.6 | 0.25 | 9 |
| LNU443 | 64024.7 | 0.0 | 0.13 | 42 | — | — | — | — | — | — |
| LNU439 | 64614.4 | — | — | — | — | — | — | 0.6 | 0.24 | 9 |
| LNU439 | 64616.2 | 0.0 | 0.12 | 38 | — | — | — | 0.6 | 0.16 | 10 |
| LNU439 | 64618.3 | 0.1 | 0.01 | 66 | — | — | — | — | — | — |
| LNU437_H2 | 66104.1 | 0.0 | 0.23 | 28 | — | — | — | — | — | — |
| LNU437_H2 | 66104.2 | — | — | — | — | — | — | 0.6 | 0.06 | 13 |
| LNU437_H2 | 66104.3 | — | — | — | — | — | — | 0.6 | 0.11 | 11 |
| LNU436 | 64240.1 | — | — | — | — | — | — | 0.6 | 0.06 | 14 |
| LNU436 | 64240.2 | 0.0 | 0.20 | 31 | — | — | — | — | — | — |
| LNU436 | 64241.3 | — | — | — | — | — | — | 0.6 | 0.24 | 9 |
| LNU436 | 64242.2 | 0.0 | 0.23 | 29 | — | — | — | — | — | — |
| LNU436 | 64243.1 | 0.0 | 0.24 | 29 | — | — | — | — | — | — |
| LNU433 | 64815.1 | 0.1 | 0.04 | 54 | — | — | — | — | — | — |
| LNU311 | 66099.1 | — | — | — | — | — | — | 0.6 | 0.28 | 12 |
| LNU298 | 66086.4 | — | — | — | — | — | — | 0.6 | 0.08 | 13 |

TABLE 73-continued

Genes showing improved plant growth rate at nitrogen deficient conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU298 | 66088.3 | — | — | — | — | — | — | 0.6 | 0.03 | 16 |
| LNU298 | 66089.1 | 0.0 | 0.16 | 34 | — | — | — | 0.6 | 0.09 | 13 |
| LNU298 | 66089.3 | — | — | — | — | — | — | 0.6 | 0.17 | 11 |
| LNU293 | 65048.1 | — | — | — | — | — | — | 0.6 | 0.09 | 14 |
| LNU293 | 65049.1 | — | — | — | — | — | — | 0.6 | 0.14 | 12 |
| LNU293 | 65050.3 | 0.0 | 0.22 | 31 | — | — | — | — | — | — |
| LNU293 | 65051.3 | 0.0 | 0.10 | 44 | — | — | — | 0.6 | 0.05 | 14 |
| CONT. | — | 0.0 | — | — | — | — | — | 0.5 | — | — |

Table 73:
"CONT."—Control;
"Ave."—Average
"% Incr." = % increment;
"p-val."—p-value;
L means that p-value is less than 0.01, p < 0.1 was considered as significant.

TABLE 74

Genes showing improved plant growth rate at nitrogen deficient conditions (T1 generation)

| Gene Name | RGR Of Leaf Area | | | RGR Of Root Coverage | | | RGR Of Roots Length | | |
|---|---|---|---|---|---|---|---|---|---|
| | Ave. | P-Val. | % Incr. | Ave. | P-Val. | % Incr. | Ave. | P-Val. | % Incr. |
| LNU490 | 0.1 | 0.29 | 18 | — | — | — | 0.6 | L | 27 |
| LNU417_H4 | — | — | — | — | — | — | 0.5 | 0.14 | 14 |
| LNU394 | — | — | — | — | — | — | 0.6 | 0.05 | 17 |
| CONT. | 0.1 | — | — | — | — | — | 0.5 | — | — |
| LNU488 | 0.1 | L | 55 | — | — | — | 0.7 | L | 34 |
| LNU466 | 0.1 | 0.16 | 17 | — | — | — | 0.7 | L | 28 |
| LNU453 | 0.1 | L | 49 | — | — | — | 0.6 | 0.20 | 10 |
| LNU359 | 0.1 | 0.05 | 34 | — | — | — | 0.7 | L | 29 |
| LNU358 | 0.1 | 0.02 | 28 | — | — | — | 0.7 | L | 28 |
| LNU341 | 0.1 | 0.03 | 27 | — | — | — | — | — | — |
| LNU309_H3 | 0.1 | L | 67 | — | — | — | 0.8 | L | 42 |
| CONT. | 0.0 | — | — | — | — | — | 0.5 | — | — |

Table 74:
"CONT."—Control;
"Ave."—Average;
"% Incr." = % increment;
"p-val."—p-value;
L means that p-value is less than 0.01, p < 0.1 was considered as significant.

The genes listed in Tables 75-78 improved plant NUE when grown at standard nitrogen concentration levels. These genes produced larger plant biomass (plant fresh and dry weight; leaf area, root coverage and roots length) when grown under standard nitrogen growth conditions, compared to control plants in T2 (Tables 75-76) and T1 (Tables 77-78) generations. Larger plant biomass under this growth conditions indicates the high ability of the plant to better metabolize the nitrogen present in the medium. Plants producing larger root biomass have better possibilities to absorb larger amount of nitrogen from soil.

TABLE 75

Genes showing improved plant performance at standard nitrogen growth conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LNU437_H2 | 66104.1 | 4.2 | 0.09 | 38 | — | — | — |
| LNU437_H2 | 66104.2 | 5.2 | L | 70 | 78.6 | L | 48 |
| LNU437_H2 | 66104.3 | 5.5 | L | 80 | 91.3 | 0.03 | 71 |
| LNU437_H2 | 66105.1 | 3.7 | 0.12 | 21 | — | — | — |
| LNU426 | 66146.1 | 4.4 | 0.11 | 46 | 71.1 | 0.06 | 34 |

TABLE 75-continued

Genes showing improved plant performance at standard nitrogen growth conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU426 | 66147.3 | 6.7 | L | 122 | 117.6 | L | 121 |
| LNU420 | 64007.3 | 4.6 | 0.08 | 52 | 68.5 | 0.22 | 29 |
| LNU420 | 64008.4 | 5.2 | L | 72 | 77.3 | L | 45 |
| LNU420 | 64009.1 | 4.2 | 0.23 | 40 | — | — | — |
| LNU359 | 66154.6 | 3.7 | 0.19 | 21 | — | — | — |
| LNU359 | 66156.1 | 5.5 | L | 82 | 68.6 | 0.02 | 29 |
| LNU352 | 64199.1 | 7.7 | L | 154 | 124.9 | L | 135 |
| LNU352 | 64200.1 | 3.9 | 0.21 | 30 | — | — | — |
| LNU352 | 64200.10 | 4.0 | 0.02 | 32 | 67.3 | 0.05 | 26 |
| LNU352 | 64200.4 | 4.0 | 0.23 | 32 | — | — | — |
| LNU352 | 64201.1 | 4.0 | 0.18 | 34 | — | — | — |
| LNU292 | 64085.4 | 4.6 | L | 52 | 72.6 | L | 36 |
| CONT. | — | 3.0 | — | — | 53.2 | — | — |
| LNU483 | 64803.2 | 7.1 | 0.07 | 24 | 122.8 | 0.06 | 23 |
| LNU483 | 64803.3 | — | — | — | 120.7 | 0.17 | 21 |
| LNU483 | 64805.1 | 6.9 | 0.28 | 20 | 116.9 | 0.05 | 18 |
| LNU483 | 64805.2 | 7.9 | 0.06 | 37 | 132.6 | 0.02 | 33 |
| LNU477 | 63886.1 | 7.4 | 0.09 | 29 | 130.0 | 0.06 | 31 |
| LNU477 | 63888.1 | — | — | — | 124.5 | 0.15 | 25 |
| LNU477 | 63889.5 | — | — | — | 108.2 | 0.25 | 9 |
| LNU447 | 65000.1 | 7.5 | 0.27 | 31 | 141.4 | 0.09 | 42 |
| LNU447 | 65000.4 | — | — | — | 116.6 | 0.24 | 17 |
| LNU447 | 65002.3 | 7.4 | 0.19 | 29 | 140.6 | 0.05 | 41 |
| LNU447 | 65004.1 | — | — | — | 131.6 | 0.15 | 32 |
| LNU439 | 64616.2 | 7.9 | 0.18 | 37 | 132.8 | 0.01 | 34 |
| LNU439 | 64616.3 | 8.9 | 0.02 | 56 | 154.7 | 0.02 | 56 |
| LNU425 | 63910.9 | — | — | — | 116.5 | 0.19 | 17 |
| LNU425 | 63911.11 | — | — | — | 118.7 | 0.03 | 19 |
| LNU425 | 63911.12 | — | — | — | 116.9 | 0.12 | 18 |
| LNU425 | 63911.9 | 7.5 | 0.15 | 30 | 134.3 | 0.10 | 35 |
| LNU414 | 64475.1 | 8.3 | 0.14 | 44 | 143.4 | 0.16 | 44 |
| LNU414 | 64480.2 | — | — | — | 120.2 | 0.17 | 21 |
| LNU336 | 64447.2 | 9.0 | 0.13 | 56 | 172.0 | 0.02 | 73 |
| LNU336 | 64448.3 | — | — | — | 131.3 | 0.10 | 32 |
| LNU336 | 64449.3 | 6.7 | 0.29 | 17 | 113.6 | 0.09 | 14 |
| LNU336 | 64449.4 | 7.8 | 0.11 | 35 | 136.5 | 0.03 | 37 |
| CONT. | — | 5.8 | — | — | 99.4 | — | — |
| LNU473 | 65770.4 | — | — | — | 110.9 | 0.20 | 8 |
| LNU470 | 64228.3 | 6.5 | 0.22 | 24 | 126.1 | 0.22 | 23 |
| LNU470 | 64229.1 | 5.9 | 0.19 | 13 | — | — | — |
| LNU460 | 64359.3 | 9.7 | 0.05 | 86 | 173.9 | 0.03 | 69 |
| LNU460 | 64362.1 | 6.0 | 0.25 | 15 | — | — | — |
| LNU408 | 64248.10 | 6.2 | 0.14 | 18 | 115.2 | 0.10 | 12 |
| LNU408 | 64250.8 | 6.7 | 0.02 | 29 | 135.8 | 0.01 | 32 |
| LNU380 | 65765.4 | 6.2 | 0.13 | 20 | 123.1 | 0.20 | 20 |
| LNU331 | 64215.1 | 6.9 | 0.25 | 32 | 116.8 | 0.16 | 14 |
| LNU306 | 64131.2 | 6.0 | 0.22 | 14 | 119.4 | 0.04 | 16 |
| CONT. | — | 5.2 | — | — | 102.8 | — | — |
| LNU412 | 63940.8 | — | — | — | 118.0 | 0.24 | 41 |
| LNU407 | 64218.1 | — | — | — | 103.4 | 0.19 | 24 |
| LNU407 | 64219.2 | — | — | — | 106.8 | 0.10 | 28 |
| LNU402 | 63915.1 | — | — | — | 105.5 | 0.27 | 26 |
| LNU384 | 64161.7 | — | — | — | 121.1 | 0.22 | 45 |
| LNU360 | 64029.3 | — | — | — | 109.0 | 0.29 | 30 |
| LNU335 | 64168.18 | — | — | — | 101.5 | 0.26 | 21 |
| LNU301 | 63927.5 | — | — | — | 122.8 | 0.12 | 47 |
| CONT. | — | — | — | — | 83.6 | — | — |
| LNU450 | 63708.3 | — | — | — | 109.0 | 0.14 | 22 |
| LNU450 | 63710.2 | — | — | — | 99.8 | 0.24 | 11 |
| LNU426 | 66148.1 | 7.0 | 0.22 | 24 | — | — | — |
| LNU416 | 64134.11 | — | — | — | 113.9 | 0.05 | 27 |
| LNU416 | 64134.2 | — | — | — | 108.3 | 0.28 | 21 |
| LNU416 | 64136.4 | 7.0 | 0.04 | 24 | 111.6 | 0.10 | 25 |
| LNU412 | 63940.8 | 7.6 | 0.27 | 35 | 125.8 | 0.07 | 40 |
| LNU349 | 63990.2 | 6.9 | 0.07 | 21 | — | — | — |
| LNU349 | 63990.4 | 8.0 | 0.01 | 42 | 129.0 | L | 44 |
| LNU293 | 65048.1 | — | — | — | 116.2 | 0.17 | 30 |
| LNU293 | 65051.3 | 6.4 | 0.15 | 13 | 120.6 | 0.01 | 35 |
| CONT. | — | 5.6 | — | — | 89.6 | — | — |
| LNU498 | 64185.3 | 5.0 | L | 64 | 102.5 | L | 46 |
| LNU493 | 64190.1 | 4.1 | 0.04 | 35 | 83.0 | 0.24 | 18 |
| LNU493 | 64191.4 | 4.9 | 0.09 | 61 | — | — | — |
| LNU455 | 64187.5 | 4.6 | 0.09 | 52 | 111.3 | L | 59 |
| LNU455 | 64189.2 | 4.0 | 0.14 | 30 | — | — | — |
| LNU455 | 64189.4 | 5.2 | 0.04 | 69 | 112.1 | 0.10 | 60 |
| LNU343 | 64208.1 | 4.5 | 0.02 | 46 | 126.1 | 0.01 | 80 |
| LNU343 | 64209.1 | 4.0 | 0.18 | 29 | 107.1 | 0.16 | 53 |
| LNU328 | 64150.1 | 4.2 | 0.06 | 37 | — | — | — |
| LNU328 | 64150.2 | 4.0 | 0.27 | 32 | 89.2 | 0.13 | 27 |
| LNU328 | 64150.4 | 3.7 | 0.20 | 20 | 87.4 | 0.13 | 25 |
| LNU328 | 64151.1 | — | — | — | 88.2 | 0.21 | 26 |
| LNU328 | 64151.2 | — | — | — | 85.9 | 0.04 | 22 |
| LNU322 | 63917.2 | 4.4 | 0.20 | 44 | 106.5 | 0.25 | 52 |
| LNU322 | 63918.1 | 4.1 | 0.28 | 34 | 99.4 | 0.12 | 42 |
| LNU322 | 63918.3 | 4.3 | 0.03 | 42 | 93.2 | 0.04 | 33 |
| LNU317 | 64097.3 | 3.6 | 0.22 | 19 | 83.6 | 0.21 | 19 |
| LNU305 | 64111.1 | — | — | — | 77.8 | 0.30 | 11 |
| LNU305 | 64111.3 | 4.7 | 0.01 | 53 | 111.1 | 0.15 | 58 |
| LNU305 | 64115.1 | 3.8 | 0.20 | 25 | 89.7 | 0.27 | 28 |
| CONT. | — | 3.1 | — | — | 70.1 | — | — |
| LNU495 | 64701.3 | 4.2 | 0.30 | 8 | — | — | — |
| LNU487 | 64702.1 | — | — | — | 78.4 | 0.12 | 25 |
| LNU487 | 64702.3 | 4.6 | 0.16 | 18 | 76.7 | 0.06 | 22 |
| LNU474 | 64381.1 | 6.0 | 0.10 | 53 | 102.8 | 0.07 | 64 |
| LNU474 | 64382.2 | 5.2 | L | 31 | 79.6 | 0.05 | 27 |
| LNU474 | 64383.2 | — | — | — | 74.2 | 0.22 | 18 |
| LNU465 | 64020.1 | 5.2 | 0.11 | 32 | 98.1 | 0.26 | 56 |
| LNU465 | 64022.2 | 4.6 | 0.05 | 18 | 81.0 | 0.05 | 29 |
| LNU446 | 64546.2 | 4.8 | 0.13 | 22 | 76.8 | 0.27 | 22 |
| LNU443 | 64024.3 | 7.1 | 0.02 | 82 | 144.5 | L | 130 |
| LNU443 | 64024.7 | 4.8 | 0.25 | 22 | — | — | — |
| LNU436 | 64240.1 | 6.2 | 0.16 | 59 | 91.7 | 0.04 | 46 |
| LNU436 | 64240.2 | 4.8 | 0.16 | 21 | 85.4 | 0.03 | 36 |
| LNU436 | 64242.2 | 12.3 | 0.03 | 213 | 181.2 | L | 189 |
| LNU436 | 64243.1 | — | — | — | 81.9 | 0.21 | 31 |
| LNU379 | 64170.4 | — | — | — | 81.2 | 0.21 | 29 |
| LNU315 | 64224.1 | 5.2 | 0.15 | 31 | 79.0 | 0.21 | 26 |
| LNU315 | 64224.3 | 5.2 | 0.17 | 33 | 91.2 | L | 45 |
| LNU315 | 64225.1 | — | — | — | 78.0 | 0.18 | 24 |
| LNU315 | 64226.3 | 5.5 | L | 40 | 105.2 | 0.04 | 68 |
| LNU315 | 64227.3 | 5.9 | L | 51 | 88.3 | 0.06 | 41 |
| CONT. | — | 3.9 | — | — | 62.7 | — | — |
| LNU497 | 64207.2 | 7.0 | 0.27 | 18 | — | — | — |
| LNU491 | 64406.4 | 8.1 | 0.27 | 37 | 165.8 | 0.30 | 38 |
| LNU449 | 64571.3 | 9.4 | 0.11 | 60 | — | — | — |
| LNU449 | 63890.1 | 6.9 | 0.10 | 17 | — | — | — |
| LNU432 | 64065.2 | 9.9 | 0.09 | 67 | 179.4 | 0.13 | 50 |
| LNU432 | 64559.2 | 8.8 | 0.19 | 50 | 185.1 | 0.20 | 55 |
| LNU432 | 64560.3 | — | — | — | 144.1 | 0.22 | 20 |
| LNU367 | 64398.2 | 9.1 | 0.16 | 55 | 196.8 | 0.14 | 64 |
| LNU367 | 64399.1 | 7.8 | 0.03 | 32 | 174.7 | L | 46 |
| CONT. | — | 5.9 | — | — | 119.8 | — | — |
| LNU436 | 64241.3 | 6.9 | 0.10 | 47 | — | — | — |
| LNU379 | 64170.3 | 5.4 | 0.19 | 13 | — | — | — |
| LNU379 | 64172.2 | 7.1 | 0.14 | 50 | 156.5 | 0.09 | 50 |
| LNU315 | 64225.2 | 7.1 | L | 49 | 138.9 | 0.02 | 33 |
| CONT. | — | 4.7 | — | — | 104.3 | — | — |
| LNU519 | 64678.1 | 4.1 | 0.04 | 28 | 74.2 | 0.04 | 23 |
| LNU519 | 64679.1 | 5.0 | 0.06 | 56 | 78.1 | L | 29 |
| LNU519 | 64681.3 | 3.8 | 0.24 | 19 | — | — | — |
| LNU519 | 64681.8 | 3.9 | 0.04 | 21 | 74.0 | L | 23 |
| LNU459 | 64542.3 | 4.2 | 0.12 | 29 | 75.4 | 0.17 | 25 |
| LNU459 | 64543.2 | 3.9 | 0.16 | 22 | 73.0 | 0.29 | 21 |
| LNU348 | 64472.2 | — | — | — | 76.2 | 0.10 | 26 |
| LNU348 | 64472.3 | — | — | — | 65.7 | 0.16 | 9 |
| LNU348 | 64474.1 | 4.0 | 0.09 | 24 | 74.1 | 0.04 | 23 |
| LNU348 | 64474.2 | 4.8 | 0.05 | 48 | 81.8 | 0.05 | 35 |
| LNU329 | 63427.3 | — | — | — | 72.9 | 0.10 | 21 |
| LNU329 | 63428.2 | 4.0 | 0.02 | 24 | 82.2 | 0.10 | 36 |
| LNU329 | 63429.1 | 4.2 | 0.23 | 32 | — | — | — |
| LNU329 | 63430.3 | 3.7 | 0.12 | 14 | 68.1 | 0.08 | 13 |
| CONT. | — | 3.2 | — | — | 60.4 | — | — |

TABLE 75-continued

Genes showing improved plant performance at standard nitrogen growth conditions (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LNU499 | 64146.12 | — | — | — | 105.9 | 0.30 | 20 |
| LNU312 | 64002.5 | 6.0 | 0.07 | 18 | — | — | — |
| LNU311 | 66100.3 | — | — | — | 100.9 | 0.23 | 14 |
| CONT. | — | 5.1 | — | — | 88.2 | — | — |
| LNU392 | 63697.4 | — | — | — | 152.5 | 0.13 | 24 |
| LNU392 | 63701.2 | 8.0 | 0.22 | 21 | 150.6 | 0.24 | 22 |
| CONT. | — | 6.6 | — | — | 123.3 | — | — |
| LNU497 | 64207.2 | 6.0 | 0.03 | 49 | 103.5 | 0.02 | 40 |
| LNU497 | 64207.3 | 5.2 | 0.16 | 29 | — | — | — |
| LNU491 | 64404.3 | 6.3 | 0.02 | 57 | 108.3 | 0.02 | 46 |
| LNU491 | 64404.6 | 5.0 | 0.17 | 24 | 89.8 | 0.15 | 21 |
| LNU449 | 63890.1 | — | — | — | 92.1 | 0.09 | 24 |
| LNU449 | 64570.1 | 6.6 | 0.01 | 64 | 109.3 | 0.02 | 47 |
| LNU432 | 64065.2 | 5.3 | 0.06 | 32 | 94.4 | 0.16 | 27 |
| LNU432 | 64066.2 | 6.1 | 0.05 | 53 | 115.4 | L | 56 |
| LNU432 | 64559.2 | 5.0 | 0.22 | 24 | 90.2 | 0.18 | 22 |
| LNU367 | 64398.2 | 5.6 | 0.01 | 41 | 93.0 | 0.09 | 25 |
| LNU367 | 64398.3 | — | — | — | 88.0 | 0.26 | 19 |
| LNU362 | 64323.1 | 5.2 | 0.21 | 31 | — | — | — |
| CONT. | — | 4.0 | — | — | 74.2 | — | — |
| LNU438 | 63994.12 | 8.8 | 0.18 | 36 | — | — | — |
| LNU438 | 63994.5 | 7.5 | 0.25 | 16 | — | — | — |
| LNU310 | 63904.3 | 10.4 | 0.10 | 62 | 178.4 | 0.29 | 33 |
| CONT. | — | 6.5 | — | — | 134.4 | — | — |
| LNU483 | 64803.2 | 5.7 | L | 42 | 115.9 | L | 35 |
| LNU483 | 64803.3 | 5.2 | 0.05 | 30 | 105.3 | 0.05 | 22 |
| LNU483 | 64805.1 | — | — | — | 102.7 | 0.24 | 19 |
| LNU483 | 64805.2 | 5.1 | 0.23 | 27 | 109.1 | 0.04 | 27 |
| LNU483 | 64806.2 | 5.6 | 0.02 | 40 | 110.1 | 0.10 | 28 |
| LNU435 | 64463.3 | 7.6 | 0.05 | 89 | 150.3 | 0.03 | 75 |
| LNU378 | 64494.2 | — | — | — | 112.0 | 0.08 | 30 |
| LNU346 | 65008.2 | 4.9 | 0.19 | 20 | — | — | — |
| CONT. | — | 4.0 | — | — | 86.1 | — | — |
| LNU489 | 64010.8 | — | — | — | 90.2 | 0.25 | 28 |
| LNU438 | 63994.5 | 6.4 | 0.13 | 68 | 106.3 | 0.07 | 51 |
| LNU310 | 63904.1 | 6.0 | 0.14 | 59 | 93.5 | 0.23 | 33 |
| LNU295 | 63899.8 | 6.0 | 0.11 | 59 | 110.0 | 0.12 | 56 |
| LNU295 | 63902.3 | 6.6 | 0.10 | 75 | 125.0 | 0.12 | 78 |
| CONT. | — | 3.8 | — | — | 70.3 | — | — |
| LNU490 | 66093.2 | 4.2 | 0.28 | 18 | — | — | — |
| LNU443 | 64023.2 | 4.3 | 0.29 | 23 | — | — | — |
| LNU443 | 64024.4 | 4.3 | 0.25 | 22 | — | — | — |
| LNU443 | 64024.7 | 5.6 | 0.01 | 60 | 97.7 | 0.03 | 35 |
| LNU439 | 64614.4 | 5.6 | 0.15 | 61 | 109.5 | 0.21 | 51 |
| LNU439 | 64618.3 | 6.0 | 0.27 | 70 | 109.1 | 0.21 | 51 |
| LNU436 | 64240.2 | 4.5 | 0.26 | 27 | 90.6 | 0.10 | 25 |
| LNU436 | 64242.2 | 5.4 | 0.01 | 53 | 101.0 | 0.03 | 39 |
| LNU433 | 64815.2 | 7.8 | L | 123 | 132.9 | L | 83 |
| LNU433 | 64816.1 | 5.0 | 0.18 | 42 | — | — | — |
| LNU293 | 65051.3 | 4.2 | 0.28 | 20 | — | — | — |
| CONT. | — | 3.5 | — | — | 72.5 | — | — |

Table 75:
"CONT."—Control;
"Ave."—Average;
"% Incr." = % increment;
"p-val."—p-value;
L means that p-value is less than 0.01, p < 0.1 was considered as significant.

TABLE 76

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm²] Ave. | P-Val. | % Incr. |
|---|---|---|---|---|---|---|---|---|---|---|
| LNU437_H2 | 66104.1 | — | — | — | 5.1 | 0.21 | 27 | 6.8 | 0.02 | 17 |
| LNU437_H2 | 66104.2 | 0.4 | 0.01 | 35 | 5.1 | 0.04 | 28 | — | — | — |
| LNU437_H2 | 66104.3 | 0.5 | L | 53 | 6.7 | 0.04 | 67 | 6.8 | 0.04 | 18 |
| LNU437_H2 | 66105.1 | 0.4 | 0.20 | 14 | — | — | — | — | — | — |
| LNU437_H2 | 66105.3 | 0.4 | 0.17 | 15 | — | — | — | — | — | — |
| LNU426 | 66147.1 | — | — | — | — | — | — | 6.4 | 0.04 | 11 |
| LNU426 | 66147.3 | 0.6 | L | 74 | 5.8 | L | 46 | 6.3 | 0.17 | 10 |
| LNU420 | 64006.3 | — | — | — | — | — | — | 6.3 | 0.11 | 9 |
| LNU420 | 64007.3 | — | — | — | 4.9 | 0.19 | 22 | 6.3 | 0.04 | 10 |
| LNU420 | 64008.4 | 0.4 | 0.07 | 24 | 5.1 | 0.02 | 28 | 6.3 | 0.19 | 9 |
| LNU420 | 64009.1 | — | — | — | — | — | — | 6.1 | 0.21 | 7 |
| LNU359 | 66154.6 | 0.4 | 0.26 | 14 | — | — | — | — | — | — |
| LNU352 | 64199.1 | 0.6 | L | 83 | 7.1 | L | 78 | 7.0 | L | 22 |
| LNU352 | 64200.1 | 0.4 | 0.14 | 24 | — | — | — | — | — | — |
| LNU352 | 64200.10 | 0.4 | 0.14 | 20 | 6.0 | 0.08 | 49 | 6.6 | 0.06 | 14 |
| LNU352 | 64200.4 | — | — | — | 4.7 | 0.15 | 19 | 6.3 | 0.15 | 9 |
| LNU292 | 64084.1 | — | — | — | — | — | — | 6.1 | 0.25 | 5 |
| LNU292 | 64085.4 | 0.4 | 0.25 | 12 | 4.7 | 0.10 | 17 | 6.6 | 0.02 | 14 |
| CONT. | — | 0.3 | — | — | 4.0 | — | — | 5.8 | — | — |
| LNU483 | 64803.2 | 0.7 | 0.05 | 15 | 10.7 | 0.01 | 54 | 7.3 | 0.02 | 11 |
| LNU483 | 64803.3 | 0.7 | 0.10 | 18 | 11.0 | L | 57 | — | — | — |
| LNU483 | 64805.1 | — | — | — | 13.7 | L | 97 | 7.5 | L | 15 |
| LNU483 | 64805.2 | 0.7 | 0.06 | 21 | 10.7 | L | 53 | — | — | — |
| LNU483 | 64806.2 | — | — | — | 8.6 | 0.29 | 23 | — | — | — |
| LNU477 | 63886.1 | 0.7 | 0.04 | 20 | — | — | — | — | — | — |
| LNU477 | 63888.1 | 0.7 | 0.14 | 17 | — | — | — | 7.1 | 0.02 | 9 |
| LNU477 | 63889.2 | — | — | — | — | — | — | 6.9 | 0.17 | 6 |
| LNU477 | 63889.5 | — | — | — | — | — | — | 6.8 | 0.12 | 5 |

TABLE 76-continued

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm²] Ave. | P-Val. | % Incr. |
|---|---|---|---|---|---|---|---|---|---|---|
| LNU464 | 65076.1 | — | — | — | — | — | — | 6.9 | L | 6 |
| LNU464 | 65076.4 | 0.7 | 0.15 | 17 | — | — | — | 6.7 | 0.30 | 2 |
| LNU447 | 65000.1 | 0.7 | 0.08 | 20 | 9.2 | 0.07 | 32 | 7.1 | 0.04 | 10 |
| LNU447 | 65000.4 | 0.6 | 0.26 | 12 | — | — | — | 7.0 | 0.08 | 8 |
| LNU447 | 65002.3 | 0.7 | 0.12 | 18 | 8.1 | 0.11 | 16 | 6.8 | 0.29 | 4 |
| LNU439 | 64614.4 | — | — | — | — | — | — | 6.9 | 0.29 | 6 |
| LNU439 | 64616.2 | 0.7 | L | 29 | — | — | — | 6.9 | 0.04 | 6 |
| LNU439 | 64616.3 | 0.8 | L | 40 | 9.2 | 0.04 | 31 | 7.5 | 0.02 | 14 |
| LNU439 | 64618.3 | 0.7 | 0.16 | 24 | 8.6 | 0.04 | 23 | 7.0 | 0.25 | 8 |
| LNU425 | 63910.9 | — | — | — | 8.2 | 0.18 | 17 | — | — | — |
| LNU425 | 63911.11 | 0.7 | 0.14 | 13 | 12.6 | L | 80 | 7.3 | L | 11 |
| LNU425 | 63911.12 | 0.6 | 0.24 | 8 | — | — | — | 6.8 | 0.17 | 4 |
| LNU425 | 63911.7 | — | — | — | — | — | — | 6.7 | 0.22 | 3 |
| LNU425 | 63911.9 | 0.7 | 0.11 | 19 | 8.5 | 0.24 | 21 | 7.0 | 0.13 | 7 |
| LNU414 | 64475.1 | 0.8 | 0.11 | 30 | — | — | — | 6.9 | 0.01 | 6 |
| LNU414 | 64480.2 | 0.7 | 0.25 | 18 | 8.8 | 0.25 | 26 | 7.0 | L | 8 |
| LNU346 | 65006.1 | — | — | — | — | — | — | 6.9 | 0.03 | 6 |
| LNU346 | 65007.3 | — | — | — | — | — | — | 6.8 | 0.04 | 4 |
| LNU346 | 65008.2 | — | — | — | 7.9 | 0.17 | 13 | 7.1 | 0.14 | 8 |
| LNU346 | 65008.3 | — | — | — | — | — | — | 6.8 | 0.05 | 5 |
| LNU346 | 65009.2 | — | — | — | — | — | — | 7.0 | L | 7 |
| LNU336 | 64447.2 | 0.8 | 0.05 | 31 | 9.1 | 0.12 | 30 | 7.0 | 0.06 | 8 |
| LNU336 | 64448.2 | — | — | — | 9.0 | 0.28 | 29 | 7.2 | L | 10 |
| LNU336 | 64448.3 | 0.7 | 0.12 | 19 | — | — | — | — | — | — |
| LNU336 | 64449.4 | 0.7 | 0.10 | 14 | — | — | — | 6.8 | 0.28 | 5 |
| CONT. | — | 0.6 | — | — | 7.0 | — | — | 6.5 | — | — |
| LNU470 | 64228.3 | 0.7 | 0.10 | 15 | 10.6 | L | 39 | 7.5 | 0.03 | 12 |
| LNU470 | 64229.1 | — | — | — | 9.0 | 0.09 | 19 | 7.7 | 0.08 | 14 |
| LNU460 | 64359.3 | 0.8 | 0.04 | 39 | 11.6 | 0.01 | 53 | 7.7 | L | 14 |
| LNU460 | 64362.1 | 0.6 | 0.29 | 6 | — | — | — | 7.1 | 0.03 | 5 |
| LNU421 | 64302.7 | — | — | — | 9.2 | 0.23 | 21 | 7.6 | 0.02 | 13 |
| LNU408 | 64248.10 | 0.6 | 0.30 | 8 | 10.2 | 0.05 | 34 | 7.7 | L | 15 |
| LNU408 | 64248.12 | — | — | — | — | — | — | 7.3 | 0.21 | 9 |
| LNU408 | 64248.16 | — | — | — | — | — | — | 7.2 | 0.16 | 8 |
| LNU408 | 64250.8 | 0.7 | 0.08 | 13 | 10.8 | 0.08 | 42 | 7.7 | 0.05 | 15 |
| LNU380 | 65764.2 | — | — | — | — | — | — | 7.1 | 0.19 | 5 |
| LNU380 | 65765.4 | — | — | — | 9.1 | 0.11 | 20 | 7.3 | 0.30 | 9 |
| LNU340 | 64290.11 | — | — | — | — | — | — | 7.7 | L | 14 |
| LNU340 | 64290.7 | — | — | — | 9.8 | 0.10 | 29 | 7.9 | L | 17 |
| LNU340 | 64291.10 | — | — | — | — | — | — | 7.8 | L | 16 |
| LNU340 | 64292.5 | — | — | — | — | — | — | 6.9 | 0.17 | 3 |
| LNU331 | 64214.2 | — | — | — | — | — | — | 7.2 | 0.14 | 7 |
| LNU331 | 64215.1 | — | — | — | — | — | — | 7.4 | 0.08 | 10 |
| LNU331 | 64215.3 | — | — | — | — | — | — | 7.4 | 0.04 | 10 |
| LNU306 | 64131.2 | — | — | — | 9.8 | 0.12 | 29 | 7.4 | 0.13 | 10 |
| CONT. | — | 0.6 | — | — | 7.6 | — | — | 6.7 | — | — |
| LNU456 | 63991.2 | — | — | — | 6.4 | 0.13 | 16 | 6.8 | 0.24 | 7 |
| LNU456 | 63991.8 | — | — | — | 6.3 | 0.17 | 14 | 6.8 | 0.12 | 7 |
| LNU412 | 63940.1 | — | — | — | — | — | — | 6.9 | 0.01 | 8 |
| LNU412 | 63941.2 | — | — | — | — | — | — | 7.0 | 0.03 | 10 |
| LNU407 | 64218.2 | — | — | — | — | — | — | 7.2 | L | 13 |
| LNU407 | 64219.1 | — | — | — | 6.4 | 0.22 | 16 | 7.2 | L | 13 |
| LNU407 | 64219.2 | 0.5 | 0.08 | 14 | — | — | — | — | — | — |
| LNU402 | 63914.2 | — | — | — | — | — | — | 6.7 | 0.19 | 5 |
| LNU384 | 64161.3 | — | — | — | 7.3 | 0.16 | 32 | 7.2 | 0.07 | 12 |
| LNU384 | 64161.7 | — | — | — | 6.9 | 0.12 | 24 | 7.0 | 0.16 | 9 |
| LNU360 | 64029.2 | — | — | — | 6.7 | L | 22 | 6.7 | 0.21 | 5 |
| LNU360 | 64029.3 | — | — | — | 6.8 | 0.07 | 22 | 7.0 | 0.12 | 10 |
| LNU360 | 64030.4 | — | — | — | 7.3 | 0.06 | 33 | 7.4 | 0.05 | 16 |
| LNU360 | 64030.6 | — | — | — | 6.3 | 0.29 | 14 | 7.0 | 0.01 | 10 |
| LNU335 | 64168.15 | — | — | — | — | — | — | 6.7 | 0.27 | 4 |
| LNU301 | 63950.3 | — | — | — | 6.7 | 0.24 | 21 | 7.3 | L | 14 |
| CONT. | — | 0.5 | — | — | 5.5 | — | — | 6.4 | — | — |
| LNU450 | 63708.3 | 0.7 | 0.19 | 16 | 7.7 | 0.25 | 15 | — | — | — |
| LNU450 | 63710.2 | 0.7 | 0.12 | 17 | — | — | — | — | — | — |
| LNU450 | 63712.3 | 0.6 | 0.12 | 10 | 7.9 | 0.03 | 18 | — | — | — |
| LNU429 | 63938.2 | — | — | — | 8.1 | L | 22 | 7.4 | L | 12 |
| LNU426 | 66150.2 | — | — | — | 7.2 | 0.29 | 8 | 7.2 | 0.04 | 9 |
| LNU416 | 64134.11 | 0.7 | 0.05 | 17 | 8.4 | 0.08 | 27 | 7.1 | 0.08 | 7 |
| LNU416 | 64134.2 | — | — | — | 9.2 | L | 39 | 7.1 | 0.07 | 8 |
| LNU412 | 63940.12 | — | — | — | 7.6 | 0.28 | 14 | — | — | — |

TABLE 76-continued

Genes showing improved plant performance at standard nitrogen growth conditions (T2 generation)

| Gene Name | Event # | Leaf Area [cm²] Ave. | Leaf Area [cm²] P-Val. | Leaf Area [cm²] % Incr. | Roots Coverage [cm²] Ave. | Roots Coverage [cm²] P-Val. | Roots Coverage [cm²] % Incr. | Roots Length [cm²] Ave. | Roots Length [cm²] P-Val. | Roots Length [cm²] % Incr. |
|---|---|---|---|---|---|---|---|---|---|---|
| LNU412 | 63940.8 | 0.7 | 0.22 | 22 | 9.0 | 0.05 | 35 | 7.1 | 0.10 | 7 |
| LNU412 | 63941.2 | — | — | — | 7.8 | 0.09 | 17 | 7.1 | 0.08 | 8 |
| LNU349 | 63990.2 | — | — | — | 7.5 | 0.17 | 13 | 7.1 | 0.24 | 8 |
| LNU349 | 63990.4 | 0.6 | 0.24 | 11 | 8.6 | L | 29 | 7.4 | 0.01 | 11 |
| LNU293 | 65048.1 | 0.7 | 0.26 | 21 | 8.3 | 0.11 | 24 | 7.0 | 0.14 | 6 |
| LNU293 | 65051.3 | 0.7 | L | 24 | 9.2 | L | 39 | 7.4 | L | 12 |
| CONT. | — | 0.6 | — | — | 6.7 | — | — | 6.6 | — | — |
| LNU498 | 64184.3 | — | — | — | 6.6 | 0.23 | 19 | 7.5 | 0.22 | 8 |
| LNU498 | 64185.3 | 0.5 | 0.02 | 30 | — | — | — | — | — | — |
| LNU498 | 64186.2 | — | — | — | 7.7 | L | 39 | 7.6 | 0.06 | 10 |
| LNU498 | 64186.3 | — | — | — | — | — | — | 7.5 | 0.20 | 9 |
| LNU493 | 64191.4 | — | — | — | 7.2 | 0.29 | 31 | 7.7 | 0.30 | 11 |
| LNU455 | 64187.4 | — | — | — | 6.3 | 0.15 | 15 | 7.7 | L | 11 |
| LNU455 | 64187.5 | 0.5 | L | 42 | 7.7 | 0.07 | 39 | 7.8 | 0.01 | 13 |
| LNU455 | 64189.4 | 0.5 | 0.14 | 21 | 8.7 | 0.02 | 57 | 7.6 | 0.01 | 10 |
| LNU455 | 64189.7 | — | — | — | 6.2 | 0.24 | 11 | 7.6 | 0.01 | 10 |
| LNU343 | 64208.1 | 0.4 | 0.19 | 15 | — | — | — | — | — | — |
| LNU343 | 64208.4 | — | — | — | — | — | — | 7.3 | 0.09 | 5 |
| LNU343 | 64209.1 | 0.4 | 0.19 | 15 | — | — | — | — | — | — |
| LNU328 | 64150.1 | 0.5 | 0.09 | 19 | 8.0 | L | 45 | 7.8 | 0.05 | 13 |
| LNU328 | 64150.4 | — | — | — | 7.2 | 0.13 | 30 | 7.8 | L | 13 |
| LNU328 | 64151.1 | 0.4 | 0.28 | 13 | 6.6 | 0.14 | 19 | 7.5 | 0.02 | 8 |
| LNU328 | 64151.2 | — | — | — | — | — | — | 7.1 | 0.30 | 3 |
| LNU322 | 63917.2 | — | — | — | 7.0 | 0.05 | 27 | 7.7 | L | 11 |
| LNU322 | 63918.1 | 0.5 | 0.06 | 23 | 6.4 | 0.14 | 16 | — | — | — |
| LNU322 | 63918.3 | 0.5 | 0.23 | 25 | — | — | — | — | — | — |
| LNU317 | 64097.2 | — | — | — | 7.2 | 0.08 | 30 | 7.6 | 0.17 | 10 |
| LNU305 | 64111.3 | 0.5 | 0.04 | 32 | 6.9 | 0.11 | 24 | 7.9 | 0.02 | 14 |
| LNU305 | 64115.1 | — | — | — | 6.3 | 0.17 | 14 | 7.6 | L | 9 |
| CONT. | — | 0.4 | — | — | 5.5 | — | — | 6.9 | — | — |
| LNU495 | 64697.3 | — | — | — | 5.6 | 0.17 | 16 | — | — | — |
| LNU495 | 64701.3 | — | — | — | 5.4 | 0.25 | 11 | — | — | — |
| LNU495 | 64701.4 | — | — | — | 7.1 | L | 47 | 6.8 | 0.16 | 8 |
| LNU487 | 64702.1 | 0.5 | L | 26 | 7.3 | L | 51 | 7.1 | 0.03 | 13 |
| LNU487 | 64702.3 | 0.5 | 0.10 | 14 | 6.7 | 0.06 | 38 | — | — | — |
| LNU474 | 64381.1 | — | — | — | 6.7 | 0.21 | 38 | — | — | — |
| LNU474 | 64382.2 | 0.5 | 0.12 | 11 | 5.9 | 0.16 | 22 | — | — | — |
| LNU474 | 64382.3 | — | — | — | — | — | — | 7.0 | 0.03 | 11 |
| LNU465 | 64020.1 | 0.5 | 0.24 | 25 | — | — | — | — | — | — |
| LNU465 | 64022.2 | — | — | — | 6.2 | 0.23 | 27 | 6.6 | 0.24 | 5 |
| LNU446 | 64546.2 | — | — | — | 7.0 | L | 45 | 7.1 | 0.02 | 12 |
| LNU446 | 64546.3 | — | — | — | — | — | — | 7.0 | 0.12 | 12 |
| LNU446 | 64549.2 | — | — | — | 6.2 | 0.04 | 29 | 6.7 | 0.21 | 7 |
| LNU443 | 64023.2 | — | — | — | 6.4 | L | 33 | 6.9 | 0.14 | 9 |
| LNU443 | 64024.4 | — | — | — | 6.3 | 0.09 | 31 | — | — | — |
| LNU443 | 64024.7 | 0.5 | 0.20 | 6 | — | — | — | — | — | — |
| LNU436 | 64240.1 | 0.6 | 0.10 | 36 | — | — | — | 6.6 | 0.24 | 6 |
| LNU436 | 64240.2 | 0.5 | 0.02 | 20 | — | — | — | — | — | — |
| LNU436 | 64241.3 | — | — | — | 6.0 | 0.18 | 25 | — | — | — |
| LNU379 | 64170.3 | — | — | — | 6.1 | 0.02 | 25 | 6.9 | 0.20 | 9 |
| LNU379 | 64170.4 | — | — | — | 6.3 | 0.05 | 30 | 7.1 | 0.06 | 12 |
| LNU315 | 64224.1 | — | — | — | 6.2 | 0.16 | 29 | — | — | — |
| LNU315 | 64224.3 | — | — | — | 5.8 | 0.05 | 19 | — | — | — |
| LNU315 | 64225.1 | — | — | — | 7.6 | L | 58 | 7.4 | 0.02 | 17 |
| LNU315 | 64226.3 | 0.6 | L | 33 | 10.0 | L | 107 | 7.7 | L | 23 |
| LNU315 | 64227.3 | 0.5 | 0.10 | 10 | 5.6 | 0.14 | 17 | — | — | — |
| CONT. | — | 0.4 | — | — | 4.8 | — | — | 6.3 | — | — |
| LNU497 | 64206.2 | — | — | — | 6.1 | 0.08 | 15 | 6.7 | 0.25 | 7 |
| LNU491 | 64406.4 | — | — | — | 6.4 | 0.27 | 21 | — | — | — |
| LNU449 | 64570.1 | — | — | — | — | — | — | 6.9 | 0.10 | 11 |
| LNU449 | 64571.3 | 0.7 | 0.16 | 28 | 7.8 | 0.10 | 46 | 6.8 | 0.12 | 9 |
| LNU432 | 64065.2 | 0.7 | 0.17 | 42 | 10.1 | 0.20 | 90 | 7.4 | 0.17 | 19 |
| LNU432 | 64066.2 | 0.6 | 0.26 | 15 | — | — | — | — | — | — |
| LNU432 | 64559.2 | 0.7 | 0.14 | 35 | 8.1 | 0.15 | 52 | 6.9 | 0.14 | 11 |
| LNU432 | 64560.5 | — | — | — | 6.5 | 0.20 | 23 | — | — | — |
| LNU378 | 64495.4 | — | — | — | 6.3 | 0.06 | 19 | 7.1 | L | 14 |
| LNU367 | 64398.2 | 0.7 | 0.13 | 34 | 7.4 | 0.18 | 40 | — | — | — |
| LNU367 | 64398.3 | — | — | — | — | — | — | 6.6 | 0.23 | 6 |
| LNU367 | 64399.1 | 0.6 | 0.22 | 14 | — | — | — | — | — | — |
| LNU367 | 64399.2 | 0.7 | 0.07 | 39 | — | — | — | — | — | — |
| LNU364 | 64441.3 | — | — | — | — | — | — | 6.6 | 0.21 | 6 |

TABLE 76-continued

Genes showing improved plant performance at standard nitrogen growth conditions (T2 generation)

| Gene Name | Event # | Leaf Area [cm²] Ave. | P-Val. | % Incr. | Roots Coverage [cm²] Ave. | P-Val. | % Incr. | Roots Length [cm²] Ave. | P-Val. | % Incr. |
|---|---|---|---|---|---|---|---|---|---|---|
| LNU362 | 64324.2 | — | — | — | 6.3 | 0.16 | 19 | — | — | — |
| CONT. | — | 0.5 | — | — | 5.3 | — | — | 6.2 | — | — |
| LNU495 | 64697.3 | — | — | — | — | — | — | 6.5 | 0.06 | 5 |
| LNU487 | 64704.2 | — | — | — | 6.6 | 0.18 | 20 | 6.8 | 0.04 | 11 |
| LNU474 | 64379.1 | — | — | — | — | — | — | 6.6 | 0.11 | 7 |
| LNU474 | 64382.3 | — | — | — | — | — | — | 6.5 | 0.16 | 6 |
| LNU474 | 64383.2 | — | — | — | 6.8 | 0.16 | 23 | 6.7 | 0.12 | 8 |
| LNU446 | 64546.2 | — | — | — | — | — | — | 6.5 | 0.02 | 5 |
| LNU446 | 64546.3 | 0.6 | 0.21 | 13 | 7.2 | 0.06 | 30 | 7.1 | 0.02 | 14 |
| LNU446 | 64548.2 | — | — | — | — | — | — | 6.5 | 0.19 | 5 |
| LNU443 | 64023.2 | 0.6 | 0.11 | 22 | — | — | — | 6.8 | 0.05 | 11 |
| LNU436 | 64240.2 | — | — | — | — | — | — | 6.7 | 0.09 | 8 |
| LNU436 | 64241.3 | 0.7 | 0.02 | 32 | 7.6 | 0.23 | 37 | 6.8 | 0.26 | 9 |
| LNU379 | 64170.2 | — | — | — | — | — | — | 6.9 | 0.04 | 12 |
| LNU379 | 64170.3 | 0.6 | 0.05 | 20 | 7.3 | 0.03 | 33 | 6.8 | 0.06 | 10 |
| LNU379 | 64172.2 | 0.7 | L | 44 | 7.8 | 0.02 | 41 | 6.7 | 0.02 | 7 |
| LNU315 | 64225.2 | 0.7 | L | 39 | 7.4 | 0.02 | 34 | — | — | — |
| LNU315 | 64226.3 | 0.6 | 0.02 | 22 | — | — | — | — | — | — |
| LNU315 | 64227.3 | 0.6 | 0.09 | 20 | — | — | — | 6.9 | L | 12 |
| CONT. | — | 0.5 | — | — | 5.5 | — | — | 6.2 | — | — |
| LNU520 | 64155.1 | — | — | — | — | — | — | 6.8 | 0.06 | 8 |
| LNU520 | 64156.13 | — | — | — | — | — | — | 6.7 | 0.12 | 7 |
| LNU520 | 64156.7 | — | — | — | 6.5 | 0.19 | 9 | — | — | — |
| LNU518 | 64014.3 | — | — | — | — | — | — | 6.7 | 0.24 | 6 |
| LNU518 | 64015.4 | — | — | — | — | — | — | 7.0 | 0.03 | 12 |
| LNU502 | 64040.4 | — | — | — | 6.8 | 0.29 | 13 | 6.9 | 0.05 | 10 |
| LNU405 | 64159.6 | — | — | — | — | — | — | 6.7 | 0.29 | 6 |
| LNU405 | 64159.8 | — | — | — | — | — | — | 6.9 | 0.14 | 11 |
| LNU405 | 64159.9 | — | — | — | — | — | — | 7.0 | 0.05 | 11 |
| LNU403 | 64236.3 | — | — | — | 6.5 | 0.21 | 9 | 6.6 | 0.24 | 5 |
| LNU403 | 64236.4 | — | — | — | — | — | — | 6.7 | 0.22 | 7 |
| LNU393 | 63977.5 | — | — | — | — | — | — | 6.9 | 0.05 | 10 |
| LNU393 | 63977.6 | — | — | — | — | — | — | 6.9 | 0.06 | 11 |
| LNU385 | 64245.3 | — | — | — | — | — | — | 7.1 | 0.06 | 13 |
| LNU385 | 64246.3 | — | — | — | — | — | — | 6.9 | 0.13 | 9 |
| LNU385 | 64247.1 | — | — | — | — | — | — | 6.9 | 0.03 | 11 |
| LNU385 | 64247.2 | — | — | — | — | — | — | 6.9 | 0.02 | 10 |
| LNU374 | 63997.1 | — | — | — | — | — | — | 6.9 | 0.03 | 10 |
| CONT. | — | — | — | — | 6.0 | — | — | 6.3 | — | — |
| LNU519 | 64678.1 | 0.5 | 0.01 | 24 | — | — | — | — | — | — |
| LNU519 | 64679.1 | 0.5 | 0.06 | 11 | 6.7 | 0.02 | 22 | — | — | — |
| LNU519 | 64681.3 | — | — | — | 7.1 | 0.12 | 30 | — | — | — |
| LNU519 | 64681.8 | 0.5 | 0.17 | 7 | 6.8 | 0.05 | 25 | — | — | — |
| LNU500 | 64221.2 | — | — | — | 7.0 | 0.06 | 27 | 7.1 | 0.03 | 8 |
| LNU500 | 64223.1 | — | — | — | 6.9 | 0.12 | 26 | 7.0 | 0.04 | 7 |
| LNU500 | 64223.2 | — | — | — | 6.5 | 0.19 | 18 | 7.0 | 0.28 | 7 |
| LNU459 | 64542.3 | 0.5 | L | 19 | 7.3 | L | 34 | 7.0 | 0.02 | 7 |
| LNU459 | 64543.2 | — | — | — | 6.0 | 0.27 | 11 | — | — | — |
| LNU348 | 64472.3 | — | — | — | 6.0 | 0.25 | 10 | — | — | — |
| LNU348 | 64474.1 | 0.5 | 0.09 | 17 | — | — | — | — | — | — |
| LNU348 | 64474.2 | 0.5 | 0.06 | 18 | 8.0 | L | 46 | 6.9 | 0.11 | 5 |
| LNU329 | 63428.1 | — | — | — | — | — | — | 6.9 | 0.23 | 5 |
| LNU329 | 63428.2 | 0.5 | 0.29 | 14 | — | — | — | — | — | — |
| LNU329 | 63429.1 | — | — | — | 6.6 | 0.05 | 21 | — | — | — |
| LNU329 | 63430.3 | 0.5 | 0.29 | 5 | — | — | — | — | — | — |
| CONT. | — | 0.4 | — | — | 5.5 | — | — | 6.6 | — | — |
| LNU490 | 66096.1 | — | — | — | — | — | — | 5.7 | 0.10 | 12 |
| LNU437_H2 | 66104.2 | 0.6 | 0.21 | 22 | 5.4 | 0.27 | 34 | — | — | — |
| LNU416 | 64134.11 | — | — | — | — | — | — | 5.5 | 0.29 | 9 |
| LNU416 | 64134.2 | — | — | — | — | — | — | 5.8 | 0.10 | 15 |
| LNU395 | 64142.5 | 0.6 | 0.07 | 18 | 4.8 | 0.11 | 19 | 5.4 | 0.28 | 7 |
| LNU395 | 64143.6 | — | — | — | — | — | — | 5.7 | 0.14 | 13 |
| LNU312 | 64000.1 | — | — | — | 5.1 | 0.23 | 25 | 5.6 | 0.05 | 11 |
| LNU312 | 64002.3 | 0.6 | 0.09 | 34 | — | — | — | — | — | — |
| LNU312 | 64002.5 | 0.5 | 0.23 | 12 | 5.0 | 0.17 | 23 | — | — | — |
| LNU298 | 66086.4 | — | — | — | 5.0 | 0.11 | 24 | 5.9 | 0.01 | 16 |
| CONT. | — | 0.5 | — | — | 4.0 | — | — | 5.1 | — | — |
| LNU468 | 63491.1 | — | — | — | — | — | — | 6.7 | 0.20 | 9 |
| LNU468 | 63492.2 | — | — | — | — | — | — | 6.9 | L | 14 |
| LNU468 | 63493.4 | — | — | — | — | — | — | 6.9 | 0.03 | 13 |
| LNU467 | 63715.1 | — | — | — | — | — | — | 6.3 | 0.30 | 4 |

TABLE 76-continued

Genes showing improved plant performance at standard nitrogen growth conditions (T2 generation)

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU467 | 63716.1 | — | — | — | 7.6 | 0.07 | 17 | — | — | — |
| LNU462 | 63504.1 | — | — | — | — | — | — | 6.6 | 0.26 | 8 |
| LNU450 | 63708.3 | — | — | — | 10.9 | 0.02 | 68 | 7.1 | L | 16 |
| LNU450 | 63708.6 | — | — | — | — | — | — | 6.4 | 0.28 | 6 |
| LNU450 | 63710.2 | — | — | — | — | — | — | 6.8 | 0.01 | 12 |
| LNU450 | 63712.3 | — | — | — | — | — | — | 6.4 | 0.22 | 5 |
| LNU448 | 63705.2 | — | — | — | — | — | — | 7.1 | 0.04 | 16 |
| LNU448 | 63705.3 | — | — | — | 7.1 | 0.29 | 9 | 6.6 | 0.14 | 8 |
| LNU448 | 63707.2 | — | — | — | — | — | — | 6.9 | 0.06 | 13 |
| LNU392 | 63696.1 | — | — | — | — | — | — | 6.7 | 0.02 | 10 |
| LNU392 | 63701.2 | 0.7 | 0.13 | 12 | — | — | — | — | — | — |
| LNU390 | 63539.2 | — | — | — | — | — | — | 6.9 | L | 14 |
| LNU390 | 63539.3 | — | — | — | — | — | — | 6.6 | 0.09 | 9 |
| LNU390 | 63539.4 | — | — | — | 8.2 | 0.01 | 26 | 6.7 | 0.06 | 11 |
| LNU390 | 63540.9 | — | — | — | 7.3 | 0.16 | 12 | 6.8 | 0.03 | 12 |
| LNU347 | 63508.1 | — | — | — | — | — | — | 6.4 | 0.21 | 5 |
| LNU347 | 63510.2 | — | — | — | 7.6 | 0.20 | 17 | 6.7 | 0.04 | 9 |
| LNU347 | 63513.3 | — | — | — | — | — | — | 6.5 | 0.17 | 6 |
| LNU347 | 63513.4 | — | — | — | — | — | — | 6.7 | 0.12 | 10 |
| LNU323 | 63421.2 | — | — | — | — | — | — | 6.5 | 0.14 | 6 |
| LNU323 | 63424.4 | — | — | — | — | — | — | 6.9 | L | 13 |
| CONT. | — | 0.6 | — | — | 6.5 | — | — | 6.1 | — | — |
| LNU497 | 64206.2 | — | — | — | — | — | — | 7.1 | 0.01 | 10 |
| LNU497 | 64207.2 | 0.6 | 0.02 | 29 | — | — | — | — | — | — |
| LNU497 | 64207.3 | — | — | — | 6.8 | 0.08 | 37 | 6.7 | 0.11 | 4 |
| LNU491 | 64404.3 | 0.7 | L | 52 | 7.8 | 0.04 | 56 | 7.5 | 0.02 | 16 |
| LNU491 | 64404.6 | 0.6 | 0.02 | 28 | 6.4 | 0.25 | 28 | 7.0 | 0.23 | 8 |
| LNU491 | 64406.4 | — | — | — | 6.0 | 0.11 | 20 | 7.2 | 0.02 | 12 |
| LNU449 | 63890.1 | — | — | — | 6.3 | 0.16 | 25 | 7.0 | 0.19 | 9 |
| LNU432 | 64065.2 | 0.6 | 0.15 | 23 | — | — | — | — | — | — |
| LNU432 | 64066.2 | 0.7 | 0.02 | 52 | 6.5 | 0.18 | 31 | — | — | — |
| LNU432 | 64559.2 | — | — | — | 5.8 | 0.20 | 17 | 6.9 | 0.04 | 7 |
| LNU432 | 64560.5 | — | — | — | 5.9 | 0.20 | 19 | — | — | — |
| LNU367 | 64398.2 | 0.6 | 0.12 | 18 | — | — | — | — | — | — |
| CONT. | — | 0.5 | — | — | 5.0 | — | — | 6.4 | — | — |
| LNU510 | 64152.1 | — | — | — | 8.1 | 0.02 | 29 | 7.6 | L | 25 |
| LNU510 | 64153.5 | — | — | — | — | — | — | 7.0 | 0.11 | 15 |
| LNU489 | 64011.1 | — | — | — | — | — | — | 7.2 | 0.05 | 20 |
| LNU489 | 64012.1 | — | — | — | 7.5 | 0.06 | 19 | 7.7 | L | 27 |
| LNU489 | 64013.1 | — | — | — | 7.9 | 0.21 | 26 | 7.6 | 0.03 | 26 |
| LNU438 | 63994.12 | 0.7 | 0.23 | 16 | 8.4 | 0.25 | 33 | 7.2 | 0.15 | 19 |
| LNU438 | 63994.2 | — | — | — | 7.8 | 0.05 | 23 | 7.7 | L | 28 |
| LNU438 | 63994.3 | — | — | — | 7.4 | 0.29 | 18 | 7.4 | 0.02 | 22 |
| LNU438 | 63994.5 | — | — | — | 9.1 | 0.06 | 44 | 8.1 | 0.01 | 33 |
| LNU427 | 64178.6 | — | — | — | — | — | — | 7.1 | 0.13 | 16 |
| LNU427 | 64180.3 | — | — | — | — | — | — | 7.1 | 0.05 | 17 |
| LNU427 | 64180.4 | — | — | — | — | — | — | 6.6 | 0.24 | 9 |
| LNU383 | 63982.1 | — | — | — | 8.2 | 0.02 | 30 | 7.9 | L | 31 |
| LNU383 | 63982.7 | — | — | — | 8.1 | 0.13 | 29 | 7.9 | L | 30 |
| LNU354 | 63970.6 | — | — | — | 7.7 | 0.21 | 22 | 7.7 | L | 27 |
| LNU354 | 63972.5 | — | — | — | — | — | — | 6.6 | 0.26 | 10 |
| LNU354 | 63972.8 | — | — | — | — | — | — | 7.5 | L | 24 |
| LNU310 | 63904.1 | — | — | — | — | — | — | 7.1 | 0.04 | 17 |
| LNU310 | 63904.3 | — | — | — | 9.2 | 0.07 | 45 | 7.5 | 0.01 | 24 |
| LNU310 | 63905.3 | — | — | — | — | — | — | 6.7 | 0.28 | 10 |
| LNU299 | 64326.2 | — | — | — | 9.1 | 0.09 | 45 | 7.6 | 0.01 | 25 |
| LNU299 | 64327.2 | — | — | — | — | — | — | 6.8 | 0.13 | 12 |
| LNU299 | 64328.2 | — | — | — | — | — | — | 6.8 | 0.16 | 12 |
| LNU295 | 63899.5 | — | — | — | 9.3 | 0.06 | 47 | 7.5 | L | 24 |
| LNU295 | 63899.8 | — | — | — | — | — | — | 6.7 | 0.29 | 11 |
| LNU295 | 63901.3 | — | — | — | 7.6 | 0.11 | 20 | 7.2 | 0.03 | 19 |
| LNU295 | 63902.3 | — | — | — | — | — | — | 7.5 | 0.01 | 25 |
| CONT. | — | 0.6 | — | — | 6.3 | — | — | 6.1 | — | — |
| LNU483 | 64803.2 | 0.6 | 0.05 | 30 | 9.0 | 0.01 | 48 | — | — | — |
| LNU483 | 64803.3 | 0.7 | L | 41 | 9.0 | L | 50 | — | — | — |
| LNU483 | 64805.1 | 0.6 | 0.15 | 22 | 8.7 | 0.10 | 44 | — | — | — |
| LNU483 | 64805.2 | 0.7 | L | 34 | 9.2 | 0.01 | 53 | — | — | — |
| LNU483 | 64806.2 | — | — | — | 8.6 | L | 42 | — | — | — |
| LNU464 | 65076.4 | 0.6 | 0.19 | 19 | — | — | — | — | — | — |
| LNU435 | 64463.3 | 0.7 | 0.06 | 37 | 8.4 | 0.08 | 38 | — | — | — |
| LNU346 | 65007.3 | — | — | — | — | — | — | 7.3 | 0.04 | 7 |

TABLE 76-continued

Genes showing improved plant performance at standard nitrogen growth conditions (T2 generation)

| Gene Name | Event # | Leaf Area [cm²] | | | Roots Coverage [cm²] | | | Roots Length [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU346 | 65008.2 | 0.5 | 0.22 | 12 | — | — | — | — | — | — |
| CONT. | — | 0.5 | — | — | 6.0 | — | — | 6.8 | — | — |
| LNU510 | 64153.5 | — | — | — | 5.9 | 0.12 | 23 | 7.1 | L | 12 |
| LNU489 | 64010.8 | 0.5 | 0.26 | 14 | 6.3 | 0.09 | 33 | — | — | — |
| LNU489 | 64012.1 | — | — | — | 5.9 | 0.18 | 24 | 6.8 | 0.01 | 8 |
| LNU489 | 64013.1 | — | — | — | — | — | — | 6.8 | 0.07 | 7 |
| LNU438 | 63994.1 | — | — | — | 7.4 | 0.03 | 55 | 7.7 | L | 22 |
| LNU438 | 63994.12 | — | — | — | 6.6 | 0.06 | 38 | 7.3 | 0.01 | 15 |
| LNU438 | 63994.2 | — | — | — | 7.0 | 0.01 | 47 | 7.5 | 0.01 | 19 |
| LNU438 | 63994.5 | 0.5 | 0.17 | 28 | — | — | — | — | — | — |
| LNU427 | 64180.4 | — | — | — | 6.4 | 0.02 | 34 | 7.1 | 0.03 | 12 |
| LNU383 | 63982.1 | 0.5 | 0.16 | 18 | 5.6 | 0.22 | 17 | — | — | — |
| LNU354 | 63970.6 | — | — | — | 6.5 | 0.01 | 35 | 7.0 | 0.01 | 11 |
| LNU354 | 63971.5 | — | — | — | 6.4 | 0.09 | 33 | 7.3 | 0.12 | 15 |
| LNU354 | 63972.5 | — | — | — | 5.8 | 0.09 | 22 | 7.0 | 0.19 | 10 |
| LNU354 | 63972.8 | 0.5 | 0.19 | 17 | 8.1 | L | 69 | 7.7 | 0.01 | 22 |
| LNU310 | 63904.3 | — | — | — | 6.9 | L | 44 | 7.2 | 0.03 | 14 |
| LNU310 | 63905.1 | — | — | — | 6.3 | 0.25 | 31 | 7.0 | 0.19 | 11 |
| LNU310 | 63905.3 | — | — | — | — | — | — | 6.9 | 0.06 | 9 |
| LNU299 | 64327.2 | — | — | — | 6.7 | L | 40 | 7.2 | L | 14 |
| LNU299 | 64330.5 | — | — | — | 7.2 | 0.15 | 51 | — | — | — |
| LNU295 | 63899.5 | 0.5 | 0.09 | 23 | 7.0 | L | 46 | 7.3 | L | 15 |
| LNU295 | 63899.8 | 0.5 | 0.28 | 19 | 8.6 | 0.06 | 81 | 7.5 | 0.07 | 18 |
| LNU295 | 63901.3 | — | — | — | 5.7 | 0.27 | 19 | 7.1 | 0.13 | 12 |
| LNU295 | 63902.3 | 0.6 | 0.11 | 51 | 9.7 | 0.08 | 102 | 7.6 | 0.05 | 20 |
| CONT. | — | 0.4 | — | — | 4.8 | — | — | 6.3 | — | — |
| LNU490 | 66093.2 | 0.5 | 0.16 | 19 | 5.0 | 0.01 | 56 | 6.1 | 0.08 | 12 |
| LNU490 | 66096.1 | — | — | — | 4.8 | 0.03 | 50 | 6.6 | L | 22 |
| LNU443 | 64023.2 | — | — | — | 4.7 | L | 47 | 5.7 | 0.16 | 6 |
| LNU443 | 64024.3 | — | — | — | 3.8 | 0.27 | 18 | — | — | — |
| LNU443 | 64024.4 | 0.5 | 0.21 | 15 | 5.6 | 0.01 | 75 | 6.2 | 0.03 | 15 |
| LNU443 | 64024.7 | 0.6 | L | 59 | 5.4 | L | 70 | 6.3 | 0.03 | 16 |
| LNU439 | 64614.4 | 0.5 | 0.12 | 36 | 5.1 | 0.06 | 61 | — | — | — |
| LNU439 | 64616.2 | — | — | — | 3.6 | 0.25 | 14 | — | — | — |
| LNU439 | 64618.3 | 0.6 | 0.20 | 48 | 5.9 | 0.08 | 86 | 6.4 | L | 19 |
| LNU437_H2 | 66104.1 | — | — | — | 4.6 | 0.04 | 45 | 6.0 | 0.06 | 12 |
| LNU437_H2 | 66104.2 | — | — | — | 5.3 | 0.01 | 66 | 5.8 | 0.12 | 7 |
| LNU436 | 64240.1 | — | — | — | 4.6 | L | 46 | 5.8 | 0.16 | 8 |
| LNU436 | 64240.2 | 0.5 | 0.08 | 33 | 4.4 | 0.07 | 40 | 6.1 | 0.12 | 13 |
| LNU436 | 64241.3 | — | — | — | 3.6 | 0.25 | 14 | — | — | — |
| LNU436 | 64242.2 | 0.5 | 0.06 | 28 | 4.7 | 0.15 | 48 | 6.0 | 0.22 | 10 |
| LNU436 | 64243.1 | — | — | — | 4.6 | 0.09 | 44 | 5.9 | 0.17 | 9 |
| LNU433 | 64815.2 | 0.5 | 0.03 | 28 | 6.0 | 0.04 | 89 | — | — | — |
| LNU311 | 66099.1 | — | — | — | 5.5 | 0.09 | 73 | 6.2 | 0.12 | 15 |
| LNU311 | 66099.2 | — | — | — | 4.2 | 0.05 | 31 | 6.4 | L | 18 |
| LNU311 | 66100.3 | — | — | — | 3.7 | 0.29 | 15 | 5.8 | 0.21 | 7 |
| LNU298 | 66086.4 | — | — | — | 4.7 | L | 48 | 6.0 | 0.05 | 12 |
| LNU298 | 66088.3 | — | — | — | 5.0 | L | 56 | — | — | — |
| LNU298 | 66089.1 | — | — | — | 3.9 | 0.15 | 23 | — | — | — |
| LNU298 | 66089.3 | — | — | — | 4.5 | 0.07 | 40 | 5.9 | 0.22 | 9 |
| LNU293 | 65048.1 | — | — | — | 5.1 | 0.01 | 60 | 6.4 | 0.01 | 18 |
| LNU293 | 65049.1 | — | — | — | 4.0 | 0.07 | 27 | — | — | — |
| LNU293 | 65050.3 | — | — | — | 3.9 | 0.19 | 21 | — | — | — |
| LNU293 | 65051.3 | 0.5 | 0.08 | 21 | 4.7 | 0.04 | 47 | 6.1 | 0.11 | 13 |
| CONT. | — | 0.4 | — | — | 3.2 | — | — | 5.4 | — | — |

Table 76:
"CONT."—Control;
"Ave."—Average;
"% Incr." = % increment;
"p-val."—p-value;
L means that p-value is less than 0.01, p < 0.1 was considered as significant.

TABLE 77

Genes showing improved plant performance at standard nitrogen growth conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LNU488 | 45.8 | 0.11 | 26 | 100.7 | 0.06 | 32 |
| LNU359 | 60.2 | 0.04 | 66 | 109.6 | L | 44 |
| LNU358 | — | — | — | 98.4 | 0.11 | 29 |
| LNU341 | — | — | — | 90.3 | 0.04 | 18 |
| LNU309_H3 | — | — | — | 96.2 | 0.05 | 26 |
| CONT. | 36.3 | — | — | 76.3 | — | — |

Table 77:
"CONT."—Control;
"Ave."—Average;
"% Incr." = % increment;
"p-val."—p-value;
L means that p-value is less than 0.01, $p < 0.1$ was considered as significant.

TABLE 78

Genes showing improved plant performance at standard nitrogen growth conditions (T1 generation)

| Gene Name | Leaf Area [cm$^2$] | | | Roots Coverage [cm$^2$] | | | Roots Length [cm$^2$] | | |
|---|---|---|---|---|---|---|---|---|---|
| | Ave. | P-Val. | % Incr. | Ave. | P-Val. | % Incr. | Ave. | P-Val. | % Incr. |
| LNU490 | — | — | — | 2.3 | 0.12 | 35 | 3.7 | 0.03 | 29 |
| LNU417_H4 | — | — | — | 2.1 | 0.28 | 24 | 3.6 | 0.10 | 27 |
| LNU394 | — | — | — | 2.2 | 0.19 | 30 | 3.6 | 0.07 | 26 |
| CONT. | — | — | — | 1.7 | — | — | 2.8 | — | — |
| LNU488 | 0.6 | 0.01 | 34 | 5.4 | L | 96 | 6.1 | L | 46 |
| LNU466 | — | — | — | 3.8 | 0.04 | 36 | 5.1 | 0.04 | 21 |
| LNU453 | 0.5 | 0.08 | 16 | 3.4 | 0.09 | 24 | 4.9 | 0.04 | 18 |
| LNU359 | 0.6 | 0.05 | 45 | 5.5 | 0.01 | 98 | 5.9 | L | 42 |
| LNU358 | 0.5 | 0.19 | 21 | 4.0 | L | 46 | 5.2 | 0.08 | 25 |
| LNU341 | 0.5 | 0.07 | 33 | — | — | — | — | — | — |
| LNU309_H3 | 0.6 | 0.11 | 33 | 4.9 | 0.17 | 75 | 5.9 | 0.02 | 40 |
| CONT. | 0.4 | — | — | 2.8 | — | — | 4.2 | — | — |

Table 78:
"CONT."—Control;
"Ave."—Average;
"% Incr." = % increment;
"p-val."—p-value;
L means that p-value is less than 0.01, $p < 0.1$ was considered as significant.

The genes listed in Tables 79-80 improved plant relative growth rate (RGR of leaf area, root length and root coverage) when grown at standard nitrogen concentration levels. These produced plants that grew faster than control plants when grown under standard nitrogen growth conditions. Faster growth was observed when growth rate of leaf area and root length and coverage was measured.

TABLE 79

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU437_H2 | 66104.1 | — | — | — | — | — | — | 0.6 | 0.02 | 19 |
| LNU437_H2 | 66104.2 | 0.0 | 0.02 | 42 | — | — | — | 0.6 | 0.26 | 8 |
| LNU437_H2 | 66104.3 | 0.1 | L | 54 | — | — | — | 0.6 | 0.06 | 15 |
| LNU426 | 66147.3 | 0.1 | L | 77 | — | — | — | 0.6 | 0.09 | 14 |
| LNU420 | 64008.4 | 0.0 | 0.14 | 25 | — | — | — | — | — | — |
| LNU352 | 64199.1 | 0.1 | L | 85 | — | — | — | 0.6 | 0.02 | 19 |
| LNU352 | 64200.1 | 0.0 | 0.15 | 26 | — | — | — | — | — | — |
| LNU352 | 64200.10 | 0.0 | 0.14 | 26 | — | — | — | 0.6 | 0.04 | 16 |

TABLE 79-continued

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU352 | 64200.4 | — | — | — | — | — | — | 0.6 | 0.09 | 12 |
| LNU292 | 64085.4 | — | — | — | — | — | — | 0.6 | 0.06 | 13 |
| CONT. | — | 0.0 | — | — | — | — | — | 0.5 | — | — |
| LNU483 | 64803.2 | 0.1 | 0.09 | 17 | — | — | — | 0.6 | 0.29 | 14 |
| LNU483 | 64803.3 | 0.1 | 0.15 | 17 | — | — | — | — | — | — |
| LNU483 | 64805.2 | 0.1 | 0.30 | 12 | — | — | — | — | — | — |
| LNU477 | 63886.1 | 0.1 | 0.05 | 21 | — | — | — | — | — | — |
| LNU447 | 65000.1 | 0.1 | 0.05 | 23 | — | — | — | — | — | — |
| LNU447 | 65002.3 | 0.1 | 0.11 | 20 | — | — | — | — | — | — |
| LNU447 | 65004.1 | 0.1 | 0.16 | 19 | — | — | — | — | — | — |
| LNU439 | 64614.4 | — | — | — | — | — | — | 0.7 | 0.16 | 17 |
| LNU439 | 64616.2 | 0.1 | 0.03 | 21 | — | — | — | — | — | — |
| LNU439 | 64616.3 | 0.1 | L | 41 | — | — | — | 0.7 | 0.10 | 22 |
| LNU439 | 64618.3 | 0.1 | 0.13 | 23 | — | — | — | — | — | — |
| LNU425 | 63911.11 | 0.1 | 0.25 | 13 | — | — | — | — | — | — |
| LNU425 | 63911.9 | 0.1 | 0.24 | 14 | — | — | — | — | — | — |
| LNU414 | 64475.1 | 0.1 | 0.04 | 34 | — | — | — | — | — | — |
| LNU336 | 64447.2 | 0.1 | 0.02 | 32 | — | — | — | — | — | — |
| LNU336 | 64448.2 | 0.1 | 0.22 | 29 | — | — | — | — | — | — |
| LNU336 | 64448.3 | 0.1 | 0.18 | 17 | — | — | — | — | — | — |
| LNU336 | 64449.4 | 0.1 | 0.12 | 17 | — | — | — | — | — | — |
| CONT. | — | 0.1 | — | — | — | — | — | 0.6 | — | — |
| LNU473 | 65770.4 | — | — | — | — | — | — | 0.7 | 0.23 | 8 |
| LNU473 | 65771.3 | — | — | — | — | — | — | 0.7 | 0.22 | 9 |
| LNU470 | 64228.3 | 0.1 | 0.20 | 14 | — | — | — | 0.7 | 0.02 | 17 |
| LNU470 | 64229.1 | — | — | — | — | — | — | 0.7 | 0.03 | 19 |
| LNU460 | 64359.3 | 0.1 | L | 39 | — | — | — | 0.8 | L | 23 |
| LNU460 | 64362.1 | — | — | — | — | — | — | 0.7 | 0.22 | 8 |
| LNU421 | 64302.7 | — | — | — | — | — | — | 0.7 | 0.28 | 7 |
| LNU421 | 64303.3 | — | — | — | — | — | — | 0.7 | 0.12 | 12 |
| LNU408 | 64248.10 | — | — | — | — | — | — | 0.7 | 0.02 | 16 |
| LNU408 | 64248.12 | — | — | — | — | — | — | 0.7 | 0.16 | 12 |
| LNU408 | 64250.8 | 0.1 | 0.21 | 13 | — | — | — | 0.7 | 0.04 | 16 |
| LNU380 | 65764.2 | — | — | — | — | — | — | 0.7 | 0.05 | 13 |
| LNU380 | 65764.3 | — | — | — | — | — | — | 0.7 | 0.08 | 13 |
| LNU380 | 65765.4 | — | — | — | — | — | — | 0.7 | 0.06 | 17 |
| LNU340 | 64290.11 | — | — | — | — | — | — | 0.8 | L | 21 |
| LNU340 | 64290.7 | — | — | — | — | — | — | 0.8 | L | 25 |
| LNU340 | 64291.10 | — | — | — | — | — | — | 0.7 | L | 19 |
| LNU331 | 64214.2 | — | — | — | — | — | — | 0.7 | 0.26 | 8 |
| LNU331 | 64215.1 | — | — | — | — | — | — | 0.7 | 0.18 | 11 |
| LNU331 | 64215.3 | — | — | — | — | — | — | 0.7 | 0.04 | 14 |
| LNU306 | 64131.2 | — | — | — | — | — | — | 0.7 | 0.09 | 13 |
| CONT. | — | 0.1 | — | — | — | — | — | 0.6 | — | — |
| LNU456 | 63991.2 | — | — | — | — | — | — | 0.7 | 0.02 | 19 |
| LNU456 | 63991.8 | — | — | — | — | — | — | 0.6 | 0.02 | 16 |
| LNU430 | 63934.3 | — | — | — | — | — | — | 0.6 | 0.27 | 10 |
| LNU430 | 63936.1 | — | — | — | — | — | — | 0.6 | 0.13 | 12 |
| LNU412 | 63940.1 | — | — | — | — | — | — | 0.6 | 0.16 | 9 |
| LNU412 | 63941.2 | — | — | — | — | — | — | 0.6 | 0.19 | 9 |
| LNU407 | 64218.2 | — | — | — | — | — | — | 0.6 | 0.05 | 13 |
| LNU407 | 64219.1 | — | — | — | — | — | — | 0.6 | 0.01 | 17 |
| LNU402 | 63913.1 | — | — | — | — | — | — | 0.6 | 0.14 | 10 |
| LNU384 | 64161.3 | — | — | — | — | — | — | 0.7 | L | 27 |
| LNU384 | 64161.7 | — | — | — | — | — | — | 0.7 | 0.01 | 22 |
| LNU360 | 64029.2 | — | — | — | — | — | — | 0.6 | 0.26 | 8 |
| LNU360 | 64029.3 | — | — | — | — | — | — | 0.6 | 0.27 | 9 |
| LNU360 | 64030.4 | — | — | — | — | — | — | 0.7 | L | 24 |
| LNU360 | 64030.6 | — | — | — | — | — | — | 0.6 | 0.11 | 11 |
| LNU335 | 64168.15 | — | — | — | — | — | — | 0.6 | 0.22 | 8 |
| LNU335 | 64169.2 | — | — | — | — | — | — | 0.6 | 0.23 | 8 |
| LNU301 | 63927.5 | — | — | — | — | — | — | 0.6 | 0.03 | 18 |
| LNU301 | 63950.3 | — | — | — | — | — | — | 0.7 | L | 19 |
| CONT. | — | — | — | — | — | — | — | 0.6 | — | — |
| LNU450 | 63710.2 | 0.1 | 0.24 | 14 | — | — | — | — | — | — |
| LNU450 | 63712.3 | 0.1 | 0.26 | 12 | — | — | — | — | — | — |
| LNU429 | 63938.2 | — | — | — | — | — | — | 0.7 | 0.12 | 15 |
| LNU426 | 66150.2 | — | — | — | — | — | — | 0.6 | 0.25 | 11 |
| LNU416 | 64134.11 | 0.1 | 0.15 | 16 | — | — | — | 0.7 | 0.21 | 12 |
| LNU416 | 64134.2 | 0.1 | 0.25 | 15 | — | — | — | — | — | — |
| LNU416 | 64134.5 | — | — | — | — | — | — | 0.7 | 0.19 | 12 |

TABLE 79-continued

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU412 | 63940.8 | 0.1 | 0.10 | 24 | — | — | — | — | — | — |
| LNU359 | 66154.5 | — | — | — | — | — | — | 0.7 | 0.17 | 13 |
| LNU349 | 63990.4 | 0.1 | 0.15 | 17 | — | — | — | 0.7 | 0.28 | 12 |
| LNU293 | 65048.1 | 0.1 | 0.12 | 24 | — | — | — | — | — | — |
| LNU293 | 65051.3 | 0.1 | 0.03 | 25 | — | — | — | — | — | — |
| CONT. | — | 0.1 | — | — | — | — | — | 0.6 | — | — |
| LNU498 | 64185.3 | 0.0 | 0.05 | 33 | — | — | — | — | — | — |
| LNU498 | 64186.2 | — | — | — | — | — | — | 0.7 | 0.13 | 8 |
| LNU493 | 64191.4 | — | — | — | — | — | — | 0.7 | 0.16 | 11 |
| LNU455 | 64187.4 | — | — | — | — | — | — | 0.7 | 0.06 | 9 |
| LNU455 | 64187.5 | 0.1 | 0.01 | 45 | — | — | — | 0.7 | 0.07 | 11 |
| LNU455 | 64189.4 | 0.0 | 0.09 | 30 | — | — | — | — | — | — |
| LNU455 | 64189.7 | — | — | — | — | — | — | 0.7 | 0.08 | 9 |
| LNU343 | 64208.1 | 0.0 | 0.29 | 18 | — | — | — | — | — | — |
| LNU343 | 64208.4 | — | — | — | — | — | — | 0.7 | 0.06 | 9 |
| LNU343 | 64209.1 | 0.0 | 0.27 | 18 | — | — | — | — | — | — |
| LNU328 | 64150.1 | 0.0 | 0.16 | 23 | — | — | — | — | — | — |
| LNU328 | 64150.4 | — | — | — | — | — | — | 0.7 | 0.10 | 9 |
| LNU328 | 64151.2 | — | — | — | — | — | — | 0.7 | 0.10 | 8 |
| LNU322 | 63917.2 | 0.0 | 0.23 | 20 | — | — | — | 0.8 | L | 18 |
| LNU322 | 63918.1 | 0.0 | 0.19 | 21 | — | — | — | — | — | — |
| LNU322 | 63918.3 | 0.0 | 0.16 | 30 | — | — | — | — | — | — |
| LNU317 | 64097.2 | — | — | — | — | — | — | 0.7 | 0.11 | 12 |
| LNU305 | 64111.3 | 0.0 | 0.08 | 31 | — | — | — | 0.7 | 0.02 | 13 |
| CONT. | — | 0.0 | — | — | — | — | — | 0.7 | — | — |
| LNU495 | 64701.4 | 0.0 | 0.13 | 17 | — | — | — | 0.6 | 0.14 | 17 |
| LNU487 | 64702.1 | 0.1 | L | 35 | — | — | — | 0.6 | 0.25 | 13 |
| LNU487 | 64702.3 | 0.0 | 0.09 | 18 | — | — | — | — | — | — |
| LNU487 | 64706.2 | — | — | — | — | — | — | 0.6 | 0.16 | 15 |
| LNU474 | 64381.1 | 0.0 | 0.15 | 17 | — | — | — | — | — | — |
| LNU474 | 64382.2 | 0.0 | 0.02 | 22 | — | — | — | — | — | — |
| LNU474 | 64382.3 | — | — | — | — | — | — | 0.6 | 0.16 | 15 |
| LNU465 | 64020.1 | 0.1 | 0.07 | 30 | — | — | — | — | — | — |
| LNU446 | 64546.2 | 0.0 | 0.16 | 14 | — | — | — | — | — | — |
| LNU446 | 64546.3 | — | — | — | — | — | — | 0.6 | 0.26 | 12 |
| LNU443 | 64024.3 | 0.1 | L | 38 | — | — | — | — | — | — |
| LNU436 | 64240.1 | 0.1 | 0.02 | 37 | — | — | — | — | — | — |
| LNU436 | 64240.2 | 0.0 | 0.04 | 21 | — | — | — | — | — | — |
| LNU436 | 64242.2 | 0.1 | 0.02 | 56 | — | — | — | 0.7 | 0.13 | 29 |
| LNU436 | 64243.1 | 0.0 | 0.18 | 18 | — | — | — | — | — | — |
| LNU379 | 64170.3 | — | — | — | — | — | — | 0.6 | 0.10 | 18 |
| LNU315 | 64224.1 | 0.0 | 0.27 | 14 | — | — | — | — | — | — |
| LNU315 | 64224.3 | 0.0 | 0.24 | 13 | — | — | — | — | — | — |
| LNU315 | 64225.1 | 0.0 | 0.14 | 22 | — | — | — | 0.6 | 0.07 | 23 |
| LNU315 | 64226.3 | 0.1 | L | 37 | — | — | — | 0.7 | 0.04 | 28 |
| LNU315 | 64227.3 | 0.0 | 0.20 | 13 | — | — | — | — | — | — |
| CONT. | — | 0.0 | — | — | — | — | — | 0.5 | — | — |
| LNU491 | 64406.4 | 0.1 | 0.18 | 29 | — | — | — | — | — | — |
| LNU449 | 64571.3 | 0.1 | 0.13 | 31 | — | — | — | 0.6 | 0.25 | 10 |
| LNU432 | 64065.2 | 0.1 | 0.11 | 44 | — | — | — | 0.6 | 0.21 | 17 |
| LNU432 | 64559.2 | 0.1 | 0.06 | 42 | — | — | — | 0.6 | 0.10 | 16 |
| LNU432 | 64560.5 | — | — | — | — | — | — | 0.6 | 0.11 | 14 |
| LNU367 | 64398.2 | 0.1 | 0.13 | 33 | — | — | — | — | — | — |
| LNU367 | 64399.1 | 0.1 | 0.26 | 19 | — | — | — | — | — | — |
| LNU367 | 64399.2 | 0.1 | 0.08 | 38 | — | — | — | — | — | — |
| LNU364 | 64441.3 | — | — | — | — | — | — | 0.6 | 0.25 | 9 |
| CONT. | — | 0.0 | — | — | — | — | — | 0.6 | — | — |
| LNU495 | 64697.3 | — | — | — | — | — | — | 0.6 | L | 24 |
| LNU495 | 64701.3 | — | — | — | — | — | — | 0.5 | 0.25 | 10 |
| LNU487 | 64702.1 | — | — | — | — | — | — | 0.6 | 0.11 | 14 |
| LNU487 | 64702.3 | — | — | — | — | — | — | 0.5 | 0.30 | 9 |
| LNU487 | 64704.2 | 0.1 | 0.26 | 16 | — | — | — | 0.6 | 0.05 | 18 |
| LNU487 | 64705.4 | — | — | — | — | — | — | 0.5 | 0.16 | 11 |
| LNU487 | 64706.2 | — | — | — | — | — | — | 0.5 | 0.10 | 13 |
| LNU474 | 64379.1 | — | — | — | — | — | — | 0.6 | 0.01 | 24 |
| LNU474 | 64382.3 | — | — | — | — | — | — | 0.6 | 0.13 | 14 |
| LNU474 | 64383.2 | — | — | — | — | — | — | 0.6 | 0.05 | 18 |
| LNU465 | 64022.2 | — | — | — | — | — | — | 0.5 | 0.17 | 10 |
| LNU446 | 64546.2 | — | — | — | — | — | — | 0.5 | 0.18 | 9 |
| LNU446 | 64546.3 | 0.1 | 0.12 | 18 | — | — | — | 0.6 | 0.07 | 19 |
| LNU446 | 64548.1 | — | — | — | — | — | — | 0.5 | 0.26 | 12 |

TABLE 79-continued

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU443 | 64023.2 | 0.1 | 0.06 | 25 | — | — | — | 0.6 | 0.02 | 21 |
| LNU436 | 64240.2 | — | — | — | — | — | — | 0.6 | 0.06 | 16 |
| LNU436 | 64241.3 | 0.1 | L | 35 | — | — | — | 0.6 | 0.05 | 23 |
| LNU379 | 64170.2 | — | — | — | — | — | — | 0.6 | 0.04 | 21 |
| LNU379 | 64170.3 | 0.1 | 0.04 | 24 | — | — | — | 0.6 | L | 30 |
| LNU379 | 64172.2 | 0.1 | L | 51 | — | — | — | 0.6 | L | 25 |
| LNU315 | 64225.2 | 0.1 | L | 40 | — | — | — | 0.6 | 0.04 | 20 |
| LNU315 | 64226.3 | 0.1 | 0.02 | 25 | — | — | — | 0.6 | 0.04 | 18 |
| LNU315 | 64227.3 | 0.1 | 0.11 | 19 | — | — | — | 0.6 | 0.04 | 17 |
| CONT. | — | 0.0 | — | — | — | — | — | 0.5 | — | — |
| LNU502 | 64040.4 | — | — | — | — | — | — | 0.6 | 0.25 | 11 |
| CONT. | — | — | — | — | — | — | — | 0.5 | — | — |
| LNU519 | 64678.1 | 0.1 | L | 25 | — | — | — | — | — | — |
| LNU519 | 64679.1 | 0.0 | 0.12 | 10 | — | — | — | — | — | — |
| LNU519 | 64681.3 | — | — | — | — | — | — | 0.7 | 0.09 | 13 |
| LNU519 | 64681.8 | 0.0 | 0.11 | 10 | — | — | — | — | — | — |
| LNU500 | 64223.1 | — | — | — | — | — | — | 0.7 | 0.22 | 9 |
| LNU500 | 64223.2 | — | — | — | — | — | — | 0.7 | 0.15 | 12 |
| LNU459 | 64542.3 | 0.1 | L | 23 | — | — | — | 0.7 | 0.06 | 14 |
| LNU348 | 64474.1 | 0.1 | 0.05 | 16 | — | — | — | — | — | — |
| LNU348 | 64474.2 | 0.1 | 0.01 | 20 | — | — | — | 0.7 | 0.20 | 10 |
| LNU329 | 63428.1 | — | — | — | — | — | — | 0.7 | 0.10 | 11 |
| LNU329 | 63428.2 | 0.0 | 0.27 | 11 | — | — | — | — | — | — |
| LNU329 | 63429.1 | 0.1 | 0.20 | 13 | — | — | — | — | — | — |
| LNU316 | 64565.4 | — | — | — | — | — | — | 0.7 | 0.17 | 10 |
| CONT. | — | 0.0 | — | — | — | — | — | 0.6 | — | — |
| LNU490 | 66093.2 | — | — | — | — | — | — | 0.5 | 0.10 | 15 |
| LNU490 | 66095.2 | — | — | — | — | — | — | 0.5 | 0.02 | 24 |
| LNU437_H2 | 66104.1 | — | — | — | — | — | — | 0.5 | 0.20 | 17 |
| LNU437_H2 | 66104.2 | 0.1 | 0.12 | 25 | — | — | — | 0.5 | 0.07 | 21 |
| LNU437_H2 | 66104.3 | — | — | — | — | — | — | 0.5 | 0.29 | 12 |
| LNU416 | 64134.11 | — | — | — | — | — | — | 0.5 | 0.11 | 18 |
| LNU416 | 64134.2 | — | — | — | — | — | — | 0.5 | 0.01 | 27 |
| LNU416 | 64136.4 | — | — | — | — | — | — | 0.5 | 0.10 | 16 |
| LNU395 | 64142.5 | 0.1 | 0.11 | 21 | — | — | — | — | — | — |
| LNU395 | 64143.6 | 0.1 | 0.29 | 13 | — | — | — | 0.5 | L | 32 |
| LNU312 | 64000.1 | — | — | — | — | — | — | 0.5 | 0.02 | 21 |
| LNU312 | 64002.2 | — | — | — | — | — | — | 0.5 | 0.23 | 15 |
| LNU312 | 64002.3 | 0.1 | 0.04 | 34 | — | — | — | — | — | — |
| LNU312 | 64002.5 | — | — | — | — | — | — | 0.5 | 0.09 | 17 |
| LNU311 | 66099.1 | — | — | — | — | — | — | 0.5 | 0.08 | 17 |
| LNU298 | 66086.4 | — | — | — | — | — | — | 0.5 | L | 27 |
| LNU298 | 66089.1 | — | — | — | — | — | — | 0.5 | 0.17 | 13 |
| CONT. | — | 0.0 | — | — | — | — | — | 0.4 | — | — |
| LNU468 | 63491.1 | — | — | — | — | — | — | 0.6 | 0.10 | 16 |
| LNU468 | 63492.2 | — | — | — | — | — | — | 0.6 | 0.06 | 16 |
| LNU468 | 63493.4 | — | — | — | — | — | — | 0.6 | 0.13 | 14 |
| LNU467 | 63715.1 | — | — | — | — | — | — | 0.6 | 0.25 | 9 |
| LNU462 | 63505.1 | — | — | — | — | — | — | 0.6 | 0.14 | 12 |
| LNU450 | 63708.3 | — | — | — | — | — | — | 0.7 | 0.01 | 24 |
| LNU450 | 63710.2 | — | — | — | — | — | — | 0.6 | 0.10 | 14 |
| LNU448 | 63705.2 | — | — | — | — | — | — | 0.7 | L | 26 |
| LNU448 | 63705.3 | — | — | — | — | — | — | 0.6 | 0.27 | 10 |
| LNU448 | 63707.2 | — | — | — | — | — | — | 0.6 | 0.04 | 20 |
| LNU392 | 63696.1 | — | — | — | — | — | — | 0.6 | 0.08 | 15 |
| LNU392 | 63697.4 | — | — | — | — | — | — | 0.6 | 0.16 | 12 |
| LNU392 | 63698.2 | — | — | — | — | — | — | 0.6 | 0.07 | 18 |
| LNU390 | 63539.4 | — | — | — | — | — | — | 0.6 | 0.17 | 12 |
| LNU347 | 63508.1 | — | — | — | — | — | — | 0.6 | 0.29 | 9 |
| LNU347 | 63510.2 | — | — | — | — | — | — | 0.6 | 0.01 | 23 |
| LNU347 | 63510.4 | — | — | — | — | — | — | 0.6 | 0.18 | 14 |
| LNU347 | 63513.3 | — | — | — | — | — | — | 0.6 | 0.08 | 15 |
| LNU347 | 63513.4 | — | — | — | — | — | — | 0.6 | 0.03 | 21 |
| LNU323 | 63421.2 | — | — | — | — | — | — | 0.6 | 0.23 | 10 |
| LNU323 | 63424.4 | — | — | — | — | — | — | 0.6 | 0.04 | 18 |
| CONT. | — | — | — | — | — | — | — | 0.5 | — | — |
| LNU497 | 64206.2 | — | — | — | — | — | — | 0.6 | 0.02 | 16 |
| LNU497 | 64207.2 | 0.1 | 0.18 | 22 | — | — | — | — | — | — |
| LNU491 | 64403.1 | — | — | — | — | — | — | 0.6 | 0.17 | 11 |
| LNU491 | 64404.3 | 0.1 | L | 47 | — | — | — | — | — | — |
| LNU491 | 64404.6 | 0.1 | 0.18 | 22 | — | — | — | — | — | — |

TABLE 79-continued

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU491 | 64406.4 | — | — | — | — | — | — | 0.6 | 0.15 | 11 |
| LNU449 | 63890.1 | — | — | — | — | — | — | 0.6 | 0.25 | 12 |
| LNU432 | 64066.2 | 0.1 | 0.01 | 48 | — | — | — | — | — | — |
| LNU432 | 64559.2 | — | — | — | — | — | — | 0.6 | 0.20 | 9 |
| LNU432 | 64560.5 | — | — | — | — | — | — | 0.6 | 0.05 | 14 |
| CONT. | — | 0.0 | — | — | — | — | — | 0.6 | — | — |
| LNU510 | 64152.1 | — | — | — | — | — | — | 0.7 | 0.06 | 34 |
| LNU489 | 64011.1 | — | — | — | — | — | — | 0.6 | 0.23 | 22 |
| LNU489 | 64012.1 | — | — | — | — | — | — | 0.7 | 0.06 | 34 |
| LNU489 | 64013.1 | — | — | — | — | — | — | 0.7 | 0.13 | 28 |
| LNU438 | 63994.12 | — | — | — | — | — | — | 0.6 | 0.26 | 22 |
| LNU438 | 63994.2 | — | — | — | — | — | — | 0.7 | 0.04 | 37 |
| LNU438 | 63994.3 | — | — | — | — | — | — | 0.7 | 0.12 | 28 |
| LNU438 | 63994.5 | — | — | — | — | — | — | 0.7 | 0.04 | 40 |
| LNU427 | 64178.6 | — | — | — | — | — | — | 0.7 | 0.21 | 23 |
| LNU427 | 64180.3 | — | — | — | — | — | — | 0.7 | 0.18 | 24 |
| LNU383 | 63982.1 | — | — | — | — | — | — | 0.7 | 0.05 | 35 |
| LNU383 | 63982.7 | — | — | — | — | — | — | 0.7 | 0.06 | 35 |
| LNU354 | 63970.6 | — | — | — | — | — | — | 0.7 | 0.06 | 33 |
| LNU354 | 63972.8 | — | — | — | — | — | — | 0.7 | 0.22 | 23 |
| LNU310 | 63904.1 | — | — | — | — | — | — | 0.7 | 0.15 | 26 |
| LNU310 | 63904.3 | 0.1 | 0.18 | 17 | — | — | — | 0.7 | 0.15 | 28 |
| LNU299 | 64326.2 | — | — | — | — | — | — | 0.7 | 0.16 | 26 |
| LNU299 | 64328.2 | — | — | — | — | — | — | 0.6 | 0.28 | 20 |
| LNU295 | 63899.5 | — | — | — | — | — | — | 0.6 | 0.21 | 22 |
| LNU295 | 63901.3 | — | — | — | — | — | — | 0.7 | 0.11 | 29 |
| LNU295 | 63902.3 | — | — | — | — | — | — | 0.7 | 0.17 | 29 |
| CONT. | — | 0.1 | — | — | — | — | — | 0.5 | — | — |
| LNU483 | 64803.2 | 0.1 | 0.11 | 27 | — | — | — | — | — | — |
| LNU483 | 64803.3 | 0.1 | 0.02 | 41 | — | — | — | — | — | — |
| LNU483 | 64805.2 | 0.1 | 0.06 | 31 | — | — | — | — | — | — |
| LNU435 | 64463.3 | 0.1 | 0.05 | 36 | — | — | — | — | — | — |
| LNU378 | 64494.2 | — | — | — | — | — | — | 0.7 | 0.21 | 14 |
| LNU346 | 65007.3 | — | — | — | — | — | — | 0.7 | 0.20 | 8 |
| CONT. | — | 0.0 | — | — | — | — | — | 0.6 | — | — |
| LNU510 | 64153.5 | — | — | — | — | — | — | 0.7 | 0.02 | 12 |
| LNU489 | 64010.8 | 0.0 | 0.28 | 23 | — | — | — | 0.7 | 0.08 | 13 |
| LNU489 | 64012.1 | — | — | — | — | — | — | 0.6 | 0.05 | 10 |
| LNU438 | 63994.1 | — | — | — | — | — | — | 0.7 | L | 25 |
| LNU438 | 63994.12 | — | — | — | — | — | — | 0.7 | L | 17 |
| LNU438 | 63994.2 | — | — | — | — | — | — | 0.7 | L | 20 |
| LNU438 | 63994.5 | 0.1 | 0.13 | 39 | — | — | — | — | — | — |
| LNU427 | 64180.4 | — | — | — | — | — | — | 0.7 | 0.04 | 11 |
| LNU354 | 63970.6 | — | — | — | — | — | — | 0.7 | L | 15 |
| LNU354 | 63971.5 | — | — | — | — | — | — | 0.7 | 0.02 | 19 |
| LNU354 | 63972.5 | — | — | — | — | — | — | 0.7 | 0.11 | 11 |
| LNU354 | 63972.8 | 0.0 | 0.21 | 26 | — | — | — | 0.7 | L | 19 |
| LNU310 | 63904.1 | 0.0 | 0.28 | 26 | — | — | — | — | — | — |
| LNU310 | 63904.3 | — | — | — | — | — | — | 0.7 | L | 17 |
| LNU310 | 63905.1 | — | — | — | — | — | — | 0.7 | 0.02 | 18 |
| LNU310 | 63905.3 | — | — | — | — | — | — | 0.6 | 0.07 | 10 |
| LNU299 | 64327.2 | — | — | — | — | — | — | 0.7 | 0.01 | 13 |
| LNU295 | 63899.5 | — | — | — | — | — | — | 0.6 | 0.11 | 8 |
| LNU295 | 63899.8 | 0.0 | 0.25 | 27 | — | — | — | 0.7 | L | 21 |
| LNU295 | 63901.3 | — | — | — | — | — | — | 0.7 | 0.09 | 11 |
| LNU295 | 63902.3 | 0.1 | 0.03 | 60 | — | — | — | 0.7 | 0.01 | 21 |
| CONT. | — | 0.0 | — | — | — | — | — | 0.6 | — | — |
| LNU490 | 66093.2 | 0.0 | 0.26 | 20 | — | — | — | 0.5 | 0.14 | 19 |
| LNU490 | 66096.1 | — | — | — | — | — | — | 0.5 | 0.11 | 18 |
| LNU443 | 64023.2 | — | — | — | — | — | — | 0.5 | 0.21 | 13 |
| LNU443 | 64024.4 | — | — | — | — | — | — | 0.5 | 0.02 | 26 |
| LNU443 | 64024.7 | 0.1 | 0.01 | 50 | — | — | — | 0.5 | 0.05 | 22 |
| LNU439 | 64614.4 | 0.1 | 0.08 | 38 | — | — | — | — | — | — |
| LNU439 | 64618.3 | 0.1 | 0.07 | 52 | — | — | — | 0.5 | 0.08 | 21 |
| LNU437_H2 | 66104.1 | — | — | — | — | — | — | 0.5 | 0.19 | 15 |
| LNU437_H2 | 66104.2 | — | — | — | — | — | — | 0.5 | 0.18 | 13 |
| LNU436 | 64240.2 | 0.1 | 0.14 | 29 | — | — | — | 0.5 | 0.08 | 22 |
| LNU436 | 64242.2 | 0.0 | 0.26 | 21 | — | — | — | — | — | — |
| LNU436 | 64243.1 | — | — | — | — | — | — | 0.5 | 0.02 | 27 |
| LNU433 | 64815.2 | 0.0 | 0.13 | 27 | — | — | — | 0.5 | 0.25 | 14 |
| LNU311 | 66099.1 | — | — | — | — | — | — | 0.5 | 0.02 | 31 |

TABLE 79-continued

Genes showing improved growth rate at standard nitrogen growth conditions (T2 generation)

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LNU311 | 66099.2 | — | — | — | — | — | — | 0.5 | 0.04 | 21 |
| LNU311 | 66100.3 | — | — | — | — | — | — | 0.5 | 0.24 | 12 |
| LNU298 | 66086.4 | — | — | — | — | — | — | 0.5 | 0.10 | 18 |
| LNU298 | 66088.3 | — | — | — | — | — | — | 0.5 | 0.10 | 17 |
| LNU298 | 66089.3 | — | — | — | — | — | — | 0.5 | 0.22 | 15 |
| LNU293 | 65048.1 | — | — | — | — | — | — | 0.5 | L | 28 |
| LNU293 | 65051.3 | 0.0 | 0.16 | 25 | — | — | — | 0.5 | 0.04 | 24 |
| CONT. | — | 0.0 | — | — | — | — | — | 0.4 | — | — |

Table 79:
"CONT."—Control;
"Ave."—Average;
"% Incr." = % increment;
"p-val."—p-value;
L means that p-value is less than 0.01, p < 0.1 was considered as significant.

TABLE 80

Genes showing improved growth rate at standard nitrogen growth conditions (T1 generation)

| Gene Name | RGR Of Leaf Area | | | RGR Of Root Coverage | | | RGR Of Roots Length | | |
|---|---|---|---|---|---|---|---|---|---|
| | Ave. | P-Val. | % Incr. | Ave. | P-Val. | % Incr. | Ave. | P-Val. | % Incr. |
| LNU490 | — | — | — | — | — | — | 0.4 | 0.05 | 29 |
| LNU417_H4 | — | — | — | — | — | — | 0.4 | 0.12 | 27 |
| LNU394 | — | — | — | — | — | — | 0.4 | 0.09 | 27 |
| CONT. | — | — | — | — | — | — | 0.3 | — | — |
| LNU488 | 0.1 | L | 49 | — | — | — | 0.7 | L | 55 |
| LNU466 | — | — | — | — | — | — | 0.5 | L | 26 |
| LNU453 | 0.0 | 0.11 | 20 | — | — | — | 0.5 | 0.01 | 25 |
| LNU359 | 0.1 | L | 66 | — | — | — | 0.7 | L | 52 |
| LNU358 | 0.1 | 0.04 | 34 | — | — | — | 0.6 | 0.01 | 33 |
| LNU341 | 0.1 | 0.02 | 36 | — | — | — | 0.5 | 0.13 | 27 |
| LNU309_H3 | 0.1 | 0.02 | 44 | — | — | — | 0.6 | L | 45 |
| CONT. | 0.0 | — | — | — | — | — | 0.4 | — | — |

Table 80.
"CONT."—Control;
"Ave."—Average;
"% Incr." = % increment;
"p-val."—p-value;
L means that p-value is less than 0.01, p < 0.1 was considered as significant.

Example 17

Evaluation of Transgenic *Arabidopsis* NUE, Yield and Plant Growth Rate Under Low or Normal Nitrogen Fertilization in Greenhouse Assay Assay 1: Nitrogen Use Efficiency: Seed Yield Plant Biomass and Plant Growth Rate at Limited and Optimal Nitrogen Concentration Under Greenhouse Conditions—

This assay follows seed yield production, the biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The T₂ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of KNO₃, supplemented with 1 mM KH₂PO₄, 1 mM MgSO₄, 3.6 mM KCl, 2 mM CaCl₂ and microelements, while normal nitrogen levels were achieved by applying a solution of 6 mM inorganic nitrogen also in the form of KNO₃ with 1 mM KH₂PO₄, 1 mM MgSO₄, 2 mM CaCl₂ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its T₂ generation. Transgenic plants transformed with a construct conformed by an empty vector carrying the 35S promoter and the selectable marker was used as control.

The plants were analyzed for their overall size, growth rate, flowering, seed yield, 1,000-seed weight, dry matter and harvest index (HI—seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) is used for capturing images of plant samples.

The image capturing process is repeated every 2 days starting from day 1 after transplanting till day 15. Same camera, placed in a custom made iron mount, is used for capturing images of larger plants sawn in white tubs in an environmental controlled greenhouse. The tubs are square shape include 1.7 liter trays. During the capture process, the tubs are placed beneath the iron mount, while avoiding direct sun light and casting of shadows.

An image analysis system is used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images are captured in resolution of 10 Mega Pixels (3888×2592 pixels) and stored in a low compression JPEG (Joint Photographic Experts Group standard) format. Next, analyzed data is saved to text files and processed using the JMP statistical analysis software (SAS institute).

Leaf Analysis—

Using the digital analysis leaves data is calculated, including leaf number, rosette area, rosette diameter, leaf blade area.

Vegetative Growth Rate:

The relative growth rate (RGR) of leaf number [formula XII (described above)], rosette area (formula V, above), plot coverage (Formula XIX, below) and harvest index (Formula IV, above) is calculated with the indicated formulas.

Relative growth rate of plot coverage=Regression coefficient of plot coverage along time course    Formula XIX Seeds Average Weight—

At the end of the experiment all seeds are collected. The seeds are scattered on a glass tray and a picture was taken. Using the digital analysis, the number of seeds in each sample is calculated.

Dry Weight and Seed Yield—

On about day 80 from sowing, the plants are harvested and left to dry at 30° C. in a drying chamber. The biomass and seed weight of each plot are measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula IV as described above.

Oil Percentage in Seeds—

At the end of the experiment all seeds from each plot are collected. Seeds from 3 plots are mixed grounded and then mounted onto the extraction chamber. 210 ml of n-Hexane (Cat No. 080951 Biolab Ltd.) are used as the solvent. The extraction is performed for 30 hours at medium heat 50° C. Once the extraction has ended the n-Hexane was evaporated using the evaporator at 35° C. and vacuum conditions. The process is repeated twice. The information gained from the Soxhlet extractor (Soxhlet, F. Die gewichtsanalytische Bestimmung des Milchfettes, Polytechnisches J. (Dingier's) 1879, 232, 461) is used to create a calibration curve for the Low Resonance NMR. The content of oil of all seed samples is determined using the Low Resonance NMR (MARAN Ultra-Oxford Instrument) and its MultiQuant software package.

Silique Length Analysis—

On day 50 from sowing, 30 siliques from different plants in each plot are sampled in block A. The chosen siliques are green-yellow in color and are collected from the bottom parts of a grown plant's stem. A digital photograph is taken to determine silique's length.

Statistical Analyses—

To identify genes conferring significantly improved tolerance to abiotic stresses, the results obtained from the transgenic plants are compared to those obtained from control plants. To identify outperforming genes and constructs, results from the independent transformation events tested are analyzed separately. Data is analyzed using Student's t-test and results are considered significant if the p value was less than 0.1. The JMP statistics software package is used (Version 5.2.1, SAS Institute Inc., Cary, N.C., USA).

Tables 81-90 summarize the observed phenotypes of transgenic plants exogenously expressing the gene constructs using the greenhouse seed maturation (GH-SM) assays under low nitrogen (Tables 81-85) or normal nitrogen (Tables 86-90) conditions. The evaluation of each gene was performed by testing the performance of different number of events. Event with p-value<0.1 was considered statistically significant.

TABLE 81

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU519 | 64681.8 | 238.8 | 0.10 | 8 | — | — | — | — | — | — |
| LNU459 | 64542.4 | 239.2 | 0.29 | 8 | — | — | — | — | — | — |

TABLE 81-continued

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU409 | 64687.2 | 268.8 | L | 22 | — | — | — | — | — | — |
| LNU408 | 64250.8 | 231.9 | 0.30 | 5 | — | — | — | — | — | — |
| LNU385 | 64245.3 | 244.4 | 0.24 | 11 | — | — | — | — | — | — |
| LNU385 | 64245.5 | 251.9 | L | 14 | — | — | — | — | — | — |
| LNU360 | 64029.2 | 237.5 | 0.25 | 8 | — | — | — | — | — | — |
| LNU348 | 64472.2 | 265.6 | L | 20 | — | — | — | — | — | — |
| LNU340 | 64292.5 | 243.1 | 0.07 | 10 | — | — | — | — | — | — |
| LNU336 | 64449.4 | — | — | — | 14.6 | 0.08 | −10 | 10.8 | 0.01 | −14 |
| LNU331 | 64212.1 | 249.4 | 0.05 | 13 | — | — | — | — | — | — |
| LNU331 | 64214.2 | 242.5 | 0.29 | 10 | — | — | — | — | — | — |
| LNU331 | 64215.3 | 240.6 | 0.05 | 9 | — | — | — | — | — | — |
| LNU327 | 64491.2 | 245.0 | 0.02 | 11 | — | — | — | — | — | — |
| LNU316 | 64565.3 | 245.6 | 0.02 | 11 | — | — | — | — | — | — |
| LNU290 | 64368.4 | 245.6 | 0.03 | 11 | — | — | — | — | — | — |
| CONT. | — | 220.8 | — | — | 16.3 | — | — | 12.5 | — | — |
| LNU502 | 64038.5 | 229.4 | 0.04 | 19 | 15.8 | 0.17 | −2 | 11.2 | 0.04 | −6 |
| LNU502 | 64039.4 | — | — | — | — | — | — | 11.5 | 0.12 | −4 |
| LNU500 | 64221.6 | — | — | — | 15.6 | 0.04 | −3 | 11.3 | 0.22 | −5 |
| LNU500 | 64222.1 | 212.5 | 0.12 | 10 | — | — | — | — | — | — |
| LNU498 | 64185.3 | 216.2 | 0.15 | 12 | — | — | — | — | — | — |
| LNU493 | 64190.3 | — | — | — | 15.9 | 0.28 | −1 | — | — | — |
| LNU493 | 64191.3 | 226.9 | 0.15 | 18 | 15.7 | 0.24 | −2 | 11.2 | 0.03 | −6 |
| LNU485 | 63825.1 | 308.1 | L | 60 | — | — | — | 11.2 | 0.04 | −6 |
| LNU456 | 63991.2 | 209.4 | 0.16 | 9 | — | — | — | 11.1 | L | −7 |
| LNU456 | 63991.8 | 218.1 | 0.09 | 13 | 15.9 | 0.28 | −1 | 11.5 | 0.12 | −4 |
| LNU455 | 64187.4 | 210.0 | 0.29 | 9 | 15.9 | 0.28 | −1 | 11.4 | 0.18 | −5 |
| LNU455 | 64187.5 | — | — | — | 15.8 | 0.17 | −2 | — | — | — |
| LNU455 | 64189.2 | — | — | — | 15.8 | 0.17 | −2 | — | — | — |
| LNU384 | 64161.2 | — | — | — | — | — | — | 11.5 | 0.12 | −4 |
| LNU384 | 64161.6 | 226.9 | 0.07 | 18 | — | — | — | — | — | — |
| LNU384 | 64161.9 | 204.4 | 0.30 | 6 | — | — | — | — | — | — |
| LNU371 | 63974.6 | — | — | — | — | — | — | 11.2 | 0.04 | −6 |
| LNU371 | 63975.1 | 221.9 | 0.03 | 15 | — | — | — | — | — | — |
| LNU360 | 64030.6 | — | — | — | 15.9 | 0.28 | −1 | — | — | — |
| LNU343 | 64208.1 | — | — | — | 15.8 | 0.17 | −2 | 11.6 | 0.19 | −3 |
| LNU343 | 64208.4 | — | — | — | 15.9 | 0.28 | −1 | 11.5 | 0.12 | −4 |
| LNU328 | 64150.1 | 206.9 | 0.20 | 7 | 14.5 | 0.10 | −10 | 11.0 | L | −8 |
| LNU328 | 64150.2 | — | — | — | — | — | — | 11.3 | 0.04 | −5 |
| LNU328 | 64151.2 | — | — | — | — | — | — | 11.2 | 0.03 | −6 |
| LNU322 | 63917.2 | — | — | — | 15.7 | 0.24 | −2 | — | — | — |
| LNU317 | 64093.3 | — | — | — | 15.9 | 0.28 | −1 | 11.5 | 0.12 | −4 |
| LNU317 | 64097.2 | — | — | — | 15.5 | 0.13 | −4 | 11.5 | 0.12 | −4 |
| LNU317 | 64097.3 | 215.6 | 0.07 | 12 | — | — | — | 11.5 | 0.12 | −4 |
| LNU306 | 64132.1 | — | — | — | 15.9 | 0.28 | −1 | — | — | — |
| LNU306 | 64132.6 | — | — | — | — | — | — | 11.2 | 0.03 | −6 |
| LNU305 | 64111.3 | — | — | — | 15.6 | 0.04 | −3 | — | — | — |
| LNU305 | 64114.1 | 237.5 | 0.11 | 23 | — | — | — | — | — | — |
| LNU305 | 64115.1 | — | — | — | — | — | — | 11.5 | 0.12 | −4 |
| CONT. | — | 192.5 | — | — | 16.1 | — | — | 11.9 | — | — |
| LNU499 | 64146.8 | 323.1 | 0.03 | 13 | — | — | — | — | — | — |
| LNU499 | 64147.11 | 347.5 | 0.17 | 21 | — | — | — | — | — | — |
| LNU485 | 63825.1 | 401.2 | 0.01 | 40 | — | — | — | — | — | — |
| LNU485 | 63827.1 | 307.5 | 0.17 | 7 | — | — | — | — | — | — |
| LNU468 | 63492.2 | 315.6 | 0.12 | 10 | — | — | — | — | — | — |
| LNU468 | 63493.4 | 337.5 | 0.08 | 18 | — | — | — | — | — | — |
| LNU467 | 63715.1 | 327.9 | 0.12 | 14 | — | — | — | — | — | — |
| LNU462 | 63503.2 | 334.4 | 0.28 | 16 | — | — | — | — | — | — |
| LNU450 | 63708.3 | 449.4 | 0.13 | 56 | — | — | — | — | — | — |
| LNU450 | 63708.6 | 463.8 | 0.01 | 62 | — | — | — | — | — | — |
| LNU450 | 63709.4 | 456.2 | 0.06 | 59 | — | — | — | — | — | — |
| LNU450 | 63710.2 | 444.4 | 0.03 | 55 | — | — | — | — | — | — |
| LNU450 | 63712.3 | 478.8 | 0.06 | 67 | — | — | — | — | — | — |
| LNU448 | 63706.5 | 475.6 | 0.04 | 66 | — | — | — | — | — | — |
| LNU429 | 63937.3 | 423.8 | L | 48 | — | — | — | — | — | — |
| LNU429 | 63937.4 | 342.5 | 0.10 | 19 | — | — | — | — | — | — |
| LNU429 | 63938.5 | 315.7 | 0.27 | 10 | — | — | — | — | — | — |
| LNU416 | 64134.5 | 323.1 | 0.07 | 13 | — | — | — | — | — | — |
| LNU399 | 63944.4 | 324.4 | 0.02 | 13 | — | — | — | — | — | — |
| LNU399 | 63944.6 | 326.9 | 0.03 | 14 | — | — | — | — | — | — |
| LNU395 | 64143.6 | 328.1 | 0.29 | 14 | — | — | — | — | — | — |
| LNU395 | 64145.4 | 350.6 | 0.20 | 22 | — | — | — | — | — | — |

TABLE 81-continued

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LNU392 | 63698.2 | 325.0 | 0.09 | 13 | — | — | — | — | — | — |
| LNU390 | 63539.2 | 321.9 | 0.10 | 12 | — | — | — | — | — | — |
| LNU375 | 63452.2 | 316.4 | 0.18 | 10 | — | — | — | — | — | — |
| LNU375 | 63454.2 | 358.1 | 0.03 | 25 | — | — | — | — | — | — |
| LNU349 | 63989.1 | 309.3 | 0.20 | 8 | — | — | — | — | — | — |
| LNU347 | 63510.2 | 348.8 | 0.27 | 21 | — | — | — | — | — | — |
| LNU323 | 63420.1 | 308.1 | 0.29 | 7 | — | — | — | — | — | — |
| LNU323 | 63421.2 | 336.9 | 0.13 | 17 | — | — | — | — | — | — |
| LNU323 | 63424.4 | 324.6 | 0.26 | 13 | — | — | — | — | — | — |
| CONT. | — | 287.1 | — | — | — | — | — | — | — | — |

Table 81:
"CONT."—Control;
"Ave."—Average;
"% Incr." = % increment;
"p-val."—p-value;
L means that p-value is less than 0.01, $p < 0.1$ was considered as significant.
The transgenes were under the transcriptional regulation of the new At6669 promoter (SEQ ID NO: 3829).

TABLE 82

Genes showing improved plant performance at Low N growth conditions under regulation of At6669 promoter

| Gene Name | Event # | Leaf Blade Area [cm$^2$] | | | Leaf Number | | | Plot Coverage [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LNU519 | 64678.1 | — | — | — | — | — | — | 62.3 | 0.25 | 16 |
| LNU519 | 64679.1 | 1.0 | 0.13 | 9 | — | — | — | — | — | — |
| LNU519 | 64681.8 | 1.0 | 0.02 | 12 | 10.8 | 0.10 | 3 | 62.3 | 0.02 | 16 |
| LNU503 | 64203.3 | 1.0 | 0.23 | 6 | — | — | — | 59.2 | 0.15 | 10 |
| LNU460 | 64359.4 | 1.0 | 0.02 | 13 | 11.1 | 0.02 | 6 | 62.3 | 0.08 | 16 |
| LNU460 | 64362.1 | — | — | — | — | — | — | 57.7 | 0.26 | 7 |
| LNU459 | 64542.1 | 0.9 | 0.25 | 5 | — | — | — | 57.1 | 0.26 | 6 |
| LNU421 | 64302.7 | 1.0 | 0.10 | 10 | — | — | — | — | — | — |
| LNU412 | 63940.11 | 1.0 | 0.09 | 9 | — | — | — | — | — | — |
| LNU409 | 64687.2 | 1.0 | 0.01 | 16 | — | — | — | 63.0 | 0.01 | 17 |
| LNU409 | 64688.2 | 1.0 | 0.03 | 17 | — | — | — | 62.1 | 0.02 | 15 |
| LNU408 | 64249.4 | 1.0 | 0.20 | 6 | — | — | — | — | — | — |
| LNU385 | 64245.3 | 1.0 | 0.20 | 11 | 10.7 | 0.25 | 2 | 61.3 | 0.10 | 14 |
| LNU360 | 64029.2 | 1.0 | 0.24 | 6 | — | — | — | — | — | — |
| LNU360 | 64030.1 | 1.1 | 0.02 | 22 | — | — | — | 69.1 | L | 28 |
| LNU336 | 64447.2 | — | — | — | 10.9 | 0.04 | 5 | — | — | — |
| LNU336 | 64447.4 | — | — | — | — | — | — | 57.0 | 0.26 | 6 |
| LNU331 | 64212.3 | — | — | — | — | — | — | 57.6 | 0.19 | 7 |
| LNU331 | 64215.3 | 1.0 | 0.06 | 9 | — | — | — | 62.2 | 0.05 | 15 |
| LNU327 | 64490.3 | 1.0 | 0.05 | 15 | — | — | — | 63.7 | 0.02 | 18 |
| LNU290 | 64369.3 | 1.0 | 0.20 | 6 | — | — | — | — | — | — |
| CONT. | — | 0.9 | — | — | 10.5 | — | — | 53.8 | — | — |
| LNU502 | 64038.5 | 0.9 | 0.02 | 13 | — | — | — | 52.4 | 0.15 | 8 |
| LNU498 | 64184.3 | — | — | — | 10.8 | 0.14 | 5 | — | — | — |
| LNU493 | 64191.3 | 0.9 | 0.05 | 10 | 11.4 | 0.17 | 11 | 57.1 | 0.01 | 17 |
| LNU485 | 63825.1 | — | — | — | 10.8 | 0.02 | 5 | 54.0 | 0.06 | 11 |
| LNU456 | 63991.2 | 0.9 | 0.24 | 6 | — | — | — | — | — | — |
| LNU456 | 63991.8 | 0.9 | 0.20 | 9 | 11.4 | 0.27 | 11 | 55.3 | 0.08 | 14 |
| LNU455 | 64187.4 | 0.9 | 0.07 | 10 | — | — | — | 51.8 | 0.21 | 7 |
| LNU455 | 64187.5 | 0.9 | 0.18 | 10 | 10.6 | 0.16 | 3 | 55.2 | 0.17 | 14 |
| LNU371 | 63974.6 | 0.9 | 0.07 | 10 | — | — | — | 55.3 | 0.04 | 14 |
| LNU343 | 64208.4 | — | — | — | 11.1 | 0.23 | 8 | — | — | — |
| LNU328 | 64150.1 | — | — | — | 11.0 | 0.28 | 7 | 55.6 | 0.11 | 14 |
| LNU328 | 64151.2 | 1.0 | 0.02 | 14 | — | — | — | 54.4 | 0.05 | 12 |
| LNU322 | 63917.2 | — | — | — | 10.9 | L | 6 | — | — | — |
| LNU305 | 64115.1 | 0.9 | 0.27 | 7 | — | — | — | 52.5 | 0.14 | 8 |
| CONT. | — | 0.8 | — | — | 10.3 | — | — | 48.6 | — | — |
| LNU468 | 63492.2 | 0.8 | 0.12 | 9 | — | — | — | — | — | — |
| LNU467 | 63714.4 | 0.8 | 0.29 | 5 | — | — | — | — | — | — |

TABLE 82-continued

Genes showing improved plant performance at Low N growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LNU450 | 63708.6 | 0.8 | 0.01 | 16 | — | — | — | 44.9 | 0.15 | 8 |
| LNU448 | 63705.4 | 0.8 | 0.13 | 8 | — | — | — | — | — | — |
| LNU448 | 63706.5 | 0.8 | 0.23 | 12 | — | — | — | — | — | — |
| LNU375 | 63454.2 | 0.9 | 0.06 | 18 | — | — | — | 48.0 | 0.02 | 15 |
| LNU323 | 63421.2 | 0.8 | 0.26 | 6 | — | — | — | — | — | — |
| CONT. | — | 0.7 | — | — | — | — | — | 41.6 | — | — |

Table 82.
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 83

Genes showing improved plant performance at low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU519 | 64678.1 | — | — | — | 7.9 | 0.12 | 18 | — | — | — |
| LNU519 | 64681.8 | — | — | — | 8.0 | 0.10 | 19 | 0.4 | 0.12 | 16 |
| LNU503 | 64203.3 | — | — | — | 7.6 | 0.27 | 13 | 0.4 | 0.23 | 13 |
| LNU460 | 64359.4 | — | — | — | 8.0 | 0.10 | 19 | 0.4 | 0.05 | 21 |
| LNU460 | 64360.3 | — | — | — | — | — | — | 0.4 | 0.22 | 12 |
| LNU409 | 64687.2 | — | — | — | 8.1 | 0.09 | 20 | 0.4 | 0.17 | 14 |
| LNU409 | 64688.2 | — | — | — | 7.9 | 0.12 | 18 | 0.4 | 0.07 | 19 |
| LNU385 | 64245.3 | — | — | — | 7.6 | 0.25 | 13 | 0.4 | 0.30 | 11 |
| LNU385 | 64246.6 | — | — | — | — | — | — | 0.4 | 0.25 | 12 |
| LNU360 | 64029.2 | — | — | — | — | — | — | 0.4 | 0.15 | 15 |
| LNU360 | 64030.1 | — | — | — | 8.9 | L | 32 | 0.4 | 0.03 | 23 |
| LNU360 | 64030.4 | — | — | — | — | — | — | 0.4 | 0.29 | 12 |
| LNU331 | 64212.3 | — | — | — | — | — | — | 0.4 | 0.26 | 11 |
| LNU331 | 64215.3 | — | — | — | 7.8 | 0.15 | 16 | 0.4 | 0.21 | 13 |
| LNU327 | 64490.3 | — | — | — | 8.3 | 0.06 | 23 | 0.4 | 0.05 | 21 |
| LNU290 | 64369.3 | — | — | — | — | — | — | 0.4 | 0.12 | 17 |
| CONT. | — | — | — | — | 6.7 | — | — | 0.3 | — | — |
| LNU493 | 64191.3 | 0.8 | 0.10 | 19 | 6.9 | 0.07 | 15 | — | — | — |
| LNU493 | 64191.4 | — | — | — | 7.0 | 0.08 | 17 | — | — | — |
| LNU485 | 63825.1 | — | — | — | 6.6 | 0.27 | 9 | — | — | — |
| LNU456 | 63991.8 | 0.8 | 0.03 | 27 | 6.9 | 0.09 | 14 | — | — | — |
| LNU455 | 64187.5 | — | — | — | 6.9 | 0.09 | 14 | — | — | — |
| LNU371 | 63974.6 | 0.8 | 0.25 | 14 | 6.9 | 0.10 | 14 | 0.4 | 0.21 | 10 |
| LNU360 | 64030.4 | — | — | — | — | — | — | 0.4 | 0.27 | 9 |
| LNU343 | 64208.4 | 0.8 | 0.09 | 20 | — | — | — | — | — | — |
| LNU328 | 64150.1 | 0.8 | 0.26 | 15 | 6.8 | 0.11 | 13 | — | — | — |
| LNU328 | 64151.2 | — | — | — | 6.9 | 0.10 | 14 | 0.4 | 0.15 | 12 |
| LNU306 | 64132.6 | 0.8 | 0.18 | 16 | — | — | — | — | — | — |
| CONT. | — | 0.7 | — | — | 6.0 | — | — | 0.3 | — | — |
| LNU468 | 63492.2 | — | — | — | — | — | — | 0.4 | 0.19 | 13 |
| LNU462 | 63503.2 | — | — | — | — | — | — | 0.4 | 0.26 | 11 |

TABLE 83-continued

Genes showing improved plant performance at low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU375 | 63454.2 | — | — | — | 6.3 | 0.24 | 17 | 0.4 | 0.10 | 15 |
| LNU323 | 63421.2 | — | — | — | — | — | — | 0.4 | 0.28 | 10 |
| CONT. | — | — | — | — | 5.4 | — | — | 0.4 | — | — |

Table 83.
"CONT."—Control;
"Ave."—Average;
"% Incr." = % increment;
"p-val."—p-value;
L means that p-value is less than 0.01 p < 0.1 was considered as significant.
The transgenes were under the transcriptional regulation of the new At6669 promoter (SEQ ID NO: 3829).

TABLE 84

Genes showing improved plant performance at low Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU519 | 64678.1 | — | — | — | 7.8 | 0.25 | 16 | — | — | — |
| LNU519 | 64681.8 | — | — | — | 7.8 | 0.02 | 16 | 4.6 | 0.04 | 7 |
| LNU503 | 64203.3 | — | — | — | 7.4 | 0.15 | 10 | 4.5 | 0.17 | 4 |
| LNU460 | 64359.4 | 0.4 | 0.29 | 4 | 7.8 | 0.08 | 16 | 4.7 | 0.16 | 8 |
| LNU460 | 64362.1 | — | — | — | 7.2 | 0.26 | 7 | — | — | — |
| LNU459 | 64542.1 | 0.4 | 0.15 | 7 | 7.1 | 0.26 | 6 | 4.5 | 0.12 | 5 |
| LNU421 | 64303.4 | — | — | — | — | — | — | 4.5 | 0.17 | 4 |
| LNU409 | 64687.2 | — | — | — | 7.9 | 0.01 | 17 | 4.8 | 0.01 | 10 |
| LNU409 | 64688.2 | — | — | — | 7.8 | 0.02 | 15 | 4.8 | 0.10 | 10 |
| LNU385 | 64245.3 | — | — | — | 7.7 | 0.10 | 14 | 4.7 | 0.15 | 9 |
| LNU360 | 64030.1 | — | — | — | 8.6 | L | 28 | 4.9 | L | 14 |
| LNU360 | 64030.4 | 0.4 | 0.10 | 9 | — | — | — | — | — | — |
| LNU336 | 64447.4 | — | — | — | 7.1 | 0.26 | 6 | — | — | — |
| LNU336 | 64449.4 | 0.4 | 0.21 | 7 | — | — | — | — | — | — |
| LNU331 | 64212.3 | — | — | — | 7.2 | 0.19 | 7 | 4.6 | 0.10 | 6 |
| LNU331 | 64214.2 | — | — | — | — | — | — | 4.5 | 0.28 | 3 |
| LNU331 | 64215.3 | — | — | — | 7.8 | 0.05 | 15 | 4.1 | 0.01 | 9 |
| LNU327 | 64490.3 | — | — | — | 8.0 | 0.02 | 18 | 4.8 | 0.02 | 10 |
| LNU290 | 64369.3 | — | — | — | — | — | — | 4.5 | 0.22 | 4 |
| CONT. | — | 0.4 | — | — | 6.7 | — | — | 4.3 | — | — |
| LNU502 | 64038.5 | — | — | — | 6.6 | 0.15 | 8 | 4.5 | 0.05 | 7 |
| LNU502 | 64039.4 | 0.4 | L | 8 | — | — | — | — | — | — |
| LNU500 | 64221.2 | 0.5 | 0.30 | 19 | — | — | — | — | — | — |
| LNU500 | 64223.1 | 0.4 | 0.09 | 5 | — | — | — | — | — | — |
| LNU493 | 64191.3 | — | — | — | 7.1 | 0.01 | 17 | 4.5 | 0.04 | 7 |
| LNU485 | 63825.1 | — | — | — | 6.7 | 0.06 | 11 | — | — | — |
| LNU480 | 64018.4 | 0.4 | 0.29 | 9 | — | — | — | — | — | — |
| LNU456 | 63991.8 | — | — | — | 6.9 | 0.08 | 14 | 4.4 | 0.21 | 7 |
| LNU456 | 63992.5 | 0.5 | 0.04 | 16 | — | — | — | — | — | — |
| LNU455 | 64187.4 | — | — | — | 6.5 | 0.21 | 7 | 4.4 | 0.13 | 5 |
| LNU455 | 64187.5 | 0.5 | L | 12 | 6.9 | 0.17 | 14 | 4.5 | 0.04 | 9 |
| LNU455 | 64189.7 | 0.4 | 0.15 | 4 | — | — | — | — | — | — |
| LNU371 | 63973.10 | 0.4 | 0.26 | 3 | — | — | — | — | — | — |
| LNU371 | 63974.6 | — | — | — | 6.9 | 0.04 | 14 | 4.5 | 0.04 | 7 |
| LNU360 | 64030.1 | 0.4 | 0.13 | 4 | — | — | — | — | — | — |
| LNU328 | 64150.1 | — | — | — | 7.0 | 0.11 | 14 | 4.5 | 0.11 | 7 |
| LNU328 | 64151.2 | 0.4 | 0.17 | 4 | 6.8 | 0.05 | 12 | 4.5 | 0.06 | 8 |
| LNU317 | 64097.2 | 0.4 | 0.14 | 9 | — | — | — | — | — | — |
| LNU306 | 64132.2 | 0.5 | 0.19 | 13 | — | — | — | — | — | — |
| LNU305 | 64115.1 | 0.5 | 0.16 | 13 | 6.6 | 0.14 | 8 | 4.4 | 0.11 | 5 |
| CONT. | — | 0.4 | — | — | 6.1 | — | — | 4.2 | — | — |
| LNU499 | 64146.8 | 0.3 | 0.01 | 21 | — | — | — | — | — | — |
| LNU485 | 63828.3 | 0.3 | 0.03 | 22 | — | — | — | — | — | — |
| LNU468 | 63493.4 | 0.3 | 0.01 | 22 | — | — | — | — | — | — |
| LNU467 | 63718.1 | 0.3 | 0.05 | 14 | — | — | — | — | — | — |
| LNU467 | 63718.2 | 0.3 | 0.07 | 17 | — | — | — | — | — | — |

TABLE 84-continued

Genes showing improved plant performance at low Nitrogen growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU462 | 63502.2 | 0.3 | 0.09 | 19 | — | — | — | — | — | — |
| LNU462 | 63503.2 | 0.3 | 0.08 | 18 | — | — | — | — | — | — |
| LNU450 | 63708.3 | 0.3 | L | 27 | — | — | — | — | — | — |
| LNU450 | 63708.6 | — | — | — | 5.6 | 0.15 | 8 | — | — | — |
| LNU450 | 63710.2 | 0.3 | 0.06 | 27 | — | — | — | — | — | — |
| LNU450 | 63712.3 | 0.3 | 0.24 | 25 | — | — | — | — | — | — |
| LNU448 | 63705.2 | 0.3 | 0.23 | 9 | — | — | — | — | — | — |
| LNU448 | 63706.5 | 0.3 | 0.02 | 20 | — | — | — | — | — | — |
| LNU448 | 63707.2 | 0.3 | L | 32 | — | — | — | — | — | — |
| LNU429 | 63937.4 | 0.3 | 0.22 | 17 | — | — | — | — | — | — |
| LNU416 | 64134.11 | 0.3 | 0.19 | 18 | — | — | — | — | — | — |
| LNU416 | 64134.2 | 0.3 | 0.15 | 11 | — | — | — | — | — | — |
| LNU399 | 63944.2 | 0.3 | 0.12 | 19 | — | — | — | — | — | — |
| LNU395 | 64142.8 | 0.3 | 0.06 | 14 | — | — | — | — | — | — |
| LNU395 | 64143.5 | 0.3 | 0.06 | 14 | — | — | — | — | — | — |
| LNU392 | 63697.4 | 0.3 | 0.11 | 16 | — | — | — | — | — | — |
| LNU390 | 63539.4 | 0.3 | 0.12 | 11 | — | — | — | — | — | — |
| LNU375 | 63452.3 | 0.3 | 0.28 | 23 | — | — | — | — | — | — |
| LNU375 | 63454.2 | 0.3 | L | 31 | 6.0 | 0.02 | 15 | 4.4 | 0.01 | 11 |
| LNU349 | 63989.6 | 0.3 | L | 24 | — | — | — | — | — | — |
| LNU349 | 63990.2 | 0.3 | 0.24 | 11 | — | — | — | — | — | — |
| LNU347 | 63508.1 | 0.3 | 0.22 | 13 | — | — | — | — | — | — |
| LNU347 | 63513.4 | 0.3 | 0.09 | 16 | — | — | — | — | — | — |
| LNU329 | 63427.3 | 0.3 | 0.22 | 22 | — | — | — | — | — | — |
| LNU329 | 63430.3 | 0.3 | 0.05 | 19 | — | — | — | — | — | — |
| LNU323 | 63421.2 | 0.3 | 0.29 | 19 | — | — | — | 4.1 | 0.16 | 5 |
| CONT. | — | 0.3 | — | — | 5.2 | — | — | 3.9 | — | — |

Table 84.
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 85

Genes showing improved plant performance at low Nitrogen growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LNU508 | 64460.1 | 94.2 | 0.17 | 6 | — | — | — |
| LNU421 | 64303.4 | — | — | — | 25.2 | L | 14 |
| LNU409 | 64687.2 | — | — | — | 23.5 | 0.02 | 7 |
| LNU408 | 64250.8 | — | — | — | 23.4 | 0.02 | 7 |
| LNU385 | 64245.3 | 97.2 | 0.05 | 10 | — | — | — |
| LNU348 | 64472.2 | — | — | — | 26.9 | 0.13 | 22 |
| LNU340 | 64292.5 | 94.1 | 0.19 | 6 | — | — | — |
| LNU336 | 64447.4 | — | — | — | 22.7 | 0.20 | 3 |
| LNU331 | 64212.1 | — | — | — | 24.3 | L | 10 |
| LNU327 | 64491.2 | 101.1 | 0.06 | 14 | — | — | — |
| LNU316 | 64567.1 | — | — | — | 26.1 | L | 19 |
| LNU290 | 64369.3 | — | — | — | 23.9 | 0.29 | 9 |
| CONT. | — | 88.5 | — | — | 22.0 | — | — |
| LNU502 | 64038.2 | — | — | — | 22.8 | 0.14 | 10 |
| LNU502 | 64038.5 | — | — | — | 24.4 | L | 18 |
| LNU502 | 64039.3 | — | — | — | 22.0 | 0.17 | 6 |
| LNU500 | 64222.1 | — | — | — | 24.9 | 0.07 | 20 |
| LNU498 | 64185.3 | 88.3 | 0.18 | 11 | — | — | — |
| LNU498 | 64186.1 | 87.7 | 0.14 | 11 | — | — | — |
| LNU498 | 64186.2 | 86.9 | 0.12 | 10 | — | — | — |
| LNU493 | 64191.3 | — | — | — | 22.7 | 0.09 | 9 |
| LNU485 | 63825.1 | — | — | — | 30.8 | 0.01 | 48 |
| LNU485 | 63828.3 | — | — | — | 21.3 | 0.22 | 2 |
| LNU456 | 63991.2 | 86.6 | 0.13 | 9 | — | — | — |
| LNU456 | 63991.8 | 91.7 | 0.14 | 16 | — | — | — |
| LNU456 | 63992.6 | — | — | — | 21.3 | 0.16 | 3 |
| LNU455 | 64189.4 | — | — | — | 21.3 | 0.22 | 2 |
| LNU384 | 64161.2 | — | — | — | 22.1 | 0.08 | 6 |
| LNU371 | 63973.12 | — | — | — | 21.8 | 0.22 | 5 |
| LNU371 | 63974.4 | — | — | — | 22.4 | 0.03 | 8 |
| LNU371 | 63974.6 | — | — | — | 23.6 | L | 14 |
| LNU360 | 64029.8 | 90.6 | 0.04 | 14 | — | — | — |
| LNU360 | 64030.1 | — | — | — | 21.3 | 0.29 | 2 |
| LNU343 | 64208.1 | — | — | — | 23.6 | 0.26 | 14 |
| LNU343 | 64208.2 | — | — | — | 24.7 | L | 19 |
| LNU328 | 64151.1 | — | — | — | 23.4 | 0.12 | 13 |
| LNU322 | 63918.4 | — | — | — | 21.8 | 0.03 | 5 |
| LNU317 | 64097.1 | — | — | — | 21.3 | 0.22 | 3 |
| LNU306 | 64130.7 | — | — | — | 21.5 | 0.24 | 3 |
| LNU306 | 64132.6 | — | — | — | 24.4 | 0.07 | 17 |
| CONT. | — | 79.2 | — | — | 20.8 | — | — |
| LNU499 | 64146.8 | 102.9 | L | 35 | — | — | — |

TABLE 85-continued

Genes showing improved plant performance at low Nitrogen growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LNU499 | 64147.11 | 98.8 | 0.19 | 30 | — | — | — |
| LNU485 | 63825.1 | 95.6 | 0.05 | 26 | 24.4 | 0.02 | 51 |
| LNU485 | 63825.2 | 87.4 | 0.27 | 15 | — | — | — |
| LNU485 | 63828.3 | — | — | — | 16.9 | 0.26 | 5 |
| LNU468 | 63493.2 | 96.7 | 0.03 | 27 | 16.8 | 0.30 | 4 |
| LNU468 | 63493.4 | 108.7 | 0.03 | 43 | — | — | — |
| LNU467 | 63714.4 | — | — | — | 17.2 | 0.24 | 6 |
| LNU467 | 63718.1 | — | — | — | 17.2 | 0.05 | 7 |
| LNU462 | 63503.2 | 103.3 | 0.01 | 36 | 17.4 | 0.04 | 8 |
| LNU462 | 63505.1 | — | — | — | 17.0 | 0.08 | 6 |
| LNU450 | 63708.3 | 150.5 | 0.05 | 98 | — | — | — |
| LNU450 | 63708.6 | 131.6 | L | 73 | 22.5 | L | 39 |
| LNU450 | 63709.4 | 123.4 | 0.18 | 62 | — | — | — |
| LNU450 | 63710.2 | 148.3 | 0.07 | 95 | — | — | — |
| LNU450 | 63712.3 | 157.1 | L | 107 | — | — | — |
| LNU448 | 63705.3 | — | — | — | 16.8 | 0.17 | 4 |
| LNU448 | 63706.5 | 149.8 | L | 97 | — | — | — |
| LNU448 | 63707.2 | 91.0 | 0.15 | 20 | 18.3 | L | 13 |
| LNU429 | 63937.3 | — | — | — | 20.1 | 0.04 | 24 |
| LNU429 | 63937.4 | 105.1 | L | 38 | — | — | — |
| LNU429 | 63938.5 | — | — | — | 16.9 | 0.30 | 5 |
| LNU416 | 64134.2 | — | — | — | 16.8 | 0.20 | 4 |
| LNU399 | 63944.2 | 90.8 | 0.08 | 19 | — | — | — |
| LNU399 | 63945.3 | 87.2 | 0.20 | 15 | — | — | — |
| LNU395 | 64142.8 | — | — | — | 16.7 | 0.26 | 3 |
| LNU395 | 64143.5 | 100.6 | 0.10 | 32 | — | — | — |
| LNU395 | 64145.4 | 96.9 | 0.26 | 27 | — | — | — |
| LNU392 | 63701.2 | — | — | — | 21.1 | L | 31 |
| LNU390 | 63539.2 | 94.6 | 0.15 | 24 | — | — | — |
| LNU390 | 63539.3 | — | — | — | 17.5 | 0.02 | 8 |
| LNU390 | 63539.4 | — | — | — | 16.7 | 0.23 | 3 |
| LNU375 | 63452.3 | 102.5 | 0.01 | 35 | — | — | — |
| LNU375 | 63454.2 | 123.5 | 0.01 | 62 | — | — | — |
| LNU349 | 63989.6 | 93.9 | 0.05 | 23 | 16.7 | 0.30 | 4 |
| LNU349 | 63990.2 | 91.3 | 0.27 | 20 | — | — | — |
| LNU329 | 63428.2 | — | — | — | 18.6 | 0.01 | 16 |
| LNU323 | 63421.2 | 106.4 | 0.26 | 40 | — | — | — |
| LNU323 | 63424.4 | 84.4 | 0.29 | 11 | — | — | — |
| CONT. | — | 76.1 | — | — | 16.1 | — | — |

Table 85.
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 86

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LNU503 | 64203.3 | 620.0 | 0.23 | 9 | — | — | — | — | — | — |
| LNU460 | 64360.1 | 623.1 | 0.13 | 10 | — | — | — | — | — | — |
| LNU421 | 64303.3 | — | — | — | 16.5 | 0.25 | -1 | — | — | — |
| LNU421 | 64303.4 | 615.6 | 0.19 | 8 | 16.5 | 0.25 | -1 | — | — | — |
| LNU336 | 64449.4 | — | — | — | 15.9 | L | -4 | 11.9 | 0.07 | -5 |
| LNU290 | 64372.2 | — | — | — | 16.4 | 0.27 | -1 | — | — | — |
| CONT. | — | 568.8 | — | — | 16.6 | — | — | 12.6 | — | — |
| LNU502 | 64038.5 | 734.4 | L | 9 | — | — | — | 11.1 | 0.07 | -6 |
| LNU502 | 64039.4 | 698.8 | 0.06 | 4 | — | — | — | — | — | — |
| LNU500 | 64221.2 | 693.8 | 0.10 | 3 | — | — | — | — | — | — |
| LNU500 | 64221.6 | — | — | — | — | — | — | 11.2 | 0.11 | -5 |
| LNU500 | 64222.1 | 760.6 | 0.24 | 13 | — | — | — | — | — | — |
| LNU498 | 64184.2 | 705.0 | 0.05 | 5 | — | — | — | — | — | — |
| LNU498 | 64185.3 | 700.6 | 0.15 | 4 | — | — | — | — | — | — |
| LNU498 | 64186.1 | 747.5 | L | 11 | — | — | — | — | — | — |
| LNU493 | 64190.1 | — | — | — | — | — | — | 11.2 | 0.11 | -5 |
| LNU493 | 64191.3 | 799.4 | L | 19 | — | — | — | — | — | — |
| LNU485 | 63825.1 | 878.8 | 0.18 | 31 | — | — | — | 11.4 | 0.27 | -4 |
| LNU456 | 63991.2 | — | — | — | — | — | — | 11.0 | 0.04 | -7 |
| LNU456 | 63991.8 | — | — | — | 16.1 | 0.28 | -2 | 11.2 | 0.11 | -5 |
| LNU456 | 63992.5 | — | — | — | — | — | — | 11.2 | 0.10 | -6 |
| LNU455 | 64187.4 | — | — | — | — | — | — | 11.1 | 0.06 | -7 |
| LNU455 | 64189.4 | 712.5 | 0.20 | 6 | — | — | — | — | — | — |
| LNU412 | 63940.10 | 764.4 | L | 14 | — | — | — | — | — | — |
| LNU384 | 64161.6 | 763.8 | 0.09 | 14 | — | — | — | — | — | — |
| LNU371 | 63974.6 | — | — | — | — | — | — | 11.4 | 0.27 | -4 |
| LNU343 | 64208.1 | 706.2 | 0.20 | 5 | — | — | — | — | — | — |
| LNU343 | 64208.4 | 731.2 | L | 9 | — | — | — | — | — | — |
| LNU343 | 64209.2 | 748.8 | 0.15 | 11 | — | — | — | — | — | — |
| LNU328 | 64150.1 | 693.8 | 0.22 | 3 | — | — | — | 11.0 | 0.04 | -7 |
| LNU328 | 64150.2 | — | — | — | — | — | — | 11.3 | 0.16 | -4 |
| LNU328 | 64151.1 | — | — | — | — | — | — | 11.1 | 0.06 | -7 |

TABLE 86-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LNU328 | 64151.2 | — | — | — | — | — | — | 11.1 | 0.07 | −6 |
| LNU322 | 63918.3 | 687.5 | 0.26 | 2 | — | — | — | 11.4 | 0.27 | −4 |
| LNU317 | 64097.1 | — | — | — | 15.9 | 0.03 | −3 | 11.0 | 0.04 | −7 |
| LNU317 | 64097.2 | — | — | — | — | — | — | 11.3 | 0.28 | −5 |
| LNU317 | 64097.3 | — | — | — | — | — | — | 11.4 | 0.27 | −4 |
| LNU305 | 64111.1 | — | — | — | — | — | — | 11.1 | 0.07 | −6 |
| LNU305 | 64115.1 | 768.8 | 0.05 | 14 | — | — | — | — | — | — |
| CONT. | — | 672.5 | — | — | 16.4 | — | — | 11.9 | — | — |
| LNU499 | 64146.12 | — | — | — | — | — | — | 13.6 | 0.02 | −14 |
| LNU485 | 63825.2 | — | — | — | 16.7 | 0.26 | −3 | — | — | — |
| LNU468 | 63493.2 | — | — | — | — | — | — | 14.1 | 0.05 | −12 |
| LNU467 | 63716.1 | — | — | — | — | — | — | 13.5 | 0.02 | −15 |
| LNU467 | 63718.2 | — | — | — | — | — | — | 13.8 | 0.02 | −14 |
| LNU462 | 63503.1 | — | — | — | — | — | — | 13.5 | 0.02 | −15 |
| LNU450 | 63708.3 | 996.2 | 0.28 | 22 | — | — | — | — | — | — |
| LNU450 | 63712.3 | 940.0 | 0.14 | 15 | — | — | — | — | — | — |
| LNU448 | 63706.5 | 1195.0 | 0.06 | 46 | — | — | — | — | — | — |
| LNU429 | 63937.4 | — | — | — | — | — | — | 13.8 | 0.02 | −14 |
| LNU416 | 64134.1 | — | — | — | — | — | — | 13.9 | 0.06 | −12 |
| LNU395 | 64145.1 | — | — | — | — | — | — | 14.1 | 0.05 | −12 |
| LNU375 | 63452.2 | — | — | — | 16.2 | 0.10 | −6 | — | — | — |
| LNU349 | 63990.4 | — | — | — | — | — | — | 13.8 | 0.02 | −14 |
| LNU347 | 63510.2 | — | — | — | — | — | — | 13.5 | 0.02 | −15 |
| LNU329 | 63427.3 | — | — | — | 16.7 | 0.26 | −3 | 13.5 | 0.02 | −15 |
| CONT. | — | 816.2 | — | — | 17.3 | — | — | 15.9 | — | — |

Table 86.
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 87

Genes showing improved plant performance at Normal growth conditions under regulation of At6669 promoter

| Gene Name | Event # | Leaf Blade Area [cm$^2$] Ave. | P-Val. | % Incr. | Leaf Number Ave. | P-Va. | % Incr. | Plot Coverage [cm$^2$] Ave. | P-Val. | % Incr. |
|---|---|---|---|---|---|---|---|---|---|---|
| LNU519 | 64678.1 | — | — | — | 11.4 | 0.24 | 7 | — | — | — |
| LNU508 | 64457.2 | — | — | — | 11.2 | 0.03 | 6 | — | — | — |
| LNU503 | 64203.3 | — | — | — | 11.0 | 0.14 | 4 | — | — | — |
| LNU503 | 64204.2 | — | — | — | 11.1 | 0.22 | 5 | — | — | — |
| LNU460 | 64359.4 | 1.3 | 0.09 | 5 | 11.1 | 0.17 | 4 | — | — | — |
| LNU460 | 64362.1 | 1.4 | 0.14 | 12 | 11.6 | L | 10 | 90.0 | 0.02 | 20 |
| LNU421 | 64302.7 | — | — | — | 11.1 | 0.22 | 5 | — | — | — |
| LNU421 | 64303.3 | — | — | — | 10.9 | 0.21 | 3 | — | — | — |
| LNU385 | 64245.5 | — | — | — | 11.3 | 0.20 | 7 | — | — | — |
| LNU360 | 64030.1 | — | — | — | 11.8 | 0.02 | 11 | — | — | — |
| LNU348 | 64472.2 | 1.3 | 0.15 | 5 | 11.4 | 0.04 | 8 | 81.2 | 0.03 | 8 |
| LNU348 | 64474.2 | 1.4 | 0.23 | 15 | 11.1 | 0.07 | 5 | 85.5 | 0.12 | 14 |
| LNU340 | 64290.11 | — | — | — | 11.2 | 0.11 | 6 | — | — | — |
| LNU336 | 64449.4 | 1.3 | 0.02 | 8 | — | — | — | — | — | — |
| LNU331 | 64212.1 | — | — | — | 11.4 | 0.02 | 7 | 82.5 | 0.15 | 10 |
| LNU331 | 64215.1 | 1.3 | 0.21 | 10 | — | — | — | — | — | — |
| LNU331 | 64215.3 | — | — | — | 11.9 | L | 13 | — | — | — |
| LNU290 | 64369.3 | — | — | — | 11.3 | 0.20 | 7 | — | — | — |
| LNU290 | 64372.1 | 1.4 | 0.08 | 11 | — | — | — | 82.5 | 0.12 | 10 |
| CONT. | — | 1.2 | — | — | 10.6 | — | — | 74.9 | — | — |
| LNU502 | 64038.5 | 1.3 | 0.23 | 10 | 11.3 | L | 6 | 79.3 | 0.22 | 12 |
| LNU500 | 64221.6 | — | — | — | 11.4 | 0.10 | 7 | — | — | — |
| LNU498 | 64186.1 | 1.3 | 0.18 | 9 | 11.4 | L | 7 | 82.1 | 0.10 | 16 |
| LNU493 | 64190.1 | — | — | — | 10.9 | 0.08 | 2 | — | — | — |
| LNU493 | 64191.3 | — | — | — | 11.4 | 0.03 | 7 | 80.8 | 0.11 | 14 |
| LNU493 | 64191.4 | 1.3 | 0.18 | 9 | 11.2 | 0.17 | 5 | 80.0 | 0.16 | 13 |

TABLE 87-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Va. | % Incr. | Ave. | P-Val. | % Incr. |
| LNU485 | 63825.1 | 1.4 | 0.10 | 23 | — | — | — | 87.7 | 0.02 | 23 |
| LNU480 | 64018.1 | 1.3 | 0.21 | 10 | 11.4 | 0.18 | 7 | 80.4 | 0.11 | 13 |
| LNU455 | 64187.4 | — | — | — | 11.5 | 0.15 | 8 | — | — | — |
| LNU371 | 63974.6 | — | — | — | 10.9 | 0.08 | 2 | — | — | — |
| LNU360 | 64029.8 | — | — | — | 11.4 | 0.22 | 7 | — | — | — |
| LNU343 | 64208.4 | — | — | — | 11.8 | 0.27 | 10 | — | — | — |
| LNU343 | 64209.2 | — | — | — | 11.1 | 0.08 | 4 | — | — | — |
| LNU328 | 64150.1 | — | — | — | 10.8 | 0.25 | 1 | — | — | — |
| LNU328 | 64151.1 | 1.3 | 0.13 | 11 | — | — | — | — | — | — |
| LNU328 | 64151.2 | — | — | — | 11.1 | 0.29 | 4 | — | — | — |
| LNU322 | 63917.2 | — | — | — | 11.4 | L | 7 | — | — | — |
| LNU317 | 64097.3 | 1.3 | 0.26 | 8 | — | — | — | 81.3 | 0.09 | 14 |
| LNU305 | 64111.1 | — | — | — | 11.4 | L | 7 | 79.8 | 0.13 | 12 |
| LNU305 | 64111.3 | — | — | — | 11.1 | 0.02 | 4 | — | — | — |
| LNU305 | 64115.1 | 1.3 | 0.06 | 13 | 11.6 | 0.30 | 9 | 85.5 | 0.03 | 20 |
| CONT. | — | 1.2 | — | — | 10.7 | — | — | 71.1 | — | — |
| LNU462 | 63505.1 | 0.9 | 0.28 | 12 | — | — | — | — | — | — |
| LNU429 | 63938.5 | — | — | — | 10.5 | 0.29 | 10 | — | — | — |
| LNU395 | 64143.5 | 0.9 | 0.16 | 9 | 10.2 | 0.15 | 7 | — | — | — |
| LNU375 | 63452.2 | — | — | — | 10.1 | 0.16 | 5 | — | — | — |
| LNU323 | 63424.4 | 0.9 | 0.19 | 9 | — | — | — | — | — | — |
| CONT. | — | 0.8 | — | — | 9.6 | — | — | — | — | — |

Table 87
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO:3829).

TABLE 88

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val | % Incr. | Ave. | P-Val | % Incr. |
| LNU503 | 64204.2 | 0.9 | 0.23 | 14 | — | — | — | — | — | — |
| LNU460 | 64360.1 | 0.8 | 0.29 | 12 | — | — | — | — | — | — |
| LNU460 | 64362.1 | — | — | — | 11.7 | 0.12 | 21 | 0.5 | 0.04 | 14 |
| LNU421 | 64302.7 | 0.8 | 0.28 | 11 | — | — | — | — | — | — |
| LNU412 | 63940.10 | — | — | — | 11.3 | 0.24 | 17 | — | — | — |
| LNU408 | 64248.10 | — | — | — | — | — | — | 0.5 | 0.23 | 8 |
| LNU360 | 64030.1 | 0.9 | 0.13 | 17 | — | — | — | — | — | — |
| LNU360 | 64030.6 | 0.9 | 0.24 | 14 | — | — | — | — | — | — |
| LNU348 | 64474.2 | — | — | — | 11.2 | 0.27 | 15 | 0.5 | 0.11 | 12 |
| LNU340 | 64290.11 | 0.9 | 0.18 | 17 | — | — | — | — | — | — |
| LNU340 | 64292.5 | — | — | — | 11.3 | 0.25 | 16 | — | — | — |
| LNU336 | 64449.4 | — | — | — | — | — | — | 0.5 | 0.05 | 16 |
| LNU331 | 64215.3 | 0.9 | 0.17 | 15 | — | — | — | — | — | — |
| LNU290 | 64369.4 | — | — | — | — | — | — | 0.5 | 0.17 | 9 |
| CONT. | — | 0.8 | — | — | 9.7 | — | — | 0.5 | — | — |
| LNU500 | 64221.6 | 0.8 | 0.18 | 14 | — | — | — | — | — | — |
| LNU498 | 64186.1 | 0.9 | 0.05 | 21 | 10.7 | 0.28 | 16 | — | — | — |
| LNU485 | 63825.1 | — | — | — | 11.3 | 0.15 | 22 | — | — | — |
| LNU480 | 64018.1 | 0.9 | 0.16 | 19 | — | — | — | — | — | — |
| LNU456 | 63991.2 | 0.8 | 0.20 | 15 | — | — | — | — | — | — |
| LNU455 | 64187.4 | 0.9 | 0.04 | 22 | — | — | — | — | — | — |
| LNU360 | 64029.8 | 0.9 | 0.06 | 20 | — | — | — | — | — | — |
| LNU343 | 64208.4 | 0.9 | 0.05 | 24 | — | — | — | — | — | — |
| LNU328 | 64151.2 | 0.8 | 0.23 | 13 | — | — | — | — | — | — |
| LNU305 | 64111.1 | 0.8 | 0.28 | 12 | — | — | — | — | — | — |
| LNU305 | 64115.1 | 0.9 | 0.17 | 16 | 11.1 | 0.19 | 20 | — | — | — |
| CONT. | — | 0.7 | — | — | 9.2 | — | — | — | — | — |
| LNU429 | 63938.5 | — | — | — | — | — | — | 0.5 | 0.12 | 15 |

TABLE 88-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val | % Incr. | Ave. | P-Val | % Incr. |
| LNU395 | 64143.5 | — | — | — | — | — | — | 0.5 | 0.09 | 15 |
| CONT. | — | — | — | — | — | — | — | 0.4 | — | — |

Table 88
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 89

Genes showing improved plant performance at Normal growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU508 | 64459.2 | 0.4 | 0.27 | 4 | — | — | — | — | — | — |
| LNU503 | 64204.2 | — | — | — | — | — | — | 5.4 | 0.17 | 2 |
| LNU460 | 64360.3 | 0.4 | 0.24 | 6 | — | — | — | — | — | — |
| LNU460 | 64362.1 | — | — | — | 11.2 | 0.02 | 20 | 5.8 | 0.03 | 10 |
| LNU459 | 64543.2 | — | — | — | — | — | — | 5.4 | 0.28 | 2 |
| LNU408 | 64248.10 | — | — | — | — | — | — | 5.4 | 0.09 | 3 |
| LNU348 | 64472.2 | — | — | — | 10.2 | 0.03 | 8 | — | — | — |
| LNU348 | 64474.2 | — | — | — | 10.7 | 0.12 | 14 | 5.6 | 0.07 | 7 |
| LNU336 | 64449.4 | — | — | — | — | — | — | 5.7 | 0.28 | 8 |
| LNU331 | 64212.1 | — | — | — | 10.3 | 0.15 | 10 | — | — | — |
| LNU331 | 64215.1 | — | — | — | — | — | — | 5.6 | L | 6 |
| LNU290 | 64369.4 | — | — | — | — | — | — | 5.5 | 0.06 | 5 |
| LNU290 | 64372.1 | — | — | — | 10.3 | 0.12 | 10 | 5.6 | 0.27 | 6 |
| CONT. | — | 0.3 | — | — | 9.4 | — | — | 5.3 | — | — |
| LNU502 | 64038.5 | — | — | — | 9.9 | 0.22 | 12 | 5.7 | 0.28 | 8 |
| LNU502 | 64039.4 | 0.5 | 0.04 | 9 | — | — | — | — | — | — |
| LNU498 | 64185.3 | 0.5 | 0.16 | 8 | — | — | — | — | — | — |
| LNU498 | 64186.1 | — | — | — | 10.3 | 0.10 | 16 | — | — | — |
| LNU493 | 64191.3 | — | — | — | 10.1 | 0.11 | 14 | — | — | — |
| LNU493 | 64191.4 | — | — | — | 10.0 | 0.16 | 13 | — | — | — |
| LNU485 | 63825.1 | — | — | — | 11.0 | 0.02 | 23 | 5.8 | 0.06 | 9 |
| LNU480 | 64018.1 | — | — | — | 10.1 | 0.11 | 13 | 5.7 | 0.14 | 8 |
| LNU455 | 64187.4 | 0.5 | 0.29 | 14 | — | — | — | — | — | — |
| LNU455 | 64189.4 | 0.5 | 0.26 | 4 | — | — | — | — | — | — |
| LNU412 | 63940.8 | 0.5 | 0.02 | 10 | — | — | — | — | — | — |
| LNU322 | 63918.4 | 0.5 | 0.03 | 9 | — | — | — | — | — | — |
| LNU317 | 64097.3 | — | — | — | 10.2 | 0.09 | 14 | 5.7 | 0.09 | 8 |
| LNU305 | 64111.1 | — | — | — | 10.0 | 0.13 | 12 | — | — | — |
| LNU305 | 64115.1 | — | — | — | 10.7 | 0.03 | 20 | 5.6 | 0.21 | 6 |
| CONT. | — | 0.5 | — | — | 8.9 | — | — | 5.3 | — | — |
| LNU485 | 63826.1 | 0.3 | 0.02 | 14 | — | — | — | — | — | — |
| LNU485 | 63828.3 | 0.3 | 0.22 | 11 | — | — | — | — | — | — |
| LNU468 | 63492.2 | 0.3 | 0.11 | 25 | — | — | — | — | — | — |
| LNU462 | 63502.2 | 0.3 | 0.23 | 11 | — | — | — | — | — | — |
| LNU462 | 63503.2 | 0.3 | 0.09 | 24 | — | — | — | — | — | — |
| LNU450 | 63712.3 | 0.3 | 0.03 | 19 | — | — | — | — | — | — |
| LNU448 | 63705.2 | 0.3 | 0.15 | 7 | — | — | — | — | — | — |
| LNU448 | 63705.3 | 0.3 | 0.05 | 11 | — | — | — | — | — | — |
| LNU448 | 63707.2 | 0.3 | 0.11 | 9 | — | — | — | — | — | — |
| LNU429 | 63938.5 | 0.3 | 0.19 | 16 | — | — | — | 4.7 | 0.14 | 10 |
| LNU399 | 63944.2 | 0.3 | 0.24 | 15 | — | — | — | — | — | — |
| LNU395 | 64143.5 | — | — | — | — | — | — | 4.5 | 0.09 | 7 |
| LNU392 | 63698.2 | 0.3 | 0.09 | 8 | — | — | — | — | — | — |
| LNU390 | 63539.3 | 0.3 | 0.25 | 6 | — | — | — | — | — | — |
| LNU375 | 63452.3 | 0.3 | 0.07 | 19 | — | — | — | — | — | — |
| LNU375 | 63454.2 | 0.3 | L | 18 | — | — | — | — | — | — |
| LNU349 | 63989.6 | 0.3 | 0.19 | 10 | — | — | — | — | — | — |
| LNU347 | 63513.3 | 0.3 | 0.02 | 32 | — | — | — | — | — | — |
| LNU329 | 63427.3 | 0.3 | L | 31 | — | — | — | — | — | — |

TABLE 89-continued

Genes showing improved plant performance at Normal growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU329 | 63429.1 | 0.3 | 0.08 | 9 | — | — | — | — | — | — |
| LNU323 | 63421.2 | 0.3 | 0.03 | 13 | — | — | — | — | — | — |
| CONT. | — | 0.3 | — | — | — | — | — | 4.2 | — | — |

Table 89
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

TABLE 90

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LNU460 | 64360.1 | 215.8 | 0.21 | 12 | — | — | — |
| LNU421 | 64303.4 | 204.8 | 0.21 | 6 | — | — | — |
| LNU421 | 64304.3 | 207.3 | 0.09 | 8 | — | — | — |
| LNU408 | 64248.10 | — | — | — | 23.0 | 0.20 | 8 |
| LNU348 | 64472.2 | — | — | — | 26.4 | 0.07 | 24 |
| LNU340 | 64292.5 | 202.0 | 0.25 | 5 | — | — | — |
| LNU331 | 64212.1 | — | — | — | 23.4 | 0.15 | 10 |
| LNU331 | 64215.3 | 202.6 | 0.25 | 5 | — | — | — |
| CONT. | — | 192.8 | — | — | 21.3 | — | — |
| LNU502 | 64038.2 | — | — | — | 22.0 | 0.03 | 7 |
| LNU502 | 64038.5 | — | — | — | 29.6 | 0.29 | 44 |
| LNU502 | 64039.4 | 350.0 | 0.04 | 14 | — | — | — |
| LNU500 | 64222.1 | — | — | — | 25.2 | L | 22 |
| LNU500 | 64223.1 | — | — | — | 21.4 | 0.24 | 4 |
| LNU498 | 64185.3 | 346.1 | 0.02 | 12 | 21.2 | 0.29 | 3 |
| LNU498 | 64186.1 | 366.9 | 0.11 | 19 | 22.3 | 0.06 | 8 |
| LNU493 | 64191.3 | — | — | — | 24.4 | 0.14 | 18 |
| LNU485 | 63825.1 | — | — | — | 27.4 | 0.06 | 33 |
| LNU485 | 63828.3 | — | — | — | 22.2 | 0.03 | 7 |
| LNU455 | 64189.4 | 340.6 | 0.03 | 11 | — | — | — |
| LNU412 | 63940.8 | 337.2 | 0.04 | 9 | — | — | — |
| LNU384 | 64161.6 | — | — | — | 22.6 | 0.22 | 10 |
| LNU371 | 63974.4 | — | — | — | 21.2 | 0.26 | 3 |
| LNU343 | 64208.1 | — | — | — | 21.4 | 0.25 | 4 |
| LNU328 | 64151.1 | — | — | — | 24.3 | L | 18 |
| LNU306 | 64130.7 | — | — | — | 22.3 | 0.19 | 8 |
| LNU306 | 64132.6 | — | — | — | 24.3 | 0.04 | 18 |
| LNU305 | 64115.1 | 373.2 | 0.15 | 21 | 22.2 | 0.28 | 8 |
| CONT. | — | 308.1 | — | — | 20.6 | — | — |
| LNU499 | 64146.12 | — | — | — | 21.0 | 0.06 | 22 |
| LNU499 | 64146.8 | 219.5 | 0.26 | 8 | 19.2 | 0.11 | 11 |
| LNU485 | 63825.1 | — | — | — | 23.0 | 0.15 | 33 |
| LNU485 | 63826.1 | 226.6 | 0.13 | 12 | — | — | — |
| LNU467 | 63716.1 | — | — | — | 19.7 | 0.11 | 14 |
| LNU467 | 63718.2 | 219.7 | 0.26 | 8 | — | — | — |
| LNU462 | 63503.1 | 220.5 | 0.28 | 9 | — | — | — |
| LNU450 | 63708.3 | 246.0 | 0.03 | 21 | — | — | — |
| LNU450 | 63712.3 | 279.6 | L | 38 | — | — | — |
| LNU448 | 63705.3 | 259.6 | 0.22 | 28 | — | — | — |
| LNU448 | 63706.5 | 305.0 | 0.04 | 50 | 18.3 | 0.18 | 6 |
| LNU429 | 63938.5 | 220.5 | 0.23 | 9 | — | — | — |
| LNU416 | 64134.1 | 235.0 | 0.18 | 16 | — | — | — |
| LNU416 | 64134.2 | 224.4 | 0.16 | 11 | — | — | — |
| LNU399 | 63944.2 | 238.6 | 0.15 | 18 | — | — | — |
| LNU399 | 63944.6 | 228.5 | 0.28 | 13 | — | — | — |
| LNU395 | 64145.1 | — | — | — | 21.4 | 0.20 | 23 |
| LNU392 | 63701.2 | — | — | — | 20.7 | 0.12 | 20 |
| LNU347 | 63513.3 | 237.3 | 0.05 | 17 | — | — | — |

TABLE 90-continued

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LNU329 | 63427.3 | 239.9 | 0.04 | 18 | — | — | — |
| CONT. | — | 202.7 | — | — | 17.3 | — | — |

Table 90
"CONT."—Control;
"Ave."—Average;
"% Incr." = % increment;
"p-val."—p-value;
L means that p-value is less than 0.01, p < 0.1 was considered as significant.
The transgenes were under the transcriptional regulation of the new At6669 promoter (SEQ ID NO: 3829).

Example 18

Evaluation of Transgenic Arabidopsis NUE, Yield and Plant Growth Rate Under Low or Normal Nitrogen Fertilization in Greenhouse Assay Assay 2: Nitrogen Use Efficiency Measured Until Bolting Stage: Plant Biomass and Plant Growth Rate at Limited and Optimal Nitrogen Concentration Under Greenhouse Conditions—

This assay follows the plant biomass formation and the rosette area growth of plants grown in the greenhouse at limiting and non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until bolting. Plant biomass (the above ground tissue) was weighted in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the AT6669 promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, leaf blade area.

Vegetative Growth Rate:

The relative growth rate (RGR) of leaf number (Formula XII, described above), rosette area (Formula V described above) and plot coverage (Formula XIX, described above) are calculated using the indicated formulas.

Plant Fresh and Dry Weight—

On about day 80 from sowing, the plants were harvested and directly weight for the determination of the plant fresh weight (FW) and left to dry at 50° C. in a drying chamber for about 48 hours before weighting to determine plant dry weight (DW).

Statistical Analyses—

To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

The genes listed in the following Tables were cloned under the regulation of a constitutive (At6669). The evaluation of each gene was performed by testing the performance of different number of events. Event with p-value<0.1 was considered statistically significant.

The genes listed in Tables 91-92 improved plant NUE when grown at limiting nitrogen concentration levels. These genes produced larger plants with a larger photosynthetic area, biomass (fresh weight, dry weight, leaf number, rosette diameter, rosette area and plot coverage) when grown under limiting nitrogen conditions.

TABLE 91

Genes showing improved plant biomass production at limiting nitrogen growth conditions

| Gene Name | Event # | Dry Weight [mg] Ave. | P-Val. | % Incr. | Fresh Weight [mg] Ave. | P-Val | % Incr. | Leaf Number Ave. | P-Val | % Incr. |
|---|---|---|---|---|---|---|---|---|---|---|
| LNU507 | 64087.1 | — | — | — | — | — | — | 9.6 | 0.17 | 4 |
| LNU507 | 64584.2 | — | — | — | 237.5 | 0.12 | 11 | — | — | — |
| LNU479 | 65497.2 | 30.6 | 0.06 | 35 | 268.8 | L | 25 | — | — | — |
| LNU479 | 65499.1 | — | — | — | 262.5 | 0.07 | 22 | 9.7 | 0.09 | 5 |
| LNU423 | 64102.1 | 25.0 | 0.19 | 10 | — | — | — | — | — | — |
| LNU418 | 65025.1 | — | — | — | — | — | — | 9.8 | 0.09 | 6 |
| LNU418 | 65027.2 | — | — | — | — | — | — | 9.8 | 0.22 | 6 |
| LNU418 | 65028.2 | — | — | — | — | — | — | 9.8 | 0.09 | 6 |
| LNU401 | 65493.2 | — | — | — | 231.2 | 0.27 | 8 | — | — | — |
| LNU377 | 64603.2 | — | — | — | 231.2 | 0.27 | 8 | — | — | — |
| LNU344 | 63520.4 | 28.1 | 0.02 | 24 | — | — | — | 9.5 | 0.27 | 3 |
| LNU337 | 64952.1 | 27.5 | 0.26 | 21 | 262.5 | 0.01 | 22 | — | — | — |
| LNU333 | 65295.1 | — | — | — | — | — | — | 9.8 | 0.04 | 6 |
| LNU333 | 65297.1 | 25.0 | 0.19 | 10 | — | — | — | — | — | — |
| LNU304 | 64573.1 | 25.4 | 0.14 | 12 | — | — | — | — | — | — |
| CONT. | — | 22.7 | — | — | 214.6 | — | — | 9.2 | — | — |
| LNU494 | 65302.1 | 25.6 | 0.12 | 28 | 206.2 | 0.18 | 18 | — | — | — |
| LNU479 | 65499.1 | 25.0 | 0.08 | 25 | 206.2 | 0.18 | 18 | 12.2 | 0.15 | 5 |
| LNU423 | 64596.1 | — | — | — | — | — | — | 13.2 | 0.05 | 14 |
| LNU423 | 64598.3 | 24.4 | 0.19 | 22 | — | — | — | 12.0 | 0.29 | 3 |
| LNU418 | 65024.2 | 31.9 | 0.09 | 59 | 275.0 | 0.07 | 57 | — | — | — |
| LNU388 | 65487.1 | 26.2 | 0.16 | 31 | 206.2 | 0.18 | 18 | — | — | — |
| LNU388 | 65487.2 | — | — | — | — | — | — | 12.2 | 0.28 | 5 |
| LNU377 | 64604.3 | — | — | — | — | — | — | 12.9 | 0.01 | 11 |
| LNU339 | 65056.1 | — | — | — | — | — | — | 12.8 | 0.06 | 10 |
| LNU339 | 65058.2 | — | — | — | — | — | — | 12.2 | 0.19 | 6 |
| LNU337 | 64955.2 | 23.8 | 0.17 | 19 | — | — | — | — | — | — |
| LNU333 | 65295.1 | 24.4 | 0.19 | 22 | — | — | — | — | — | — |
| LNU333 | 65295.2 | 22.5 | 0.27 | 12 | — | — | — | — | — | — |
| LNU333 | 65297.1 | — | — | — | — | — | — | 13.1 | 0.13 | 13 |
| LNU324 | 64233.7 | — | — | — | — | — | — | 12.4 | 0.08 | 7 |
| LNU292 | 64085.2 | 23.8 | 0.17 | 19 | 225.0 | 0.08 | 29 | — | — | — |
| CONT. | — | 20.0 | — | — | 175.0 | — | — | 11.6 | — | — |
| LNU519 | 64679.1 | — | — | — | 264.3 | 0.16 | 11 | — | — | — |
| LNU508 | 64457.2 | — | — | — | 256.2 | 0.30 | 8 | — | — | — |
| LNU469 | 64308.4 | — | — | — | 300.0 | 0.03 | 26 | — | — | — |
| LNU469 | 64311.5 | — | — | — | — | — | — | 9.8 | 0.09 | 4 |
| LNU460 | 64359.3 | — | — | — | 287.5 | 0.06 | 21 | — | — | — |
| LNU460 | 64360.1 | 45.6 | 0.04 | 26 | — | — | — | — | — | — |
| LNU460 | 64361.4 | 45.0 | 0.08 | 24 | 306.2 | 0.23 | 29 | — | — | — |
| LNU459 | 64541.4 | 48.1 | 0.24 | 33 | 300.0 | L | 26 | — | — | — |
| LNU459 | 64542.4 | — | — | — | — | — | — | 10.1 | 0.08 | 8 |
| LNU442 | 64056.1 | — | — | — | 300.0 | 0.18 | 26 | — | — | — |
| LNU442 | 64057.1 | 48.8 | 0.18 | 34 | — | — | — | — | — | — |
| LNU439 | 64615.2 | — | — | — | 267.0 | 0.11 | 12 | — | — | — |
| LNU439 | 64615.4 | 40.0 | 0.27 | 10 | — | — | — | — | — | — |
| LNU439 | 64616.2 | — | — | — | 262.5 | 0.27 | 11 | — | — | — |
| LNU439 | 64618.3 | 40.6 | 0.18 | 12 | 287.5 | 0.24 | 21 | — | — | — |
| LNU421 | 64303.3 | — | — | — | 275.0 | 0.12 | 16 | 9.8 | 0.09 | 4 |
| LNU421 | 04303.4 | — | — | — | — | — | — | 9.9 | 0.05 | 6 |
| LNU421 | 64304.4 | — | — | — | 293.8 | 0.12 | 24 | 10.2 | L | 10 |
| LNU420 | 64006.3 | 46.2 | 0.15 | 28 | 287.5 | 0.24 | 21 | — | — | — |
| LNU420 | 64009.1 | — | — | — | 295.5 | 0.29 | 24 | — | — | — |
| LNU409 | 64688.2 | — | — | — | 267.9 | 0.30 | 13 | — | — | — |
| LNU409 | 64689.3 | 46.4 | 0.13 | 28 | — | — | — | — | — | — |
| LNU408 | 64248.16 | — | — | — | 281.2 | 0.18 | 18 | — | — | — |
| LNU408 | 64249.4 | — | — | — | — | — | — | 9.6 | 0.19 | 3 |
| LNU368 | 64003.1 | 45.0 | 0.08 | 24 | — | — | — | — | — | — |
| LNU368 | 64004.2 | — | — | — | 262.5 | 0.16 | 11 | — | — | — |
| LNU368 | 64004.3 | — | — | — | — | — | — | 9.6 | 0.18 | 2 |
| LNU363 | 64410.1 | — | — | — | 293.8 | 0.01 | 24 | 10.3 | 0.15 | 10 |
| LNU363 | 64411.2 | — | — | — | 306.2 | L | 29 | — | — | — |
| LNU363 | 64413.2 | 53.1 | L | 47 | 293.8 | 0.12 | 24 | 9.6 | 0.19 | 3 |
| LNU331 | 64214.2 | — | — | — | 275.0 | 0.12 | 16 | — | — | — |
| LNU331 | 64215.1 | — | — | — | 256.2 | 0.30 | 8 | — | — | — |
| LNU331 | 64215.3 | 45.0 | 0.03 | 24 | 312.5 | L | 32 | 10.0 | 0.17 | 7 |

TABLE 91-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val | % Incr. |
| LNU316 | 64564.5 | 40.6 | 0.18 | 12 | — | — | — | — | — | — |
| LNU314 | 64434.2 | 41.9 | 0.10 | 16 | — | — | — | 9.9 | 0.11 | 6 |
| LNU290 | 64369.6 | — | — | — | 262.5 | 0.27 | 11 | — | — | — |
| CONT. | — | 36.2 | — | — | 237.5 | — | — | 9.3 | — | — |
| LNU509 | 64692.3 | — | — | — | — | — | — | 9.5 | 0.20 | 3 |
| LNU509 | 64692.6 | — | — | — | — | — | — | 9.5 | 0.20 | 3 |
| LNU504 | 64453.2 | — | — | — | — | — | — | 9.7 | 0.15 | 5 |
| LNU501 | 64197.1 | — | — | — | — | — | — | 9.6 | 0.24 | 4 |
| LNU397 | 64376.4 | — | — | — | — | — | — | 9.5 | 0.20 | 3 |
| LNU396 | 64315.15 | 84.4 | 0.25 | 81 | — | — | — | — | — | — |
| LNU396 | 64317.4 | — | — | — | — | — | — | 9.6 | 0.24 | 4 |
| CONT. | — | 46.7 | — | — | — | — | — | — | — | — |
| LNU513 | 63458.2 | 106.3 | 0.06 | 24 | 963.4 | 0.11 | 19 | — | — | — |
| LNU513 | 63459.2 | 99.4 | 0.02 | 16 | 868.8 | 0.30 | 7 | 9.6 | 0.07 | 4 |
| LNU512 | 63468.3 | 106.8 | L | 25 | — | — | — | — | — | — |
| LNU512 | 63468.4 | — | — | — | — | — | — | 9.4 | 0.19 | 3 |
| LNU512 | 63470.1 | 98.8 | 0.08 | 16 | — | — | — | — | — | — |
| LNU512 | 63471.3 | 100.6 | 0.01 | 18 | 893.8 | 0.21 | 10 | 9.6 | 0.23 | 4 |
| LNU512 | 63471.4 | 93.8 | 0.13 | 10 | — | — | — | 9.7 | 0.03 | 5 |
| LNU451 | 63496.2 | — | — | — | — | — | — | 9.4 | 0.29 | 2 |
| LNU451 | 63497.5 | — | — | — | — | — | — | 9.5 | 0.19 | 3 |
| LNU451 | 63499.1 | 98.1 | 0.12 | 15 | — | — | — | — | — | — |
| LNU451 | 63499.5 | 120.0 | L | 40 | 1018.8 | L | 25 | — | — | — |
| LNU451 | 63500.1 | 106.9 | 0.04 | 25 | — | — | — | — | — | — |
| LNU424 | 63474.3 | 97.5 | 0.25 | 14 | 868.8 | 0.30 | 7 | — | — | — |
| LNU424 | 63476.3 | — | — | — | — | — | — | 9.5 | 0.19 | 3 |
| LNU424 | 63477.2 | — | — | — | — | — | — | 9.7 | 0.15 | 5 |
| LNU415 | 63692.1 | — | — | — | — | — | — | 9.6 | 0.09 | 5 |
| LNU415 | 63692.3 | 94.3 | 0.13 | 10 | — | — | — | — | — | — |
| LNU411 | 63514.3 | 108.8 | L | 27 | 987.5 | 0.01 | 22 | — | — | — |
| LNU411 | 63515.3 | 103.8 | L | 21 | 881.2 | 0.22 | 8 | — | — | — |
| LNU411 | 63518.1 | — | — | — | 956.2 | 0.03 | 18 | — | — | — |
| LNU375 | 63451.3 | 111.9 | 0.06 | 31 | 1000.0 | 0.07 | 23 | — | — | — |
| LNU375 | 63452.2 | 114.6 | L | 34 | 971.4 | 0.03 | 20 | — | — | — |
| LNU375 | 63454.1 | 103.1 | 0.02 | 21 | 943.8 | 0.04 | 16 | 9.6 | 0.23 | 4 |
| LNU375 | 63454.2 | 113.8 | L | 33 | 1050.0 | L | 29 | — | — | — |
| LNU370 | 63544.3 | 105.0 | L | 23 | 937.5 | 0.16 | 15 | — | — | — |
| LNU370 | 63545.6 | 107.5 | 0.20 | 26 | 1006.3 | L | 24 | — | — | — |
| LNU370 | 63548.2 | 101.4 | L | 19 | 912.5 | 0.10 | 12 | — | — | — |
| LNU357 | 63533.1 | 97.5 | 0.03 | 14 | — | — | — | — | — | — |
| LNU357 | 63533.8 | 109.4 | L | 28 | 900.0 | 0.16 | 11 | 9.8 | 0.09 | 7 |
| LNU357 | 63534.1 | 105.6 | 0.19 | 24 | 943.8 | 0.18 | 16 | 9.5 | 0.19 | 3 |
| LNU356 | 63444.1 | 97.5 | 0.03 | 14 | — | — | — | — | — | — |
| LNU356 | 63444.2 | 96.9 | 0.03 | 13 | — | — | — | — | — | — |
| LNU356 | 63445.1 | 104.4 | 0.02 | 22 | — | — | — | — | — | — |
| LNU351 | 63462.3 | 107.5 | 0.24 | 26 | 943.8 | 0.04 | 16 | — | — | — |
| LNU351 | 63463.2 | 105.0 | 0.03 | 23 | 868.8 | 0.30 | 7 | — | — | — |
| LNU351 | 63464.1 | — | — | — | — | — | — | 9.8 | 0.04 | 6 |
| LNU351 | 63466.1 | — | — | — | — | — | — | 9.6 | 0.07 | 4 |
| LNU344 | 63520.2 | 93.1 | 0.28 | 9 | — | — | — | — | — | — |
| LNU344 | 63521.1 | 98.1 | 0.12 | 15 | — | — | — | — | — | — |
| LNU330 | 63438.1 | 104.4 | 0.10 | 22 | — | — | — | — | — | — |
| LNU330 | 63440.2 | 98.1 | 0.02 | 15 | — | — | — | — | — | — |
| LNU330 | 63441.1 | — | — | — | — | — | — | 9.6 | 0.07 | 4 |
| LNU326 | 63435.1 | 105.6 | 0.01 | 24 | 987.5 | 0.04 | 22 | 9.7 | 0.03 | 5 |
| LNU326 | 63436.1 | 99.4 | 0.17 | 16 | 893.8 | 0.15 | 10 | — | — | — |
| LNU319 | 63527.1 | 99.4 | 0.30 | 16 | 893.8 | 0.21 | 10 | — | — | — |
| LNU319 | 63527.2 | — | — | — | — | — | — | 9.5 | 0.10 | 3 |
| LNU319 | 63530.3 | 118.7 | 0.15 | 39 | 998.2 | 0.17 | 23 | — | — | — |
| LNU308 | 63414.1 | 100.6 | 0.08 | 18 | — | — | — | — | — | — |
| LNU308 | 63414.4 | 106.9 | 0.22 | 25 | 943.8 | 0.04 | 16 | — | — | — |
| LNU308 | 63417.5 | 115.6 | 0.15 | 35 | — | — | — | 9.7 | 0.03 | 5 |
| LNU308 | 63417.8 | — | — | — | 977.7 | 0.16 | 20 | — | — | — |
| LNU302 | 63378.3 | 108.1 | 0.07 | 27 | 968.8 | 0.13 | 19 | — | — | — |
| LNU302 | 63380.1 | 118.8 | 0.12 | 39 | 1045.5 | L | 29 | — | — | — |
| LNU302 | 63381.1 | 111.9 | L | 31 | 1000.0 | 0.03 | 23 | — | — | — |
| LNU302 | 63382.2 | 111.9 | L | 31 | 931.2 | 0.06 | 15 | 9.5 | 0.10 | 3 |
| LNU291 | 63385.2 | 101.9 | 0.03 | 19 | 975.0 | 0.05 | 20 | 9.7 | 0.03 | 5 |
| LNU291 | 63387.1 | 93.8 | 0.09 | 10 | — | — | — | 10.1 | L | 10 |
| LNU291 | 63387.3 | — | — | — | 943.8 | 0.18 | 16 | 9.8 | 0.04 | 6 |
| LNU291 | 63388.1 | 118.8 | L | 39 | 1062.5 | L | 31 | 9.6 | 0.23 | 4 |
| CONT. | — | 85.4 | — | — | 812.5 | — | — | 9.2 | — | — |
| LNU482 | 64165.5 | — | — | — | — | — | — | 9.8 | 0.12 | 4 |
| LNU469 | 64313.9 | 41.9 | 0.17 | 12 | 350.0 | 0.23 | 9 | — | — | — |

TABLE 91-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val | % Incr. |
| LNU444 | 64182.3 | — | — | — | 368.8 | 0.16 | 15 | 10.1 | 0.03 | 7 |
| LNU444 | 64183.1 | — | — | — | 350.0 | 0.23 | 9 | — | — | — |
| LNU442 | 64056.1 | — | — | — | 375.0 | 0.05 | 17 | — | — | — |
| LNU442 | 64553.1 | — | — | — | — | — | — | 10.2 | 0.06 | 8 |
| LNU442 | 64555.1 | — | — | — | — | — | — | 9.9 | 0.05 | 5 |
| LNU430 | 63935.1 | 43.8 | 0.03 | 17 | 375.0 | 0.21 | 17 | — | — | — |
| LNU430 | 63935.4 | — | — | — | — | — | — | 9.9 | 0.11 | 5 |
| LNU430 | 63936.2 | — | — | — | — | — | — | 10.0 | 0.03 | 6 |
| LNU391 | 63979.3 | — | — | — | — | — | — | 9.8 | 0.12 | 4 |
| LNU391 | 63980.3 | 43.1 | 0.27 | 16 | 356.2 | 0.10 | 11 | 10.2 | 0.10 | 9 |
| LNU376 | 63986.8 | — | — | — | — | — | — | 9.9 | 0.11 | 5 |
| LNU366 | 64028.3 | — | — | — | 381.2 | 0.02 | 19 | 10.4 | 0.12 | 11 |
| LNU314 | 64433.3 | — | — | — | 381.2 | 0.10 | 19 | — | — | — |
| LNU314 | 64437.2 | — | — | — | 368.8 | 0.04 | 15 | 9.9 | 0.05 | 5 |
| CONT. | — | 37.3 | — | — | 320.8 | — | — | 9.4 | — | — |
| LNU511 | 65037.1 | — | — | — | — | — | — | 11.4 | 0.12 | 11 |
| LNU492 | 64176.4 | — | — | — | 187.5 | 0.15 | 8 | 11.4 | 0.12 | 11 |
| LNU463 | 64283.4 | — | — | — | 237.5 | 0.05 | 37 | 12.2 | 0.03 | 18 |
| LNU463 | 64283.5 | — | — | — | 200.0 | 0.22 | 15 | — | — | — |
| LNU454 | 64796.2 | — | — | — | — | — | — | 11.1 | 0.27 | 7 |
| LNU454 | 64796.3 | — | — | — | 193.8 | 0.11 | 11 | 11.2 | 0.20 | 9 |
| LNU454 | 64799.2 | — | — | — | — | — | — | 11.8 | 0.14 | 14 |
| LNU454 | 64800.5 | — | — | — | — | — | — | 11.1 | 0.27 | 7 |
| LNU413 | 65022.4 | 25.6 | 0.24 | 62 | — | — | — | 11.4 | 0.14 | 10 |
| LNU410 | 64971.2 | — | — | — | 187.5 | 0.15 | 8 | — | — | — |
| LNU387 | 64808.1 | — | — | — | — | — | — | 11.4 | 0.15 | 11 |
| LNU373 | 64826.4 | 21.2 | 0.21 | 34 | — | — | — | — | — | — |
| LNU373 | 64830.1 | 23.1 | L | 46 | — | — | — | — | — | — |
| LNU361 | 64835.2 | — | — | — | 193.8 | 0.11 | 11 | — | — | — |
| LNU355 | 65012.1 | — | — | — | — | — | — | 11.1 | 0.28 | 7 |
| LNU355 | 65015.2 | — | — | — | 218.8 | L | 26 | 12.1 | 0.03 | 17 |
| LNU332 | 64823.2 | — | — | — | — | — | — | 11.6 | 0.09 | 12 |
| LNU307 | 64958.2 | — | — | — | 187.5 | 0.15 | 8 | — | — | — |
| LNU307 | 64962.2 | 18.6 | 0.27 | 18 | 199.1 | 0.26 | 15 | — | — | — |
| LNU300 | 65030.2 | — | — | — | — | — | — | 11.1 | 0.24 | 8 |
| LNU300 | 65033.3 | 20.0 | 0.30 | 27 | — | — | — | — | — | — |
| CONT. | — | 15.8 | — | — | 173.8 | — | — | 10.3 | — | — |
| LNU517 | 64296.3 | 40.0 | 0.23 | 19 | 300.0 | 0.25 | 19 | 10.1 | L | 10 |
| LNU517 | 64297.9 | — | — | — | 287.5 | 0.12 | 14 | — | — | — |
| LNU514 | 64364.2 | — | — | — | 312.5 | 0.04 | 24 | — | — | — |
| LNU514 | 64365.3 | — | — | — | 325.0 | 0.02 | 29 | 10.1 | 0.17 | 9 |
| LNU514 | 64366.1 | — | — | — | 331.2 | 0.05 | 31 | — | — | — |
| LNU509 | 64640.3 | — | — | — | 300.0 | 0.09 | 19 | 9.9 | 0.03 | 7 |
| LNU509 | 64690.6 | — | — | — | — | — | — | 9.6 | 0.08 | 4 |
| LNU509 | 64692.3 | 47.5 | 0.04 | 41 | — | — | — | — | — | — |
| LNU509 | 64692.6 | — | — | — | 300.0 | 0.09 | 19 | — | — | — |
| LNU501 | 64197.1 | 45.6 | 0.18 | 35 | 300.0 | 0.13 | 19 | 9.6 | 0.15 | 5 |
| LNU501 | 64197.3 | — | — | — | 325.0 | 0.02 | 29 | — | — | — |
| LNU501 | 64723.1 | 41.9 | 0.28 | 24 | — | — | — | — | — | — |
| LNU461 | 64666.1 | 43.1 | 0.10 | 28 | — | — | — | — | — | — |
| LNU397 | 64375.1 | 50.6 | 0.18 | 50 | 312.5 | 0.04 | 24 | — | — | — |
| LNU396 | 64315.13 | — | — | — | — | — | — | 9.4 | 0.22 | 2 |
| LNU396 | 64315.16 | — | — | — | 300.0 | 0.25 | 19 | — | — | — |
| LNU396 | 64317.3 | — | — | — | 331.2 | 0.29 | 31 | — | — | — |
| LNU396 | 64317.4 | — | — | — | — | — | — | 9.8 | 0.22 | 6 |
| LNU386 | 64394.3 | — | — | — | — | — | — | 9.6 | 0.26 | 4 |
| LNU381 | 64285.5 | — | — | — | — | — | — | 9.9 | 0.30 | 7 |
| LNU372 | 64483.3 | — | — | — | 306.2 | 0.04 | 21 | 9.7 | 0.16 | 5 |
| LNU369 | 64386.1 | 43.8 | 0.08 | 30 | 293.8 | 0.08 | 17 | — | — | — |
| LNU369 | 64387.1 | 42.5 | 0.21 | 26 | 306.2 | 0.12 | 21 | — | — | — |
| LNU369 | 64387.2 | — | — | — | 325.0 | 0.02 | 29 | 10.1 | L | 9 |
| LNU369 | 64389.2 | — | — | — | 300.0 | 0.09 | 19 | 9.8 | 0.05 | 6 |
| LNU365 | 64708.1 | — | — | — | 305.4 | 0.14 | 21 | — | — | — |
| LNU365 | 64711.3 | — | — | — | — | — | — | 10.1 | 0.30 | 10 |
| LNU350 | 64674.4 | — | — | — | 337.5 | 0.21 | 34 | — | — | — |
| LNU350 | 64676.2 | — | — | — | 281.2 | 0.20 | 12 | — | — | — |
| LNU350 | 64677.2 | 40.0 | 0.27 | 19 | 306.2 | 0.29 | 21 | — | — | — |
| LNU342 | 64035.3 | — | — | — | 306.2 | 0.12 | 21 | — | — | — |
| LNU342 | 64035.8 | 40.0 | 0.23 | 19 | 312.5 | 0.04 | 24 | — | — | — |
| LNU313 | 64661.8 | — | — | — | 331.2 | 0.05 | 31 | — | — | — |
| LNU313 | 64663.2 | — | — | — | — | — | — | 9.9 | L | 7 |
| LNU313 | 64664.1 | 46.2 | 0.05 | 37 | 325.0 | 0.02 | 29 | — | — | — |
| LNU313 | 64664.3 | — | — | — | 281.2 | 0.20 | 12 | — | — | — |
| LNU294 | 64658.7 | 40.6 | 0.27 | 20 | — | — | — | — | — | — |

TABLE 91-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val | % Incr. |
| CONT. | — | 33.8 | — | — | 252.1 | — | — | 9.2 | — | — |
| LNU472 | 63949.8 | — | — | — | — | — | — | 9.6 | 0.26 | 4 |
| LNU458 | 63893.1 | 33.8 | 0.13 | 46 | — | — | — | — | — | — |
| LNU425 | 63911.12 | — | — | — | — | — | — | 9.4 | 0.07 | 3 |
| LNU419 | 63896.2 | — | — | — | 250.0 | 0.27 | 7 | 9.5 | 0.17 | 3 |
| LNU403 | 64237.1 | — | — | — | 268.8 | 0.04 | 15 | | | |
| LNU393 | 63978.6 | — | — | — | 262.5 | 0.06 | 12 | | | |
| LNU374 | 63997.2 | — | — | — | — | — | — | 9.6 | 0.01 | 4 |
| LNU371 | 63974.4 | — | — | — | — | — | — | 9.7 | 0.18 | 5 |
| LNU335 | 64169.2 | — | — | — | 262.5 | 0.20 | 12 | — | — | — |
| CONT. | — | 23.1 | — | — | 234.4 | — | — | 9.2 | — | — |
| LNU520 | 64157.4 | — | — | — | — | — | — | 9.2 | 0.25 | 3 |
| LNU518 | 64014.5 | — | — | — | — | — | — | 9.2 | 0.29 | 3 |
| LNU518 | 64016.4 | — | — | — | — | — | — | 9.5 | 0.20 | 6 |
| LNU500 | 64221.6 | 38.1 | 0.02 | 29 | — | — | — | 9.7 | 0.06 | 8 |
| LNU496 | 64195.1 | — | — | — | — | — | — | 9.9 | 0.12 | 11 |
| LNU493 | 64190.1 | — | — | — | — | — | — | 9.3 | 0.25 | 4 |
| LNU493 | 64191.3 | — | — | — | — | — | — | 9.6 | 0.03 | 8 |
| LNU481 | 64140.1 | — | — | — | — | — | — | 9.6 | 0.09 | 7 |
| LNU472 | 63919.5 | — | — | — | — | — | — | 9.2 | 0.29 | 3 |
| LNU472 | 63949.7 | 35.6 | 0.06 | 20 | — | — | — | — | — | — |
| LNU458 | 63894.3 | — | — | — | — | — | — | 9.8 | 0.04 | 10 |
| LNU458 | 63895.1 | — | — | — | — | — | — | 9.4 | 0.06 | 6 |
| LNU419 | 63896.2 | 46.2 | 0.07 | 56 | — | — | — | 9.4 | 0.28 | 5 |
| LNU419 | 63897.6 | 33.2 | 0.29 | 12 | — | — | — | — | — | — |
| LNU405 | 64159.8 | 38.8 | 0.07 | 31 | — | — | — | — | — | — |
| LNU343 | 64208.2 | 35.9 | 0.08 | 21 | — | — | — | — | — | — |
| LNU340 | 64290.7 | — | — | — | 237.5 | 0.18 | 10 | — | — | — |
| LNU328 | 64150.4 | 39.4 | 0.30 | 33 | 237.5 | 0.18 | 10 | — | — | — |
| LNU327 | 64491.2 | 45.0 | L | 52 | 268.8 | 0.01 | 24 | — | — | — |
| LNU322 | 63917.2 | 38.8 | 0.28 | 31 | — | — | — | — | — | — |
| LNU322 | 63918.1 | 43.1 | L | 46 | — | — | — | — | — | — |
| LNU322 | 63918.3 | — | — | — | — | — | — | 9.3 | 0.25 | 4 |
| LNU306 | 64132.1 | — | — | — | — | — | — | 9.3 | 0.13 | 4 |
| LNU305 | 64111.1 | 41.9 | 0.16 | 42 | — | — | — | 9.2 | 0.19 | 3 |
| LNU305 | 64111.3 | — | — | — | 237.5 | 0.18 | 10 | 9.6 | 0.27 | 8 |
| LNU305 | 64114.1 | — | — | — | — | — | — | 9.2 | 0.29 | 3 |
| CONT. | — | 29.6 | — | — | 216.1 | — | — | 8.9 | — | — |
| LNU503 | 64203.3 | 83.1 | 0.23 | 9 | 606.2 | 0.23 | 7 | — | — | — |
| LNU503 | 64203.5 | — | — | — | 781.2 | 0.25 | 38 | — | — | — |
| LNU502 | 64038.5 | — | — | — | — | — | — | 10.9 | 0.21 | 5 |
| LNU502 | 64040.4 | 108.8 | 0.29 | 42 | 756.2 | 0.09 | 33 | — | — | — |
| LNU482 | 64164.8 | — | — | — | 637.5 | 0.13 | 12 | — | — | — |
| LNU480 | 64018.3 | 103.8 | 0.19 | 36 | — | — | — | — | — | — |
| LNU444 | 64181.1 | — | — | — | — | — | — | 11.0 | 0.26 | 7 |
| LNU444 | 64181.2 | 108.1 | L | 41 | 693.8 | L | 22 | 10.8 | 0.20 | 5 |
| LNU444 | 64182.3 | 86.9 | 0.09 | 14 | — | — | — | — | — | — |
| LNU430 | 63934.3 | 83.1 | 0.23 | 9 | 662.5 | 0.18 | 17 | — | — | — |
| LNU430 | 63935.1 | 90.6 | L | 19 | 656.2 | 0.25 | 16 | — | — | — |
| LNU430 | 63936.1 | 94.4 | L | 23 | — | — | — | — | — | — |
| LNU430 | 63952.1 | 115.6 | 0.25 | 51 | 806.2 | L | 42 | — | — | — |
| LNU403 | 64236.3 | — | — | — | 606.2 | 0.23 | 7 | — | — | — |
| LNU403 | 64237.1 | — | — | — | 681.2 | 0.09 | 20 | — | — | — |
| LNU403 | 64239.1 | 86.9 | 0.09 | 14 | 643.8 | 0.29 | 14 | — | — | — |
| LNU393 | 63976.2 | 90.0 | 0.29 | 18 | 637.5 | 0.13 | 12 | — | — | — |
| LNU393 | 63977.3 | 98.1 | 0.04 | 28 | 706.2 | 0.07 | 25 | — | — | — |
| LNU393 | 63977.6 | 96.2 | 0.27 | 26 | 693.8 | 0.08 | 22 | — | — | — |
| LNU391 | 63980.6 | 80.6 | 0.28 | 5 | — | — | — | — | — | — |
| LNU385 | 64246.3 | — | — | — | 797.3 | 0.06 | 41 | — | — | — |
| LNU376 | 63985.1 | 93.1 | 0.08 | 22 | 681.2 | 0.09 | 20 | — | — | — |
| LNU376 | 63987.2 | 101.9 | 1 | 33 | 712.5 | 0.10 | 26 | — | — | — |
| LNU374 | 63997.2 | 96.9 | 0.05 | 27 | 700.0 | L | 24 | — | — | — |
| LNU374 | 63997.4 | 86.2 | 0.04 | 13 | 687.5 | L | 21 | — | — | — |
| LNU366 | 64027.2 | 91.9 | 0.16 | 20 | — | — | — | — | — | — |
| LNU366 | 64027.7 | — | — | — | 643.8 | 0.18 | 14 | — | — | — |
| LNU366 | 64028.3 | 107.5 | 0.22 | 41 | 762.5 | 0.01 | 35 | — | — | — |
| LNU353 | 64033.2 | 91.2 | L | 19 | 656.2 | 0.04 | 16 | — | — | — |
| LNU353 | 64033.3 | 91.2 | 0.26 | 19 | 687.5 | 0.04 | 21 | — | — | — |
| LNU352 | 64199.1 | — | — | — | 700.0 | 0.03 | 24 | — | — | — |
| LNU352 | 64200.10 | 128.1 | 0.06 | 68 | 850.0 | L | 50 | 11.2 | 0.05 | 8 |
| LNU352 | 64201.1 | 91.2 | L | 19 | 681.2 | L | 20 | — | — | — |
| LNU335 | 64168.18 | 98.1 | 0.23 | 28 | 756.2 | 0.15 | 33 | 10.7 | 0.25 | 4 |
| LNU335 | 64168.19 | 150.0 | L | 96 | 950.0 | L | 68 | 10.9 | 0.12 | 5 |
| LNU317 | 64094.1 | 82.5 | 0.14 | 8 | — | — | — | — | — | — |

TABLE 91-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val | % Incr. |
| LNU317 | 64097.2 | — | — | — | 593.8 | 0.26 | 5 | — | — | — |
| CONT. | — | 76.5 | — | — | 566.7 | — | — | 10.3 | — | — |
| LNU499 | 64146.12 | 133.8 | 0.25 | 28 | 968.8 | 0.05 | 14 | — | — | — |
| LNU499 | 64146.8 | — | — | — | 925.0 | 0.19 | 9 | — | — | — |
| LNU468 | 63492.2 | — | — | — | 906.2 | 0.29 | 6 | 11.5 | 0.28 | 4 |
| LNU467 | 63718.2 | 116.2 | 0.28 | 11 | — | — | — | — | — | — |
| LNU462 | 63502.2 | — | — | — | — | — | — | 12.2 | 0.16 | 11 |
| LNU462 | 63505.1 | — | — | — | — | — | — | 11.3 | 0.15 | 2 |
| LNU455 | 64187.4 | — | — | — | — | — | — | 11.7 | 0.10 | 6 |
| LNU450 | 63708.6 | 126.9 | 0.12 | 21 | — | — | — | — | — | — |
| LNU450 | 63709.4 | 151.2 | 0.09 | 44 | 968.8 | 0.30 | 14 | — | — | — |
| LNU450 | 63710.2 | — | — | — | — | — | — | 11.6 | 0.04 | 5 |
| LNU448 | 63706.5 | 130.0 | 0.16 | 24 | 993.8 | 0.23 | 17 | — | — | — |
| LNU429 | 63937.4 | 129.4 | 0.07 | 24 | 962.5 | 0.28 | 13 | — | — | — |
| LNU402 | 63914.2 | — | — | — | — | — | — | 11.8 | L | 7 |
| LNU399 | 63944.6 | 141.9 | 0.11 | 35 | — | — | — | — | — | — |
| LNU395 | 64142.8 | 124.4 | 0.13 | 19 | 1018.8 | 0.03 | 20 | — | — | — |
| LNU392 | 63696.2 | 141.9 | 0.01 | 35 | 962.5 | 0.05 | 13 | — | — | — |
| LNU392 | 63698.2 | 135.6 | 0.10 | 29 | — | — | — | — | — | — |
| LNU392 | 63700.3 | 148.1 | 0.20 | 41 | — | — | — | 11.2 | 0.23 | 2 |
| LNU349 | 63989.1 | 125.0 | 0.09 | 19 | — | — | — | — | — | — |
| LNU349 | 63989.5 | — | — | — | 937.5 | 0.21 | 10 | — | — | — |
| LNU347 | 63508.1 | — | — | — | — | — | — | 11.6 | 0.02 | 5 |
| LNU347 | 63510.4 | — | — | — | 925.0 | 0.27 | 9 | 11.6 | 0.21 | 5 |
| LNU347 | 63513.3 | 122.5 | 0.15 | 17 | 987.5 | 0.03 | 16 | — | — | — |
| LNU329 | 63429.1 | 178.1 | 0.03 | 70 | 1112.5 | 0.01 | 30 | 11.9 | 0.17 | 8 |
| LNU323 | 63421.4 | 131.9 | 0.04 | 26 | 1043.8 | L | 22 | 11.4 | 0.23 | 4 |
| LNU323 | 63424.1 | 150.6 | 0.02 | 44 | — | — | — | — | — | — |
| CONT. | — | 104.8 | — | — | 852.5 | — | — | 11.1 | — | — |
| LNU511 | 65038.1 | 30.6 | 0.08 | 28 | — | — | — | — | — | — |
| LNU492 | 64174.1 | — | — | — | 250.0 | 0.01 | 19 | — | — | — |
| LNU471 | 64838.1 | — | — | — | 231.2 | 0.14 | 10 | 9.8 | 0.09 | 8 |
| LNU413 | 65022.4 | — | — | — | 243.8 | 0.04 | 16 | — | — | — |
| LNU410 | 64971.1 | 28.1 | 0.13 | 17 | 237.5 | 0.05 | 13 | — | — | — |
| LNU410 | 64973.2 | — | — | — | — | — | — | 9.4 | 0.08 | 3 |
| LNU387 | 64810.4 | — | — | — | 225.0 | 0.22 | 7 | 9.3 | 0.25 | 2 |
| LNU382 | 64429.3 | — | — | — | 231.2 | 0.14 | 10 | 9.6 | 0.06 | 5 |
| LNU373 | 64828.1 | — | — | — | — | — | — | 9.6 | 0.02 | 5 |
| LNU373 | 64830.1 | 34.4 | 0.02 | 43 | 256.2 | 0.01 | 22 | — | — | — |
| LNU355 | 65013.2 | — | — | — | — | — | — | 9.5 | 0.04 | 4 |
| LNU307 | 64958.2 | — | — | — | 231.2 | 0.14 | 10 | 9.4 | 0.08 | 3 |
| LNU307 | 64959.2 | — | — | — | 243.8 | 0.28 | 16 | — | — | — |
| LNU303 | 65043.1 | — | — | — | 237.5 | 0.05 | 13 | 9.6 | 0.25 | 5 |
| LNU303 | 65046.3 | — | — | — | — | — | — | 9.9 | 0.29 | 9 |
| LNU300 | 65032.1 | 30.6 | 0.03 | 28 | — | — | — | — | — | — |
| CONT. | — | 24.0 | — | — | 210.4 | — | — | 9.1 | — | — |
| LNU512 | 63468.3 | 87.5 | 0.20 | 21 | — | — | — | — | — | — |
| LNU451 | 63499.1 | 82.5 | 0.24 | 14 | 881.2 | 0.08 | 14 | — | — | — |
| LNU424 | 63476.3 | 92.5 | 0.08 | 28 | 981.2 | 0.01 | 27 | — | — | — |
| LNU424 | 63478.1 | — | — | — | 818.8 | 0.28 | 6 | — | — | — |
| LNU424 | 63478.3 | 84.4 | 0.23 | 16 | — | — | — | — | — | — |
| LNU415 | 63691.2 | 83.8 | 0.02 | 16 | 850.0 | 0.08 | 10 | — | — | — |
| LNU415 | 63692.2 | 77.5 | 0.29 | 7 | — | — | — | — | — | — |
| LNU411 | 63514.3 | 78.8 | 0.20 | 9 | — | — | — | — | — | — |
| LNU411 | 63517.1 | 86.9 | 0.30 | 20 | — | — | — | — | — | — |
| LNU375 | 63451.3 | — | — | — | 812.5 | 0.30 | 5 | — | — | — |
| LNU375 | 63452.2 | 88.1 | 0.15 | 22 | 943.8 | 0.07 | 22 | — | — | — |
| LNU375 | 63452.3 | 78.1 | 0.16 | 8 | — | — | — | — | — | — |
| LNU375 | 63454.2 | — | — | — | 856.2 | 0.15 | 11 | — | — | — |
| LNU370 | 63544.3 | 88.1 | L | 22 | 962.5 | L | 25 | — | — | — |
| LNU370 | 63545.2 | 86.2 | 0.02 | 19 | 968.8 | 0.10 | 26 | — | — | — |
| LNU357 | 63532.3 | 80.0 | 0.08 | 10 | 843.8 | 0.10 | 9 | — | — | — |
| LNU357 | 63533.1 | 80.0 | 0.07 | 10 | 818.8 | 0.28 | 6 | 12.1 | 0.05 | 12 |
| LNU357 | 63533.8 | 81.9 | 0.05 | 13 | 837.5 | 0.12 | 9 | — | — | — |
| LNU356 | 63444.1 | 77.5 | 0.19 | 7 | — | — | — | — | — | — |
| LNU356 | 63444.3 | 83.8 | 0.28 | 16 | — | — | — | — | — | — |
| LNU356 | 63445.1 | 82.5 | 0.03 | 14 | 856.2 | 0.15 | 11 | | | |
| LNU351 | 63464.1 | 89.4 | 0.30 | 23 | — | — | — | — | — | — |
| LNU344 | 63520.4 | 80.0 | 0.14 | 10 | — | — | — | — | — | — |
| LNU330 | 63438.1 | 85.0 | 0.01 | 17 | — | — | — | — | — | — |
| LNU330 | 63441.2 | 89.4 | 0.30 | 23 | — | — | — | — | — | — |
| LNU319 | 63527.1 | 88.8 | L | 22 | 912.5 | 0.01 | 18 | — | — | — |
| LNU319 | 63527.2 | 83.8 | 0.05 | 16 | — | — | — | — | — | — |
| LNU319 | 63528.1 | 84.4 | 0.02 | 16 | 843.8 | 0.10 | 9 | 11.4 | 0.11 | 6 |

TABLE 91-continued

Genes showing improved plant biomass production at limiting nitrogen growth conditions

| Gene Name | Event # | Dry Weight [mg] Ave. | P-Val. | % Incr. | Fresh Weight [mg] Ave. | P-Val | % Incr. | Leaf Number Ave. | P-Val | % Incr. |
|---|---|---|---|---|---|---|---|---|---|---|
| LNU319 | 63530.3 | 81.9 | 0.05 | 13 | 918.8 | 0.04 | 19 | — | — | — |
| LNU308 | 63417.5 | — | — | — | 875.0 | 0.06 | 14 | — | — | — |
| LNU302 | 63380.1 | 80.0 | 0.14 | 10 | 887.5 | 0.04 | 15 | — | — | — |
| LNU302 | 63382.2 | 84.4 | 0.30 | 16 | — | — | — | — | — | — |
| LNU291 | 63387.1 | 79.4 | 0.21 | 9 | — | — | — | — | — | — |
| LNU291 | 63387.3 | — | — | — | 825.0 | 0.21 | 7 | — | — | — |
| LNU291 | 63388.1 | 78.1 | 0.16 | 8 | 856.2 | 0.08 | 11 | — | — | — |
| CONT. | — | 72.5 | — | — | 770.8 | — | — | 10.7 | — | — |

Table 91
"CONT."—Control;
"Ave."—Average;
"% Incr." = % increment;
"p-val."—p-value;
L means that p-value is less than 0.01, p < 0.1 was considered as significant.

TABLE 92

Genes showing improved plant biomass production at limiting nitrogen growth conditions

| Gene Name | Event # | Plot Coverage [cm²] Ave. | P-Val. | % Incr. | Rosette Area [cm²] Ave. | P-Val | % Incr. | Rosette Diameter [cm] Ave. | P-Val | % Incr. |
|---|---|---|---|---|---|---|---|---|---|---|
| LNU507 | 64087.1 | 33.8 | 0.29 | 8 | 4.2 | 0.29 | 8 | 3.4 | 0.12 | 5 |
| LNU507 | 64584.2 | — | — | — | — | — | — | 3.3 | 0.29 | 3 |
| LNU479 | 65497.2 | 40.6 | 0.08 | 29 | 5.1 | 0.08 | 29 | 3.7 | 0.06 | 15 |
| LNU479 | 65497.5 | 34.2 | 0.24 | 9 | 4.3 | 0.24 | 9 | 3.3 | 0.15 | 5 |
| LNU479 | 65499.1 | 37.1 | 0.10 | 18 | 4.6 | 0.10 | 18 | 3.5 | 0.23 | 10 |
| LNU423 | 64102.1 | — | — | — | — | — | — | 3.4 | 0.07 | 7 |
| LNU418 | 65027.2 | — | — | — | — | — | — | 3.5 | 0.13 | 11 |
| LNU401 | 65493.2 | 34.1 | 0.28 | 8 | 4.3 | 0.28 | 8 | 3.4 | 0.09 | 6 |
| LNU377 | 64603.2 | — | — | — | — | — | — | 3.3 | 0.18 | 5 |
| LNU377 | 64604.3 | — | — | — | — | — | — | 3.5 | 0.06 | 10 |
| LNU368 | 64004.3 | — | — | — | — | — | — | 3.3 | 0.25 | 4 |
| LNU344 | 63520.4 | — | — | — | — | — | — | 3.7 | L | 17 |
| LNU344 | 63521.2 | — | — | — | — | — | — | 3.5 | 0.24 | 10 |
| LNU339 | 65056.1 | — | — | — | — | — | — | 3.5 | 0.17 | 9 |
| LNU337 | 64952.1 | 35.8 | 0.10 | 14 | 4.5 | 0.10 | 14 | 3.5 | 0.03 | 10 |
| LNU337 | 64954.1 | — | — | — | — | — | — | 3.3 | 0.24 | 4 |
| LNU333 | 65295.1 | 36.9 | 0.22 | 17 | 4.6 | 0.22 | 17 | 3.6 | L | 13 |
| LNU333 | 65297.1 | 35.3 | 0.24 | 12 | 4.4 | 0.24 | 12 | 3.5 | 0.04 | 11 |
| LNU333 | 65297.2 | — | — | — | — | — | — | 3.3 | 0.22 | 4 |
| LNU304 | 64573.1 | — | — | — | — | — | — | 3.4 | 0.10 | 7 |
| LNU304 | 64575.2 | — | — | — | — | — | — | 3.3 | 0.24 | 4 |
| LNU292 | 64084.1 | 36.1 | 0.06 | 15 | 4.5 | 0.06 | 15 | 3.6 | L | 13 |
| CONT. | — | 31.5 | — | — | 3.9 | — | — | 3.2 | — | — |
| LNU507 | 64584.1 | 60.0 | 0.22 | 25 | 7.5 | 0.22 | 25 | 4.6 | 0.18 | 16 |
| LNU494 | 65302.1 | 58.3 | 0.12 | 21 | 7.3 | 0.12 | 21 | 4.4 | 0.14 | 11 |
| LNU479 | 65499.1 | 58.0 | 0.15 | 21 | 7.2 | 0.15 | 21 | 4.3 | 0.17 | 10 |
| LNU418 | 65024.2 | 75.2 | 0.08 | 57 | 9.4 | 0.08 | 57 | 5.1 | L | 31 |
| LNU388 | 65487.1 | 62.5 | 0.04 | 30 | 7.8 | 0.04 | 30 | 4.6 | 0.05 | 16 |
| LNU348 | 64469.1 | — | — | — | — | — | — | 4.3 | 0.23 | 9 |
| LNU336 | 64447.2 | — | — | — | — | — | — | 4.4 | 0.27 | 11 |
| LNU333 | 65295.2 | — | — | — | — | — | — | 4.3 | 0.27 | 8 |
| CONT. | — | 48.0 | — | — | 6.0 | — | — | 3.9 | — | — |
| LNU508 | 64459.2 | 45.4 | 0.09 | 13 | 5.7 | 0.09 | 13 | 4.0 | 0.17 | 6 |
| LNU469 | 64308.4 | 49.5 | 0.23 | 23 | 6.2 | 0.23 | 23 | 4.2 | 0.14 | 11 |
| LNU469 | 64311.8 | 47.3 | 0.27 | 18 | 5.9 | 0.27 | 18 | — | — | — |
| LNU460 | 64359.3 | 47.7 | 0.05 | 19 | 6.0 | 0.05 | 19 | 4.1 | 0.10 | 8 |
| LNU460 | 64361.4 | 51.1 | 0.04 | 27 | 6.4 | 0.04 | 27 | 4.4 | 0.05 | 14 |
| LNU459 | 64044.1 | — | — | — | — | — | — | 4.1 | 0.23 | 6 |
| LNU459 | 64541.4 | — | — | — | — | — | — | 4.0 | 0.26 | 5 |
| LNU459 | 64542.1 | — | — | — | — | — | — | 4.1 | 0.24 | 7 |
| LNU459 | 64542.4 | 49.4 | 0.19 | 23 | 6.2 | 0.19 | 23 | 4.2 | 0.14 | 11 |
| LNU442 | 64057.1 | 47.3 | 0.04 | 18 | 5.9 | 0.04 | 18 | 4.2 | 0.04 | 10 |
| LNU442 | 64553.1 | 54.2 | 0.16 | 35 | 6.8 | 0.16 | 35 | 4.6 | 0.08 | 19 |
| LNU421 | 64303.4 | 43.3 | 0.27 | 8 | 5.4 | 0.27 | 8 | — | — | — |
| LNU421 | 64304.4 | 50.3 | 0.02 | 25 | 6.3 | 0.02 | 25 | 4.3 | 0.02 | 13 |
| LNU421 | 64305.11 | — | — | — | — | — | — | 4.1 | 0.27 | 7 |
| LNU420 | 64006.3 | — | — | — | — | — | — | 4.0 | 0.22 | 6 |
| LNU409 | 64688.2 | — | — | — | 5.5 | 0.18 | 10 | 4.3 | 0.02 | 12 |

TABLE 92-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val | % Incr. | Ave. | P-Val | % Incr. |
| LNU408 | 64248.10 | 44.1 | 0.18 | 10 | 5.5 | 0.18 | 10 | — | — | — |
| LNU408 | 64249.4 | 46.1 | 0.06 | 15 | 5.8 | 0.06 | 15 | 4.1 | 0.08 | 8 |
| LNU368 | 64004.2 | — | — | — | — | — | — | 4.0 | 0.24 | 6 |
| LNU363 | 64409.2 | 44.1 | 0.19 | 10 | 5.5 | 0.19 | 10 | 4.2 | 0.04 | 10 |
| LNU363 | 64410.1 | 51.6 | 0.06 | 29 | 6.5 | 0.06 | 29 | 4.2 | 0.16 | 10 |
| LNU363 | 64413.2 | 44.1 | 0.19 | 10 | 5.5 | 0.19 | 10 | — | — | — |
| LNU331 | 64215.3 | 54.2 | L | 35 | 6.8 | L | 35 | 4.4 | L | 16 |
| LNU314 | 64434.2 | 54.7 | 0.03 | 36 | 6.8 | 0.03 | 36 | 4.4 | 0.03 | 16 |
| LNU290 | 64368.4 | 46.8 | 0.04 | 17 | 5.9 | 0.04 | 17 | 4.1 | 0.09 | 8 |
| LNU290 | 64369.3 | 43.7 | 0.22 | 9 | 5.5 | 0.22 | 9 | — | — | — |
| CONT. | — | 40.1 | — | — | 5.0 | — | — | 3.8 | — | — |
| LNU517 | 64296.4 | 48.1 | 0.08 | 21 | 6.0 | 0.08 | 21 | 4.2 | 0.21 | 8 |
| LNU514 | 64365.2 | 44.1 | 0.26 | 11 | 5.5 | 0.26 | 11 | — | — | — |
| LNU509 | 64692.3 | 50.5 | L | 27 | 6.3 | L | 27 | 4.5 | L | 14 |
| LNU509 | 64692.6 | 48.4 | 0.02 | 22 | 6.0 | 0.02 | 22 | 4.3 | 0.03 | 10 |
| LNU504 | 64453.2 | 48.4 | 0.23 | 22 | 6.0 | 0.23 | 22 | — | — | — |
| LNU501 | 64197.1 | 45.4 | 0.07 | 14 | 5.7 | 0.07 | 14 | 4.2 | 0.09 | 8 |
| LNU397 | 64376.4 | 47.0 | 0.19 | 18 | 5.9 | 0.19 | 18 | — | — | — |
| LNU365 | 64708.2 | 44.9 | 0.18 | 13 | 5.6 | 0.18 | 13 | 4.2 | 0.22 | 8 |
| LNU365 | 64711.3 | 43.2 | 0.21 | 9 | 5.4 | 0.21 | 9 | 4.1 | 0.27 | 4 |
| CONT. | — | 39.8 | — | — | 5.0 | — | — | 3.9 | — | — |
| LNU513 | 63456.2 | 32.8 | 0.05 | 12 | 4.1 | 0.05 | 12 | 3.4 | 0.16 | 3 |
| LNU513 | 63458.2 | 35.8 | 0.18 | 21 | 4.5 | 0.18 | 21 | 3.7 | 0.07 | 13 |
| LNU513 | 63459.2 | 38.5 | L | 31 | 4.8 | L | 31 | 3.8 | L | 16 |
| LNU513 | 63460.2 | 33.6 | 0.05 | 14 | 4.2 | 0.05 | 14 | 3.6 | L | 8 |
| LNU512 | 63468.3 | 37.1 | L | 26 | 4.6 | L | 26 | 3.7 | 0.02 | 12 |
| LNU512 | 63470.1 | 33.3 | 0.10 | 13 | 4.2 | 0.10 | 13 | 3.5 | 0.02 | 6 |
| LNU512 | 63471.3 | 32.7 | 0.03 | 11 | 4.1 | 0.03 | 11 | 3.6 | 0.08 | 7 |
| LNU512 | 63471.4 | 37.0 | 0.01 | 26 | 4.6 | 0.01 | 26 | 3.8 | 0.03 | 15 |
| LNU451 | 63499.1 | 32.3 | 0.05 | 10 | 4.0 | 0.05 | 10 | 3.5 | 0.04 | 5 |
| LNU451 | 63499.5 | 38.4 | L | 30 | 4.8 | L | 30 | 3.8 | L | 15 |
| LNU451 | 63500.1 | 36.0 | 0.04 | 22 | 4.5 | 0.04 | 22 | 3.7 | 0.22 | 12 |
| LNU424 | 63474.3 | 36.0 | 0.05 | 22 | 4.5 | 0.05 | 22 | 3.7 | 0.20 | 13 |
| LNU424 | 63476.3 | 36.4 | L | 24 | 4.6 | L | 24 | 3.7 | 0.08 | 11 |
| LNU424 | 63478.3 | 31.0 | 0.25 | 5 | 3.9 | 0.25 | 5 | — | — | — |
| LNU415 | 63692.1 | 32.2 | 0.17 | 9 | 4.0 | 0.17 | 9 | — | — | — |
| LNU411 | 63514.3 | 38.7 | 0.11 | 32 | 4.8 | 0.11 | 32 | 3.7 | 0.14 | 12 |
| LNU411 | 63518.1 | 34.3 | L | 16 | 4.3 | L | 16 | 3.6 | L | 9 |
| LNU375 | 63451.3 | 33.8 | 0.21 | 15 | 4.2 | 0.21 | 15 | — | — | — |
| LNU375 | 63452.2 | 33.8 | 0.04 | 15 | 4.2 | 0.04 | 15 | 3.6 | 0.07 | 9 |
| LNU375 | 63454.1 | 33.9 | 0.01 | 15 | 4.2 | 0.01 | 15 | 3.6 | 0.14 | 8 |
| LNU375 | 63454.2 | 36.7 | 0.16 | 25 | 4.6 | 0.16 | 25 | 3.8 | 0.07 | 14 |
| LNU370 | 63544.3 | 36.5 | 0.06 | 24 | 4.6 | 0.06 | 24 | 3.8 | L | 14 |
| LNU370 | 63545.6 | 35.7 | 0.17 | 21 | 4.5 | 0.17 | 21 | 3.7 | 0.05 | 11 |
| LNU370 | 63548.2 | 36.0 | L | 22 | 4.5 | L | 22 | 3.8 | L | 14 |
| LNU357 | 63533.1 | 41.0 | 0.07 | 39 | 5.1 | 0.07 | 39 | 3.9 | L | 19 |
| LNU357 | 63533.8 | 35.5 | L | 21 | 4.4 | L | 21 | 3.6 | L | 9 |
| LNU357 | 63534.1 | 39.5 | 0.03 | 34 | 4.9 | 0.03 | 34 | 3.9 | L | 18 |
| LNU356 | 63444.2 | 35.3 | 0.03 | 20 | 4.4 | 0.03 | 20 | 3.7 | L | 10 |
| LNU356 | 63445.1 | 35.2 | 0.07 | 20 | 4.4 | 0.07 | 20 | 3.7 | 0.03 | 12 |
| LNU351 | 63462.3 | 35.2 | 0.16 | 20 | 4.4 | 0.16 | 20 | 3.6 | L | 10 |
| LNU351 | 63463.2 | 38.4 | L | 30 | 4.8 | L | 30 | 3.8 | L | 15 |
| LNU351 | 63464.1 | — | — | — | — | — | — | 3.5 | 0.27 | 6 |
| LNU344 | 63520.2 | 33.4 | 0.02 | 13 | 4.2 | 0.02 | 13 | 3.5 | 0.02 | 6 |
| LNU344 | 63521.1 | 34.8 | 0.12 | 18 | 4.3 | 0.12 | 18 | 3.6 | 0.23 | 10 |
| LNU344 | 63521.2 | 33.5 | 0.08 | 14 | 4.2 | 0.08 | 14 | 3.5 | 0.19 | 5 |
| LNU330 | 63438.1 | 35.6 | 0.11 | 21 | 4.5 | 0.11 | 21 | 3.7 | 0.04 | 11 |
| LNU330 | 63439.1 | 32.5 | 0.08 | 10 | 4.1 | 0.08 | 10 | 3.5 | L | 7 |
| LNU326 | 63433.2 | 32.4 | 0.08 | 10 | 4.1 | 0.08 | 10 | 3.5 | 0.03 | 5 |
| LNU326 | 63433.4 | 35.3 | L | 20 | 4.4 | L | 20 | 3.6 | L | 9 |
| LNU326 | 63434.1 | — | — | — | — | — | — | 3.6 | 0.27 | 8 |
| LNU326 | 63435.1 | 40.1 | 0.03 | 36 | 5.0 | 0.03 | 36 | 4.0 | L | 20 |
| LNU319 | 63527.1 | 35.4 | L | 20 | 4.4 | L | 20 | 3.7 | L | 12 |
| LNU319 | 63527.2 | 35.7 | 0.28 | 21 | 4.5 | 0.28 | 21 | 3.7 | 0.21 | 10 |
| LNU319 | 63528.1 | 37.8 | 0.15 | 29 | 4.7 | 0.15 | 29 | 3.8 | 0.20 | 15 |
| LNU319 | 63530.3 | 34.9 | 0.08 | 19 | 4.4 | 0.08 | 19 | 3.6 | 0.24 | 9 |
| LNU308 | 63414.1 | 33.9 | 0.03 | 15 | 4.2 | 0.03 | 15 | 3.6 | 0.04 | 10 |
| LNU308 | 63414.4 | 37.3 | 0.02 | 27 | 4.7 | 0.02 | 27 | 3.9 | L | 18 |
| LNU308 | 63417.5 | 37.1 | L | 26 | 4.6 | L | 26 | 3.8 | L | 15 |
| LNU308 | 63417.8 | 37.3 | L | 27 | 4.7 | L | 27 | 3.7 | L | 12 |
| LNU302 | 63378.3 | 34.4 | 0.22 | 17 | 4.3 | 0.22 | 17 | 3.6 | 0.06 | 7 |
| LNU302 | 63581.1 | 40.5 | L | 38 | 5.1 | L | 38 | 3.9 | L | 18 |
| LNU302 | 63382.2 | 40.4 | L | 37 | 5.0 | L | 37 | 3.9 | L | 17 |
| LNU291 | 63385.2 | 37.6 | 0.19 | 28 | 4.7 | 0.19 | 28 | 3.7 | 0.25 | 12 |

TABLE 92-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val | % Incr. | Ave. | P-Val | % Incr. |
| LNU291 | 63387.1 | 34.1 | 0.11 | 16 | 4.3 | 0.11 | 16 | 3.7 | 0.05 | 11 |
| LNU291 | 63387.3 | 36.3 | 0.22 | 23 | 4.5 | 0.22 | 23 | 3.8 | 0.18 | 14 |
| LNU291 | 63388.1 | 37.6 | L | 28 | 4.7 | L | 28 | 3.8 | L | 14 |
| CONT. | — | 29.4 | — | — | 3.7 | — | — | 3.3 | — | — |
| LNU469 | 64308.5 | — | — | — | — | — | — | 4.2 | 0.27 | 3 |
| LNU469 | 64313.9 | 51.7 | 0.12 | 13 | 6.5 | 0.12 | 13 | 4.5 | 0.06 | 6 |
| LNU444 | 64182.3 | 52.0 | 0.04 | 13 | 6.5 | 0.04 | 13 | 4.3 | 0.08 | 7 |
| LNU442 | 64555.1 | 56.5 | L | 23 | 7.1 | L | 23 | 4.4 | 0.02 | 8 |
| LNU430 | 63935.1 | 51.9 | 0.08 | 13 | 6.5 | 0.08 | 13 | 4.4 | 0.12 | 10 |
| LNU391 | 63980.3 | 50.5 | 0.11 | 10 | 6.5 | 0.11 | 10 | 4.2 | 0.17 | 5 |
| LNU366 | 64027.7 | 52.6 | 0.03 | 15 | 6.6 | 0.03 | 15 | 4.3 | 0.03 | 8 |
| LNU366 | 64028.3 | 52.4 | 0.14 | 14 | 6.5 | 0.14 | 14 | — | — | — |
| LNU363 | 64409.3 | — | — | — | — | — | — | 4.2 | 0.23 | 5 |
| LNU314 | 64433.3 | 50.3 | 0.25 | 10 | 6.3 | 0.25 | 10 | 4.3 | 0.06 | 6 |
| LNU314 | 64437.2 | — | — | — | — | — | — | 4.2 | 0.18 | 4 |
| CONT. | — | 45.8 | — | — | 5.7 | — | — | 4.0 | — | — |
| LNU492 | 64177.2 | 40.3 | 0.20 | 7 | 5.0 | 0.20 | 7 | — | — | — |
| LNU471 | 64838.1 | 42.1 | 0.12 | 12 | 5.3 | 0.12 | 12 | 3.6 | 0.09 | 5 |
| LNU463 | 64283.4 | 49.9 | 0.07 | 32 | 6.2 | 0.07 | 32 | 4.0 | 0.10 | 17 |
| LNU454 | 64796.3 | 44.5 | 0.01 | 18 | 5.6 | 0.01 | 18 | 3.7 | 0.02 | 8 |
| LNU454 | 64799.2 | 39.8 | 0.30 | 6 | 5.0 | 0.30 | 6 | — | — | — |
| LNU413 | 65019.1 | 41.8 | 0.07 | 11 | 5.2 | 0.07 | 11 | 3.7 | 0.03 | 7 |
| LNU413 | 65022.4 | 48.8 | 0.18 | 30 | 6.1 | 0.18 | 30 | 3.8 | 0.26 | 11 |
| LNU410 | 64974.3 | 44.9 | L | 19 | 5.6 | L | 19 | 3.7 | 0.01 | 9 |
| LNU387 | 64808.1 | 41.1 | 0.12 | 9 | 5.1 | 0.12 | 9 | 3.5 | 0.20 | 3 |
| LNU387 | 64810.4 | 45.4 | 0.12 | 20 | 5.7 | 0.12 | 20 | 3.7 | 0.23 | 7 |
| LNU382 | 64429.3 | 40.1 | 0.24 | 6 | 5.0 | 0.24 | 6 | 3.5 | 0.28 | 3 |
| LNU373 | 64826.4 | 44.6 | 0.07 | 18 | 5.6 | 0.07 | 18 | 3.7 | 0.04 | 9 |
| LNU373 | 64830.1 | 46.0 | 0.12 | 22 | 5.7 | 0.12 | 22 | 3.7 | 0.07 | 8 |
| LNU361 | 64832.1 | 43.7 | 0.19 | 16 | 5.5 | 0.19 | 16 | 3.6 | 0.08 | 6 |
| LNU355 | 65012.1 | 45.9 | 0.12 | 22 | 5.7 | 0.12 | 22 | 3.8 | L | 12 |
| LNU355 | 65014.2 | 41.4 | 0.11 | 10 | 5.2 | 0.11 | 10 | 3.7 | 0.03 | 7 |
| LNU355 | 65015.2 | 46.0 | L | 22 | 5.8 | L | 22 | 3.S | L | 10 |
| LNU332 | 64824.4 | 40.3 | 0.22 | 7 | 5.0 | 0.22 | 7 | — | — | — |
| LNU307 | 64958.2 | 41.8 | 0.07 | 11 | 5.2 | 0.07 | 11 | — | — | — |
| LNU307 | 64960.2 | — | — | — | — | — | — | 3.7 | 0.24 | 8 |
| LNU303 | 65046.3 | 40.3 | 0.29 | 7 | 5.0 | 0.29 | 7 | 3.6 | 0.13 | 4 |
| CONT. | — | 37.7 | — | — | 4.7 | — | — | 3.4 | — | — |
| LNU517 | 64296.3 | 51.9 | 0.02 | 26 | 6.5 | 0.02 | 26 | 4.3 | 0.04 | 11 |
| LNU517 | 64297.9 | 49.5 | 0.03 | 20 | 6.2 | 0.03 | 20 | 4.1 | 0.06 | 8 |
| LNU514 | 64364.2 | 55.1 | L | 33 | 6.9 | L | 33 | 4.5 | L | 18 |
| LNU514 | 64365.3 | 52.3 | 0.09 | 27 | 6.5 | 0.09 | 27 | 4.4 | L | 14 |
| LNU514 | 64366.1 | 48.2 | 0.11 | 17 | 6.0 | 0.11 | 17 | 4.2 | 0.03 | 10 |
| LNU509 | 64692.3 | 47.3 | 0.06 | 15 | 5.9 | 0.06 | 15 | 4.2 | 0.02 | 10 |
| LNU501 | 64197.1 | 45.4 | 0.23 | 10 | 5.7 | 0.23 | 10 | — | — | — |
| LNU501 | 64197.3 | 45.5 | 0.15 | 10 | 5.7 | 0.15 | 10 | 4.0 | 0.22 | 5 |
| LNU501 | 64723.1 | 52.0 | 0.11 | 26 | 6.5 | 0.11 | 26 | 4.3 | 0.19 | 12 |
| LNU461 | 64668.5 | 44.4 | 0.26 | 8 | 5.6 | 0.26 | 8 | 4.2 | 0.05 | 9 |
| LNU397 | 64375.1 | 52.2 | 0.02 | 26 | 6.5 | 0.02 | 26 | 4.3 | 0.01 | 12 |
| LNU396 | 64315.13 | 45.9 | 0.12 | 11 | 5.7 | 0.12 | 11 | — | — | — |
| LNU396 | 64317.3 | 49.6 | 0.02 | 20 | 6.2 | 0.02 | 20 | 4.2 | 0.13 | 9 |
| LNU386 | 64394.3 | — | — | — | — | — | — | 4.0 | 0.30 | 5 |
| LNU372 | 64481.1 | 49.1 | 0.02 | 19 | 6.1 | 0.02 | 19 | 4.3 | 0.02 | 11 |
| LNU372 | 64483.3 | 53.5 | L | 29 | 6.7 | L | 2 | 4.3 | 0.08 | 12 |
| LNU369 | 64386.1 | 49.9 | 0.16 | 21 | 6.2 | 0.16 | 21 | 4.2 | 0.09 | 10 |
| LNU369 | 64387.1 | 52.1 | 0.12 | 26 | 6.5 | 0.12 | 26 | 4.3 | 0.08 | 13 |
| LNU369 | 64387.2 | 48.4 | 0.24 | 17 | 6.1 | 0.24 | 17 | — | — | — |
| LNU369 | 64389.2 | 52.7 | L | 28 | 6.6 | L | 28 | 4.4 | L | 14 |
| LNU350 | 64676.2 | — | — | — | — | — | — | 4.1 | 0.21 | 7 |
| LNU350 | 64677.2 | — | — | — | — | — | — | 4.0 | 0.29 | 4 |
| LNU345 | 64335.1 | — | — | — | — | — | — | 4.1 | 0.28 | 7 |
| LNU342 | 64035.1 | 45.9 | 0.14 | 11 | 5.7 | 0.14 | 11 | 4.0 | 0.27 | 5 |
| LNU342 | 64035.3 | — | — | — | — | — | — | 4.3 | 0.12 | 11 |
| LNU342 | 64035.8 | — | — | — | — | — | — | 4.0 | 0.23 | 5 |
| LNU313 | 64661.8 | 49.6 | 0.09 | 20 | 6.2 | 0.09 | 20 | 4.2 | 0.27 | 9 |
| LNU313 | 64664.1 | 50.0 | 0.02 | 21 | 6.3 | 0.02 | 21 | 4.2 | 0.03 | 10 |
| LNU313 | 64664.3 | 48.6 | 0.07 | 18 | 6.1 | 0.07 | 18 | 4.1 | 0.06 | 8 |
| CONT. | — | 41.3 | — | — | 5.2 | — | — | 3.8 | — | — |
| LNU477 | 63888.1 | — | — | — | — | — | — | 3.8 | 0.23 | 3 |
| LNU472 | 63921.4 | — | — | — | — | — | — | 3.8 | 0.22 | 4 |
| LNU439 | 64616.2 | 38.5 | 0.24 | 9 | 4.8 | 0.24 | 9 | — | — | — |
| LNU419 | 63896.2 | 37.1 | 0.14 | 5 | 4.6 | 0.14 | 5 | — | — | — |
| LNU407 | 64219.1 | 37.2 | 0.08 | 6 | 4.6 | 0.08 | 6 | 3.9 | L | 8 |
| LNU403 | 64237.1 | 41.4 | L | 17 | 5.2 | L | 17 | 4.0 | L | 9 |

TABLE 92-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val | % Incr. | Ave. | P-Val | % Incr. |
| LNU393 | 63978.2 | 37.7 | 0.03 | 7 | 4.7 | 0.03 | 7 | 3.8 | 0.06 | 4 |
| LNU374 | 63997.2 | 38.3 | 0.01 | 9 | 4.8 | 0.01 | 9 | 3.8 | 0.15 | 5 |
| LNU335 | 64169.2 | 41.2 | 0.12 | 17 | 5.2 | 0.12 | 17 | 3.9 | 0.09 | 9 |
| CONT. | — | 35.2 | — | — | 4.4 | — | — | 3.6 | — | — |
| LNU500 | 64222.1 | 45.4 | 0.09 | 7 | 5.7 | 0.09 | 7 | — | — | — |
| LNU496 | 64195.6 | 46.1 | 0.05 | 9 | 5.8 | 0.05 | 9 | 4.3 | 0.08 | 8 |
| LNU472 | 63949.7 | 45.3 | 0.22 | 7 | 5.7 | 0.22 | 7 | 4.2 | L | 7 |
| LNU419 | 63897.6 | 46.3 | 0.21 | 9 | 5.8 | 0.21 | 9 | — | — | — |
| LNU343 | 64208.1 | 49.5 | L | 17 | 6.2 | L | 17 | 4.3 | L | 8 |
| LNU343 | 64209.1 | — | — | — | — | — | — | 4.1 | 0.29 | 3 |
| LNU328 | 64151.2 | 43.6 | 0.15 | 3 | 5.4 | 0.15 | 3 | 4.1 | 0.26 | 3 |
| LNU327 | 64491.2 | 48.1 | 0.03 | 13 | 6.0 | 0.03 | 13 | 4.2 | 0.18 | 6 |
| LNU305 | 64111.3 | 45.1 | 0.17 | 6 | 5.6 | 0.17 | 6 | — | — | — |
| CONT. | — | 42.4 | — | — | 5.3 | — | — | 4.0 | — | — |
| LNU503 | 64203.3 | 57.1 | 0.26 | 12 | 7.1 | 0.26 | 12 | 4.6 | 0.16 | 7 |
| LNU430 | 63935.1 | — | — | — | — | — | — | 4.5 | 0.27 | 5 |
| LNU430 | 63952.1 | 60.0 | 0.13 | 18 | 7.5 | 0.13 | 18 | 4.6 | 0.09 | 8 |
| LNU403 | 64237.1 | 63.6 | 0.04 | 25 | 7.9 | 0.04 | 25 | 4.8 | 0.12 | 12 |
| LNU366 | 64028.3 | — | — | — | — | — | — | 4.6 | 0.19 | 7 |
| LNU353 | 64032.3 | 58.3 | 0.22 | 15 | 7.3 | 0.22 | 15 | — | — | — |
| LNU352 | 64199.1 | 58.1 | 0.19 | 14 | 7.3 | 0.19 | 14 | 4.7 | 0.06 | 10 |
| LNU352 | 64200.10 | 62.4 | 0.06 | 23 | 7.8 | 0.06 | 23 | 4.9 | 0.02 | 14 |
| LNU335 | 64168.19 | 67.9 | 0.05 | 34 | 8.5 | 0.05 | 34 | 5.0 | 0.02 | 17 |
| CONT. | — | 50.8 | — | — | 6.4 | — | — | 4.3 | — | — |
| LNU499 | 64146.11 | 70.5 | 0.20 | 6 | 8.8 | 0.20 | 6 | — | — | — |
| LNU499 | 64146.7 | — | — | — | — | — | — | 5.0 | 0.26 | 3 |
| LNU499 | 64146.8 | 68.8 | 0.08 | 3 | 8.6 | 0.08 | 3 | 5.0 | 0.05 | 3 |
| LNU468 | 63492.2 | 83.4 | 0.05 | 25 | 10.4 | 0.05 | 25 | 5.6 | 0.07 | 14 |
| LNU468 | 63492.3 | 77.1 | 0.30 | 16 | 9.6 | 0.30 | 16 | 5.4 | 0.29 | 11 |
| LNU467 | 63714.4 | 70.9 | 0.11 | 61 | 8.9 | 0.11 | 6 | 5.1 | 0.08 | 4 |
| LNU467 | 63718.2 | — | — | — | — | — | — | 5.0 | 0.10 | 3 |
| LNU455 | 64187.5 | — | — | — | — | — | — | 5.0 | 0.10 | 2 |
| LNU455 | 64189.2 | 70.8 | 0.05 | 6 | 8.8 | 0.05 | 6 | 5.2 | L | 6 |
| LNU455 | 64189.7 | 88.9 | 0.14 | 33 | 11.1 | 0.14 | 33 | 5.7 | 0.21 | 17 |
| LNU450 | 63708.3 | 69.7 | 0.03 | 4 | 8.7 | 0.03 | 4 | 5.1 | 0.02 | 4 |
| LNU450 | 63708.6 | 75.3 | 0.10 | 13 | 9.4 | 0.10 | 13 | 5.3 | 0.06 | 8 |
| LNU448 | 63705.2 | — | — | — | — | — | — | 5.2 | 0.21 | 7 |
| LNU448 | 63706.5 | 70.6 | 0.13 | 6 | 8.8 | 0.13 | 6 | 5.0 | 0.30 | 3 |
| LNU429 | 63937.4 | 72.7 | 0.21 | 9 | 9.1 | 0.21 | 9 | — | — | — |
| LNU429 | 63938.8 | 71.0 | L | 6 | 8.9 | L | 6 | 5.1 | 0.02 | 4 |
| LNU425 | 63911.11 | — | — | — | — | — | — | 5.1 | 0.01 | 4 |
| LNU425 | 63911.7 | 72.9 | L | 9 | 9.1 | L | 9 | 5.1 | L | 5 |
| LNU402 | 63914.2 | 71.9 | 0.09 | 8 | 9.0 | 0.09 | 8 | — | — | — |
| LNU399 | 63944.6 | 2.4 | L | 8 | 9.0 | 1 | 8 | 5.1 | 0.06 | 5 |
| LNU395 | 64142.8 | — | — | — | — | — | — | 5.1 | 0.16 | 5 |
| LNU392 | 63696.2 | 73.3 | L | 10 | 9.2 | L | 10 | — | — | — |
| LNU392 | 63697.4 | — | — | — | — | — | — | 5.2 | 0.28 | 6 |
| LNU392 | 63698.2 | — | — | — | — | — | — | 5.2 | 0.26 | 6 |
| LNU392 | 63700.3 | 70.9 | 0.23 | 6 | 8.9 | 0.23 | 6 | 5.2 | L | 6 |
| LNU390 | 63538.1 | 72.3 | 0.05 | 8 | 9.0 | 0.05 | 8 | 5.1 | 0.01 | 5 |
| LNU390 | 63539.3 | — | — | — | — | — | — | 5.2 | 0.25 | 7 |
| LNU390 | 63539.4 | 78.0 | 0.09 | 17 | 9.8 | 0.09 | 17 | 5.4 | 0.11 | 10 |
| LNU349 | 63989.1 | — | — | — | — | — | — | 5.0 | 0.26 | 2 |
| LNU349 | 63989.5 | 75.1 | L | 12 | 9.4 | L | 12 | 5.2 | 0.23 | 7 |
| LNU347 | 63510.4 | 73.9 | 0.14 | 11 | 9.2 | 0.14 | 11 | 5.2 | L | 6 |
| LNU347 | 63513.3 | 72.6 | 0.04 | 9 | 9.1 | 0.04 | 9 | 5.1 | 0.04 | 4 |
| LNU347 | 63513.4 | — | — | — | — | — | — | 5.2 | 0.20 | 6 |
| LNU329 | 63427.3 | — | — | — | — | — | — | 5.4 | 0.22 | 11 |
| LNU329 | 63429.1 | 84.8 | 0.21 | 27 | 10.6 | 0.21 | 27 | 5.6 | 0.14 | 14 |
| LNU323 | 63421.4 | 72.8 | 0.20 | 9 | 9.1 | 0.20 | 9 | 5.1 | 0.02 | 4 |
| LNU323 | 63424.4 | 69.6 | 0.22 | 4 | 8.7 | 0.22 | 4 | 5.1 | 0.25 | 5 |
| CONT. | — | 66.7 | — | — | 8.3 | — | — | 4.9 | — | — |
| LNU476 | 64041.2 | — | — | — | — | — | — | 3.3 | 0.24 | 3 |
| LNU4I0 | 64971.1 | 35.9 | L | 25 | 4.5 | L | 25 | 3.6 | L | 14 |
| LNU387 | 64810.4 | 31.3 | 0.19 | 9 | 3.9 | 0.19 | 9 | 3.3 | 0.19 | 3 |
| LNU382 | 64429.3 | 37.9 | 0.18 | 32 | 4.7 | 0.18 | 32 | 3.6 | 0.19 | 14 |
| LNU373 | 64828.1 | 32.0 | 0.17 | 11 | 4.0 | 0.17 | 11 | — | — | — |
| LNU373 | 64830.1 | 31.3 | 0.25 | 9 | 3.9 | 0.25 | 9 | 3.3 | 0.25 | 3 |
| LNU355 | 65013.2 | 36.6 | L | 28 | 4.6 | L | 28 | 3.6 | L | 13 |
| LNU355 | 65014.2 | — | — | — | — | — | — | 3.3 | 0.10 | 4 |
| LNU307 | 64959.2 | 34.2 | 0.08 | 19 | 4.3 | 0.08 | 19 | 3.4 | 0.02 | 9 |
| LNU303 | 65043.1 | 35.7 | 0.01 | 24 | 4.5 | 0.01 | 24 | 3.4 | 0.24 | 7 |
| LNU300 | 65032.1 | 32.5 | 0.21 | 13 | 4.1 | 0.21 | 13 | — | — | — |
| CONT. | — | 28.7 | — | — | 3.6 | — | — | 3.2 | — | — |

TABLE 92-continued

Genes showing improved plant biomass production at limiting nitrogen growth conditions

| Gene Name | Event # | Plot Coverage [cm²] Ave. | P-Val. | % Incr. | Rosette Area [cm²] Ave. | P-Val | % Incr. | Rosette Diameter [cm] Ave. | P-Val | % Incr. |
|---|---|---|---|---|---|---|---|---|---|---|
| LNU513 | 63458.3 | 58.4 | 0.28 | 10 | 7.3 | 0.28 | 10 | — | — | — |
| LNU512 | 63468.3 | 67.2 | 0.02 | 27 | 8.4 | 0.02 | 27 | 4.9 | 0.01 | 12 |
| LNU512 | 63470.1 | 59.2 | 0.12 | 12 | 7.4 | 0.12 | 12 | 4.6 | 0.21 | 5 |
| LNU424 | 63476.3 | 68.2 | 0.03 | 29 | 8.5 | 0.03 | 29 | 5.0 | L | 13 |
| LNU424 | 63478.3 | 57.4 | 0.29 | 9 | 7.2 | 0.29 | 9 | — | — | — |
| LNU415 | 63691.2 | 59.5 | 0.11 | 13 | 7.4 | 0.11 | 13 | 4.6 | 0.13 | 6 |
| LNU411 | 63514.3 | 60.9 | 0.07 | 15 | 7.6 | 0.07 | 15 | 4.7 | 0.08 | 7 |
| LNU411 | 63517.1 | 57.1 | 0.27 | 8 | 7.1 | 0.27 | 8 | 4.7 | 0.09 | 7 |
| LNU375 | 63452.2 | 61.2 | 0.14 | 16 | 7.7 | 0.14 | 16 | 4.7 | 0.18 | 7 |
| LNU375 | 63452.3 | — | — | — | — | — | — | 4.6 | 0.17 | 6 |
| LNU375 | 63454.1 | 62.5 | 0.04 | 18 | 7.8 | 0.04 | 18 | 4.7 | 0.15 | 6 |
| LNU375 | 63454.2 | — | — | — | — | — | — | 4.7 | 0.29 | 6 |
| LNU370 | 63544.3 | — | — | — | — | — | — | 4.6 | 0.13 | 6 |
| LNU370 | 63545.2 | 59.9 | 0.11 | 13 | 7.5 | 0.11 | 13 | 4.7 | 0.09 | 7 |
| LNU357 | 63532.3 | 62.8 | 0.07 | 19 | 7.9 | 0.07 | 19 | 4.8 | 0.12 | 8 |
| LNU357 | 63533.1 | 75.8 | L | 43 | 9.5 | L | 43 | 5.1 | L | 17 |
| LNU357 | 63533.8 | 62.4 | 0.04 | 18 | 7.8 | 0.04 | 18 | 4.7 | 0.07 | 8 |
| LNU356 | 63444.1 | 61.0 | 0.08 | 15 | 7.6 | 0.08 | 15 | 4.8 | 0.05 | 9 |
| LNU356 | 63444.3 | 61.8 | 0.12 | 17 | 7.7 | 0.12 | 17 | 4.7 | 0.23 | 7 |
| LNU356 | 63445.1 | 67.8 | L | 28 | 8.5 | L | 28 | 5.0 | L | 15 |
| LNU351 | 63462.3 | 59.8 | 0.10 | 13 | 7.5 | 0.10 | 13 | 4.7 | 0.11 | 6 |
| LNU351 | 63464.1 | 62.4 | 0.04 | 18 | 7.8 | 0.04 | 18 | 4.8 | 0.05 | 8 |
| LNU344 | 63520.4 | 64.4 | 0.02 | 22 | 8.0 | 0.02 | 22 | 4.8 | 0.02 | 11 |
| LNU330 | 63438.1 | 60.3 | 0.13 | 14 | 7.5 | 0.13 | 14 | 4.6 | 0.20 | 6 |
| LNU330 | 63439.1 | — | — | — | — | — | — | 4.6 | 0.21 | 5 |
| LNU330 | 63441.2 | 62.1 | 0.07 | 17 | 7.8 | 0.07 | 17 | 4.8 | 0.23 | 10 |
| LNU319 | 63527.1 | 74.1 | L | 40 | 9.3 | L | 40 | 5.2 | L | 18 |
| LNU319 | 63528.1 | 67.9 | L | 28 | 8.5 | L | 28 | 4.9 | 0.01 | 12 |
| LNU319 | 63530.1 | 59.6 | 0.27 | 13 | 7.5 | 0.27 | 13 | — | — | — |
| LNU319 | 63530.3 | 58.1 | 0.28 | 10 | 7.3 | 0.28 | 10 | — | — | — |
| LNU302 | 63379.1 | 58.9 | 0.14 | 11 | 7.4 | 0.14 | 11 | 4.7 | 0.06 | 8 |
| CONT. | — | 52.9 | — | — | 6.6 | — | — | 4.4 | — | — |

Table 92
"CONT."—Control;
"Ave."—Average;
"% Incr." = % increment;
"p-val."—p-value;
L means that p-value is less than 0.01, p < 0.1 was considered as significant.

The genes listed in Table 93 improved plant NUE when grown at limiting nitrogen concentration levels. These genes produced faster developing plants when grown under limiting nitrogen growth conditions, compared to control plants as measured by growth rate of leaf number, rosette diameter and plot coverage.

TABLE 93

Genes showing improved rosette growth performance at limiting nitrogen growth conditions

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LNU479 | 65497.2 | — | — | — | 5.1 | L | 33 | 0.3 | 0.05 | 26 |
| LNU479 | 65499.1 | — | — | — | 4.5 | 0.09 | 20 | — | — | — |
| LNU418 | 65025.1 | — | — | — | — | — | — | 0.3 | 0.15 | 20 |
| LNU418 | 65027.2 | — | — | — | — | — | — | 0.3 | 0.22 | 17 |
| LNU401 | 65493.2 | — | — | — | — | — | — | 0.3 | 0.26 | 15 |
| LNU401 | 65494.1 | — | — | — | 4.4 | 0.17 | 17 | — | — | — |
| LNU377 | 64603.2 | — | — | — | — | — | — | 0.3 | 0.19 | 17 |
| LNU377 | 64604.3 | — | — | — | — | — | — | 0.3 | 0.21 | 17 |
| LNU344 | 63520.4 | — | — | — | — | — | — | 0.3 | 0.07 | 27 |
| LNU344 | 63521.2 | — | — | — | 4.5 | 0.15 | 18 | 0.3 | 0.21 | 18 |
| LNU339 | 65056.1 | — | — | — | — | — | — | 0.3 | 0.26 | 15 |
| LNU337 | 64952.1 | — | — | — | 4.4 | 0.16 | 16 | 0.3 | 0.13 | 21 |
| LNU333 | 65295.1 | — | — | — | 4.5 | 0.12 | 18 | 0.3 | 0.19 | 18 |
| LNU333 | 65297.1 | — | — | — | 4.4 | 0.17 | 16 | 0.3 | 0.03 | 29 |
| LNU324 | 64233.4 | — | — | — | 4.7 | 0.09 | 25 | 0.3 | 0.20 | 21 |
| LNU324 | 64234.5 | — | — | — | 4.3 | 0.26 | 15 | 0.3 | 0.12 | 24 |
| LNU318 | 65066.6 | — | — | — | — | — | — | 0.3 | 0.19 | 18 |

TABLE 93-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU304 | 64573.1 | — | — | — | — | — | — | 0.3 | 0.23 | 15 |
| LNU292 | 64084.1 | — | — | — | 4.5 | 0.11 | 18 | 0.3 | 0.09 | 23 |
| CONT. | — | — | — | — | 3.8 | — | — | 0.2 | — | — |
| LNU507 | 64584.1 | — | — | — | 6.4 | 0.16 | 39 | 0.3 | 0.15 | 44 |
| LNU494 | 65302.1 | — | — | — | 6.2 | 0.20 | 33 | 0.3 | 0.21 | 37 |
| LNU423 | 64596.1 | 0.8 | 0.16 | 43 | — | — | — | — | — | — |
| LNU418 | 65024.2 | — | — | — | 8.4 | L | 81 | 0.4 | 0.02 | 72 |
| LNU388 | 65487.1 | — | — | — | 6.3 | 0.19 | 35 | — | — | — |
| LNU377 | 64604.3 | 0.7 | 0.19 | 42 | — | — | — | — | — | — |
| LNU348 | 64469.1 | 0.7 | 0.24 | 36 | — | — | — | 0.3 | 0.26 | 34 |
| LNU339 | 65056.1 | 0.8 | 0.08 | 54 | — | — | — | — | — | — |
| LNU333 | 65297.1 | 0.8 | 0.16 | 45 | 6.7 | 0.20 | 44 | — | — | — |
| CONT. | — | 0.5 | — | — | 4.6 | — | — | 0.2 | — | — |
| LNU508 | 64459.2 | — | — | — | 5.6 | 0.26 | 12 | — | — | — |
| LNU469 | 64308.4 | — | — | — | 5.9 | 0.11 | 20 | — | — | — |
| LNU469 | 64311.8 | — | — | — | 5.7 | 0.19 | 16 | — | — | — |
| LNU460 | 64359.3 | — | — | — | 5.8 | 0.12 | 18 | — | — | — |
| LNU460 | 64360.1 | — | — | — | — | — | — | 0.3 | 0.13 | 18 |
| LNU460 | 64361.4 | — | — | — | 6.4 | 0.02 | 28 | 0.4 | 0.09 | 20 |
| LNU459 | 64044.1 | — | — | — | — | — | — | 0.3 | 0.23 | 14 |
| LNU459 | 64542.1 | — | — | — | — | — | — | 0.3 | 0.12 | 18 |
| LNU459 | 64542.4 | — | — | — | 6.1 | 0.06 | 23 | 0.3 | 0.23 | 14 |
| LNU442 | 64057.1 | 0.7 | 0.29 | 19 | 6.0 | 0.08 | 21 | 0.4 | 0.09 | 20 |
| LNU442 | 64553.1 | — | — | — | 6.8 | L | 38 | 0.4 | 0.05 | 25 |
| LNU439 | 64618.3 | — | — | — | — | — | — | 0.3 | 0.26 | 15 |
| LNU421 | 64304.4 | — | — | — | 6.3 | 0.03 | 26 | — | — | — |
| LNU421 | 64305.11 | — | — | — | 5.7 | 0.22 | 15 | 0.3 | 0.25 | 13 |
| LNU416 | 64134.11 | — | — | — | — | — | — | 0.3 | 0.26 | 13 |
| LNU409 | 64684.2 | — | — | — | — | — | — | 0.3 | 0.15 | 17 |
| LNU409 | 64688.2 | — | — | — | — | — | — | 0.4 | 0.01 | 31 |
| LNU408 | 64249.4 | — | — | — | 5.8 | 0.14 | 17 | — | — | — |
| LNU368 | 64004.2 | — | — | — | 5.6 | 0.29 | 13 | — | — | — |
| LNU363 | 64409.2 | — | — | — | — | — | — | 0.4 | 0.05 | 23 |
| LNU363 | 64410.1 | — | — | — | 6.3 | 0.03 | 28 | — | — | — |
| LNU331 | 64215.3 | — | — | — | 6.7 | L | 35 | 0.3 | 0.12 | 18 |
| LNU314 | 64434.2 | — | — | — | 6.7 | L | 36 | 0.3 | 0.15 | 17 |
| LNU314 | 64437.6 | — | — | — | — | — | — | 0.3 | 0.26 | 13 |
| LNU290 | 64368.4 | — | — | — | 5.9 | 0.13 | 18 | 0.3 | 0.16 | 17 |
| CONT. | — | 0.6 | — | — | 5.0 | — | — | 0.3 | — | — |
| LNU517 | 64296.4 | — | — | — | 5.9 | 0.17 | 21 | — | — | — |
| LNU509 | 64692.3 | — | — | — | 6.4 | 0.05 | 30 | 0.4 | 0.07 | 21 |
| LNU509 | 64692.6 | — | — | — | 5.9 | 0.15 | 21 | — | — | — |
| LNU509 | 64695.1 | — | — | — | — | — | — | 0.4 | 0.28 | 13 |
| LNU504 | 64453.2 | — | — | — | 5.9 | 0.19 | 20 | — | — | — |
| LNU501 | 64197.1 | — | — | — | 5.7 | 0.26 | 17 | 0.4 | 0.16 | 16 |
| LNU397 | 64376.4 | — | — | — | 5.9 | 0.18 | 20 | — | — | — |
| LNU386 | 64392.4 | 0.6 | 0.29 | 17 | — | — | — | — | — | — |
| LNU342 | 64036.2 | 0.6 | 0.29 | 17 | — | — | — | — | — | — |
| CONT. | — | 0.5 | — | — | 4.9 | — | — | 0.3 | — | — |
| LNU513 | 63458.2 | — | — | — | 4.5 | 0.17 | 19 | 0.3 | 0.14 | 11 |
| LNU513 | 63459.2 | — | — | — | 4.8 | 0.05 | 28 | 0.3 | 0.14 | 10 |
| LNU513 | 63460.2 | — | — | — | — | — | — | 0.3 | 0.22 | 8 |
| LNU512 | 63468.3 | — | — | — | 4.7 | 0.10 | 24 | — | — | — |
| LNU512 | 63471.4 | — | — | — | 4.7 | 0.08 | 25 | 0.3 | 0.04 | 15 |
| LNU451 | 63499.1 | — | — | — | — | — | — | 0.3 | 0.22 | 9 |
| LNU451 | 63499.5 | — | — | — | 4.9 | 0.05 | 29 | 0.3 | 0.06 | 14 |
| LNU451 | 63500.1 | — | — | — | 4.6 | 0.12 | 22 | 0.3 | 0.06 | 14 |
| LNU424 | 63474.3 | — | — | — | 4.5 | 0.14 | 20 | — | — | — |
| LNU424 | 63476.3 | — | — | — | 4.6 | 0.12 | 22 | 0.3 | 0.18 | 10 |
| LNU424 | 63478.1 | 0.7 | 0.17 | 18 | — | — | — | — | — | — |
| LNU415 | 63691.2 | 0.7 | 0.24 | 16 | — | — | — | — | — | — |
| LNU411 | 63514.3 | — | — | — | 5.0 | 0.04 | 32 | 0.3 | 0.05 | 14 |
| LNU411 | 63518.1 | — | — | — | 4.4 | 0.25 | 16 | 0.3 | 0.13 | 11 |
| LNU375 | 63451.3 | — | — | — | 4.3 | 0.30 | 15 | 0.3 | 0.10 | 12 |
| LNU375 | 63452.2 | — | — | — | 4.4 | 0.24 | 17 | 0.3 | 0.05 | 15 |
| LNU375 | 63452.3 | 0.7 | 0.22 | 18 | — | — | — | — | — | — |
| LNU375 | 63454.1 | 0.7 | 0.11 | 19 | 4.3 | 0.26 | 15 | 0.3 | 0.24 | 8 |
| LNU375 | 63454.2 | — | — | — | 4.7 | 0.10 | 24 | 0.3 | 0.02 | 17 |
| LNU370 | 63544.3 | — | — | — | 4.7 | 0.10 | 24 | 0.3 | 0.07 | 13 |
| LNU370 | 63545.2 | — | — | — | — | — | — | 0.3 | 0.16 | 10 |
| LNU370 | 63545.6 | — | — | — | 4.6 | 0.12 | 23 | 0.3 | 0.06 | 14 |

TABLE 93-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU370 | 63547.1 | 0.7 | 0.24 | 15 | — | — | — | — | — | — |
| LNU370 | 63548.2 | — | — | — | 4.6 | 0.13 | 21 | 0.3 | 0.10 | 11 |
| LNU357 | 63533.1 | — | — | — | 5.2 | 0.01 | 38 | 0.3 | 0.05 | 15 |
| LNU357 | 63533.8 | 0.7 | 0.10 | 21 | 4.5 | 0.15 | 20 | — | — | — |
| LNU357 | 63534.1 | 0.7 | 0.18 | 16 | 5.0 | 0.03 | 34 | 0.3 | 0.01 | 18 |
| LNU356 | 63444.1 | — | — | — | — | — | — | 0.3 | 0.26 | 8 |
| LNU356 | 63444.2 | — | — | — | 4.5 | 0.17 | 19 | 0.3 | 0.18 | 9 |
| LNU356 | 63445.1 | — | — | — | 4.5 | 0.19 | 19 | 0.3 | 0.09 | 12 |
| LNU351 | 63462.1 | — | — | — | 4.4 | 0.29 | 16 | 0.3 | 0.11 | 12 |
| LNU351 | 63462.3 | — | — | — | 4.5 | 0.16 | 20 | 0.3 | 0.11 | 11 |
| LNU351 | 63463.2 | — | — | — | 5.0 | 0.04 | 32 | 0.3 | L | 19 |
| LNU351 | 63464.1 | 0.7 | 0.24 | 17 | — | — | — | 0.3 | 0.20 | 9 |
| LNU351 | 63466.1 | — | — | — | — | — | — | 0.3 | 0.14 | 13 |
| LNU344 | 63521.1 | — | — | — | 4.5 | 0.20 | 18 | 0.3 | 0.12 | 11 |
| LNU330 | 63438.1 | — | — | — | 4.6 | 0.13 | 22 | 0.3 | 0.08 | 13 |
| LNU330 | 63439.1 | — | — | — | — | — | — | 0.3 | 0.24 | 8 |
| LNU330 | 63440.2 | — | — | — | — | — | — | 0.3 | 0.17 | 11 |
| LNU330 | 63441.1 | 0.7 | 0.20 | 19 | — | — | — | — | — | — |
| LNU326 | 63433.2 | — | — | — | — | — | — | 0.3 | 0.23 | 8 |
| LNU326 | 63433.4 | — | — | — | 4.5 | 0.15 | 21 | 0.3 | 0.11 | 11 |
| LNU326 | 63434.1 | 0.7 | 0.27 | 14 | — | — | — | 0.3 | 0.18 | 10 |
| LNU326 | 63435.1 | — | — | — | 5.1 | 0.02 | 36 | 0.3 | 0.01 | 18 |
| LNU319 | 63527.1 | — | — | — | 4.4 | 0.20 | 18 | 0.3 | 0.27 | 8 |
| LNU319 | 63527.2 | 0.7 | 0.23 | 15 | 4.6 | 0.14 | 22 | 0.3 | 0.15 | 10 |
| LNU319 | 63528.1 | — | — | — | 4.8 | 0.06 | 28 | 0.3 | 0.07 | 15 |
| LNU319 | 63530.3 | — | — | — | 4.4 | 0.22 | 18 | 0.3 | 0.19 | 10 |
| LNU308 | 63414.1 | — | — | — | 4.4 | 0.25 | 16 | 0.3 | 0.05 | 14 |
| LNU308 | 63414.4 | — | — | — | 4.7 | 0.08 | 26 | 0.3 | 0.02 | 17 |
| LNU308 | 63417.5 | 0.7 | 0.25 | 14 | 4.8 | 0.06 | 27 | 0.3 | L | 20 |
| LNU308 | 63417.8 | — | — | — | 4.8 | 0.07 | 27 | 0.3 | 0.08 | 12 |
| LNU302 | 63378.3 | — | — | — | 4.4 | 0.25 | 16 | 0.3 | 0.19 | 9 |
| LNU302 | 63379.1 | — | — | — | 4.4 | 0.25 | 17 | 0.3 | 0.27 | 8 |
| LNU302 | 63380.1 | — | — | — | 4.7 | 0.11 | 26 | 0.4 | 0.01 | 24 |
| LNU302 | 63381.1 | — | — | — | 5.2 | 0.01 | 38 | 0.3 | L | 20 |
| LNU302 | 63382.2 | — | — | — | 5.2 | 0.01 | 38 | 0.3 | 0.02 | 17 |
| LNU291 | 63385.1 | — | — | — | 4.3 | 0.29 | 15 | 0.3 | 0.14 | 12 |
| LNU291 | 63385.2 | 0.7 | 0.18 | 18 | 4.8 | 0.06 | 29 | 0.3 | 0.12 | 11 |
| LNU291 | 63387.1 | 0.7 | 0.17 | 18 | 4.3 | 0.28 | 15 | 0.3 | 0.18 | 9 |
| LNU291 | 63387.3 | 0.7 | 0.22 | 15 | 4.6 | 0.11 | 23 | 0.3 | 0.03 | 16 |
| LNU291 | 63388.1 | — | — | — | 4.8 | 0.05 | 28 | 0.3 | 0.07 | 12 |
| CONT. | — | 0.6 | — | — | 3.8 | — | — | 0.3 | — | — |
| LNU444 | 64182.1 | — | — | — | 6.6 | 0.26 | 16 | — | — | — |
| LNU444 | 64182.3 | 0.7 | 0.28 | 19 | — | — | — | — | — | — |
| LNU442 | 64553.1 | 0.7 | 0.28 | 18 | — | — | — | — | — | — |
| LNU442 | 64555.1 | — | — | — | 7.0 | 0.09 | 23 | — | — | — |
| LNU430 | 63935.1 | — | — | — | — | — | — | 0.4 | 0.25 | 12 |
| CONT. | — | 0.6 | — | — | 5.7 | — | — | 0.3 | — | — |
| LNU463 | 64283.4 | 0.7 | 0.26 | 39 | 4.4 | 0.24 | 44 | 0.2 | 0.21 | 38 |
| LNU413 | 65022.4 | — | — | — | 4.3 | 0.26 | 42 | — | — | — |
| LNU373 | 64828.1 | — | — | — | 4.1 | 0.29 | 37 | — | — | — |
| LNU373 | 64830.1 | — | — | — | 4.2 | 0.28 | 39 | — | — | — |
| LNU355 | 65012.1 | — | — | — | 4.2 | 0.29 | 38 | 0.2 | 0.30 | 30 |
| CONT. | — | 0.5 | — | — | 3.0 | — | — | 0.2 | — | — |
| LNU517 | 64296.3 | 0.7 | 0.11 | 24 | 6.5 | 0.06 | 23 | — | — | — |
| LNU517 | 64297.9 | — | — | — | 6.3 | 0.12 | 18 | — | — | — |
| LNU514 | 64364.2 | — | — | — | 7.0 | 0.01 | 31 | 0.4 | 0.28 | 11 |
| LNU514 | 64365.3 | 0.6 | 0.25 | 20 | 6.7 | 0.04 | 25 | 0.4 | 0.26 | 11 |
| LNU514 | 64366.1 | 0.7 | 0.09 | 28 | 6.1 | 0.21 | 15 | — | — | — |
| LNU509 | 64690.3 | 0.7 | 0.10 | 28 | 6.2 | 0.17 | 17 | — | — | — |
| LNU509 | 64690.6 | 0.7 | 0.19 | 24 | — | — | — | — | — | — |
| LNU509 | 64692.3 | — | — | — | — | — | — | 0.4 | 0.30 | 10 |
| LNU501 | 64723.1 | — | — | — | 6.6 | 0.05 | 24 | — | — | — |
| LNU397 | 64375.1 | — | — | — | 6.8 | 0.03 | 27 | 0.4 | 0.19 | 13 |
| LNU396 | 64317.3 | — | — | — | 6.3 | 0.13 | 18 | — | — | — |
| LNU386 | 64394.3 | 0.6 | 0.29 | 18 | — | — | — | — | — | — |
| LNU381 | 64285.5 | 0.7 | 0.17 | 24 | — | — | — | — | — | — |
| LNU372 | 64481.1 | — | — | — | 6.3 | 0.12 | 18 | — | — | — |
| LNU372 | 64483.3 | — | — | — | 6.8 | 0.03 | 27 | — | — | — |
| LNU369 | 64386.1 | — | — | — | 6.3 | 0.13 | 19 | — | — | — |
| LNU369 | 64387.1 | 0.7 | 0.18 | 26 | 6.6 | 0.05 | 24 | — | — | — |
| LNU369 | 64387.2 | 0.6 | 0.25 | 18 | 6.1 | 0.21 | 15 | — | — | — |

TABLE 93-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU369 | 64389.2 | — | — | — | 6.7 | 0.04 | 25 | — | — | — |
| LNU365 | 64708.1 | 0.7 | 0.16 | 23 | — | — | — | — | — | — |
| LNU365 | 64711.3 | 0.7 | 0.08 | 32 | — | — | — | — | — | — |
| LNU350 | 64674.4 | — | — | — | 6.2 | 0.21 | 17 | — | — | — |
| LNU342 | 64035.3 | — | — | — | 6.0 | 0.26 | 14 | — | — | — |
| LNU313 | 64661.8 | — | — | — | 6.4 | 0.11 | 20 | — | — | — |
| LNU313 | 64663.2 | 0.6 | 0.18 | 22 | — | — | — | — | — | — |
| LNU313 | 64664.1 | — | — | — | 6.4 | 0.10 | 20 | — | — | — |
| LNU313 | 64664.3 | 0.6 | 0.20 | 22 | 6.3 | 0.14 | 18 | — | — | — |
| LNU294 | 64658.7 | — | — | — | 6.2 | 0.25 | 16 | — | — | — |
| CONT. | — | 0.5 | — | — | 5.3 | — | — | 0.3 | — | — |
| LNU403 | 64237.1 | — | — | — | 5.2 | 0.05 | 17 | — | — | — |
| LNU335 | 64169.2 | — | — | — | 5.2 | 0.05 | 18 | — | — | — |
| CONT. | — | — | — | — | 4.4 | — | — | — | — | — |
| LNU518 | 64016.4 | — | — | — | 6.0 | 0.27 | 13 | — | — | — |
| LNU496 | 64195.1 | 0.7 | 0.07 | 31 | — | — | — | 0.4 | 0.09 | 8 |
| LNU496 | 64195.6 | — | — | — | 5.9 | 0.26 | 11 | 0.4 | L | 15 |
| LNU493 | 64190.1 | 0.6 | 0.25 | 22 | — | — | — | — | — | — |
| LNU493 | 64191.3 | 0.6 | 0.29 | 23 | — | — | — | — | — | — |
| LNU481 | 64140.1 | — | — | — | — | — | — | 0.4 | 0.15 | 8 |
| LNU472 | 63949.7 | — | — | — | 5.8 | 0.30 | 10 | 0.4 | L | 15 |
| LNU458 | 63895.1 | 0.7 | 0.19 | 28 | 6.0 | 0.19 | 13 | 0.4 | 0.02 | 13 |
| LNU343 | 64208.1 | — | — | — | 6.2 | 0.05 | 18 | 0.4 | 0.13 | 7 |
| LNU343 | 64209.2 | 0.6 | 0.29 | 21 | — | — | — | — | — | — |
| LNU340 | 64290.11 | — | — | — | — | — | — | 0.4 | 0.09 | 8 |
| LNU327 | 64490.2 | — | — | — | — | — | — | 0.4 | 0.04 | 11 |
| LNU327 | 64491.2 | — | — | — | 6.0 | 0.15 | 14 | — | — | — |
| LNU306 | 64132.2 | 0.7 | 0.16 | 25 | — | — | — | — | — | — |
| LNU305 | 64111.3 | 0.7 | 0.21 | 26 | — | — | — | — | — | — |
| CONT. | — | 0.5 | — | — | 5.3 | — | — | 0.3 | — | — |
| LNU403 | 64237.1 | — | — | — | 8.3 | 0.19 | 24 | — | — | — |
| LNU353 | 64033.2 | 0.8 | 0.30 | 12 | — | — | — | — | — | — |
| LNU352 | 64200.10 | — | — | — | 8.2 | 0.23 | 22 | — | — | — |
| LNU335 | 64168.19 | — | — | — | 9.0 | 0.08 | 35 | 0.5 | 0.16 | 18 |
| LNU317 | 64094.1 | 0.8 | 0.21 | 14 | — | — | — | — | — | — |
| CONT. | — | 0.7 | — | — | 6.7 | — | — | 0.4 | — | — |
| LNU468 | 63492.2 | 0.9 | 0.03 | 18 | 10.9 | 0.08 | 26 | 0.5 | 0.04 | 16 |
| LNU468 | 63492.3 | — | — | — | 10.0 | 0.25 | 16 | 0.5 | 0.10 | 13 |
| LNU462 | 63502.2 | 0.9 | 0.04 | 19 | — | — | — | — | — | — |
| LNU462 | 63505.1 | 0.8 | 0.28 | 9 | — | — | — | — | — | — |
| LNU455 | 64187.4 | — | — | — | 10.4 | 0.17 | 20 | 0.5 | 0.23 | 11 |
| LNU455 | 64189.2 | — | — | — | — | — | — | 0.5 | 0.28 | 8 |
| LNU455 | 64189.7 | — | — | — | 11.7 | 0.02 | 35 | 0.5 | 0.04 | 17 |
| LNU450 | 63708.6 | — | — | — | — | — | — | 0.5 | 0.24 | 9 |
| LNU450 | 63710.2 | 0.9 | 0.12 | 12 | — | — | — | — | — | — |
| LNU429 | 63938.8 | 0.8 | 0.22 | 9 | — | — | — | — | — | — |
| LNU425 | 63911.12 | — | — | — | — | — | — | 0.5 | 0.28 | 11 |
| LNU395 | 64145.4 | 0.8 | 0.25 | 10 | — | — | — | — | — | — |
| LNU390 | 63539.2 | 0.9 | 0.17 | 13 | — | — | — | — | — | — |
| LNU390 | 63539.4 | — | — | — | 10.1 | 0.22 | 17 | 0.5 | 0.27 | 8 |
| LNU347 | 63508.1 | 0.9 | 0.12 | 12 | — | — | — | — | — | — |
| LNU347 | 63510.4 | 0.9 | 0.08 | 14 | — | — | — | — | — | — |
| LNU347 | 63513.3 | 0.8 | 0.27 | 10 | — | — | — | — | — | — |
| LNU347 | 63513.4 | — | — | — | — | — | — | 0.5 | 0.27 | 8 |
| LNU329 | 63427.3 | — | — | — | 10.3 | 0.20 | 19 | 0.5 | 0.11 | 14 |
| LNU329 | 63429.1 | 0.8 | 0.25 | 10 | 11.1 | 0.07 | 28 | 0.5 | 0.05 | 16 |
| LNU323 | 63424.1 | — | — | — | 10.2 | 0.21 | 18 | 0.5 | 0.29 | 9 |
| CONT. | — | 0.8 | — | — | 8.7 | — | — | 0.5 | — | — |
| LNU471 | 64838.1 | 0.7 | 0.18 | 25 | — | — | — | — | — | — |
| LNU410 | 64971.1 | — | — | — | 4.3 | 0.03 | 29 | 0.3 | 0.04 | 30 |
| LNU410 | 64972.4 | — | — | — | 4.1 | 0.16 | 21 | 0.3 | 0.19 | 20 |
| LNU382 | 64429.3 | — | — | — | 4.5 | 0.02 | 34 | 0.2 | 0.25 | 17 |
| LNU373 | 64828.1 | 0.7 | 0.19 | 25 | — | — | — | — | — | — |
| LNU361 | 64834.1 | 0.7 | 0.23 | 26 | — | — | — | — | — | — |
| LNU355 | 65013.2 | — | — | — | 4.4 | 0.02 | 31 | 0.3 | 0.05 | 26 |
| LNU307 | 64958.2 | — | — | — | 3.9 | 0.26 | 15 | — | — | — |
| LNU307 | 64959.2 | — | — | — | 4.2 | 0.05 | 25 | 0.3 | 0.12 | 19 |
| LNU303 | 65043.1 | 0.7 | 0.18 | 25 | 4.3 | 0.03 | 27 | — | — | — |
| LNU303 | 65046.3 | 0.7 | 0.14 | 26 | — | — | — | — | — | — |
| LNU300 | 65032.1 | — | — | — | 3.9 | 0.19 | 16 | 0.2 | 0.18 | 17 |
| CONT. | — | 0.5 | — | — | 3.4 | — | — | 0.2 | — | — |

TABLE 93-continued

Genes showing improved rosette growth performance at limiting nitrogen growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU512 | 63468.3 | — | — | — | 8.6 | 0.12 | 27 | — | — | — |
| LNU424 | 63476.3 | — | — | — | 8.8 | 0.10 | 30 | 0.5 | 0.20 | 13 |
| LNU357 | 63532.3 | — | — | — | 8.1 | 0.26 | 19 | — | — | — |
| LNU357 | 63533.1 | 0.9 | 0.28 | 17 | 9.7 | 0.02 | 42 | — | — | — |
| LNU357 | 63533.8 | — | — | — | 8.0 | 0.29 | 18 | — | — | — |
| LNU356 | 63445.1 | — | — | — | 8.7 | 0.11 | 28 | — | — | — |
| LNU351 | 63464.1 | — | — | — | 8.0 | 0.28 | 18 | — | — | — |
| LNU344 | 63520.4 | — | — | — | 8.3 | 0.20 | 22 | — | — | — |
| LNU319 | 63527.1 | — | — | — | 9.5 | 0.03 | 40 | 0.5 | 0.19 | 13 |
| LNU319 | 63528.1 | — | — | — | 8.8 | 0.09 | 29 | — | — | — |
| LNU291 | 63385.1 | — | — | — | 8.4 | 0.20 | 23 | — | — | — |
| CONT. | — | 0.7 | — | — | 6.8 | — | — | 0.4 | — | — |

Table 93.
"CONT."—Control;
"Ave."—Average;
"% Incr." = % increment;
"p-val."—p-value;
L means that p-value is less than 0.01, p < 0.1 was considered as significant.

The genes listed in Tables 94-95 improved plant NUE when grown at standard nitrogen concentration levels. These genes produced larger plants with a larger photosynthetic area and increased biomass (fresh weight, dry weight, leaf number, rosette diameter, rosette area and plot coverage) when grown under standard nitrogen conditions.

TABLE 94

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU507 | 64584.2 | 60.0 | 0.10 | 36 | 706.2 | 0.06 | 37 | — | — | — |
| LNU507 | 64585.2 | 53.1 | 0.16 | 21 | 712.5 | 0.05 | 38 | — | — | — |
| LNU494 | 65299.1 | — | — | — | 618.8 | 0.27 | 20 | — | — | — |
| LNU479 | 65497.5 | 61.9 | 0.01 | 41 | 762.5 | 0.03 | 48 | 10.9 | 0.20 | 9 |
| LNU479 | 65499.1 | — | — | — | — | — | — | 10.8 | 0.27 | 8 |
| LNU418 | 65027.2 | 62.5 | 0.03 | 42 | 787.5 | 0.02 | 53 | 11.0 | 0.05 | 10 |
| LNU401 | 65493.2 | 51.9 | 0.17 | 18 | — | — | — | — | — | — |
| LNU401 | 65493.3 | — | — | — | 643.8 | 0.18 | 25 | — | — | — |
| LNU401 | 65494.1 | — | — | — | 768.8 | 0.22 | 49 | — | — | — |
| LNU388 | 65487.1 | 54.4 | 0.12 | 24 | — | — | — | — | — | — |
| LNU377 | 64604.3 | — | — | — | — | — | — | 10.5 | 0.26 | 5 |
| LNU377 | 64604.6 | 60.6 | 0.12 | 38 | 706.2 | 0.06 | 37 | — | — | — |
| LNU368 | 64004.3 | 56.2 | 0.05 | 28 | 718.8 | 0.05 | 40 | 10.7 | 0.16 | 7 |
| LNU368 | 64005.1 | 52.5 | 0.30 | 19 | — | — | — | — | — | — |
| LNU344 | 63521.1 | 61.2 | 0.04 | 39 | 806.2 | 0.02 | 57 | 11.2 | 0.03 | 12 |
| LNU339 | 65055.1 | 55.6 | 0.15 | 27 | 656.2 | 0.14 | 28 | — | — | — |
| LNU337 | 64953.1 | — | — | — | — | — | — | 11.5 | 0.19 | 15 |
| LNU337 | 64954.1 | — | — | — | — | — | — | 11.2 | 0.03 | 12 |
| LNU337 | 64955.2 | — | — | — | 656.2 | 0.14 | 28 | — | — | — |
| LNU333 | 65298.4 | 50.6 | 0.22 | 15 | — | — | — | — | — | — |
| LNU324 | 64234.3 | 51.9 | 0.22 | 18 | 693.8 | 0.16 | 35 | 10.5 | 0.27 | 5 |
| LNU318 | 65067.2 | 53.1 | 0.23 | 21 | — | — | — | — | — | — |
| LNU318 | 65069.1 | 55.0 | 0.20 | 25 | — | — | — | — | — | — |
| LNU296 | 65060.2 | — | — | — | 650.0 | 0.17 | 26 | 10.8 | 0.18 | 8 |
| LNU296 | 65061.2 | 52.5 | 0.22 | 19 | — | — | — | — | — | — |
| CONT. | — | 44.0 | — | — | 514.6 | — | — | 10.0 | — | — |
| LNU507 | 64584.1 | 41.9 | 0.15 | 25 | 481.2 | 0.03 | 45 | — | — | — |
| LNU507 | 64585.2 | — | — | — | 400.9 | 0.25 | 21 | 12.1 | 0.21 | 4 |
| LNU494 | 65299.1 | 36.9 | 0.27 | 10 | 400.0 | 0.24 | 21 | — | — | — |
| LNU494 | 65300.2 | 44.4 | 0.27 | 32 | 500.0 | 0.14 | 51 | — | — | — |
| LNU494 | 65302.1 | 44.4 | 0.02 | 32 | 425.0 | 0.13 | 28 | — | — | — |
| LNU494 | 65303.2 | 44.4 | 0.02 | 32 | 487.5 | 0.03 | 47 | — | — | — |
| LNU479 | 65497.3 | 43.8 | 0.01 | 30 | 512.5 | 0.02 | 55 | — | — | — |
| LNU479 | 65497.5 | — | — | — | 556.2 | 0.27 | 68 | — | — | — |
| LNU479 | 65499.1 | — | — | — | 531.2 | 0.02 | 60 | 12.4 | 0.05 | 7 |
| LNU423 | 64596.1 | — | — | — | 481.2 | 0.27 | 45 | — | — | — |

TABLE 94-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU423 | 64598.3 | 36.9 | 0.27 | 10 | — | — | — | — | — | — |
| LNU401 | 65492.4 | — | — | — | — | — | — | 12.2 | 0.15 | 6 |
| LNU401 | 65493.2 | 43.8 | 0.01 | 30 | 481.2 | 0.09 | 45 | — | — | — |
| LNU401 | 65493.3 | — | — | — | 550.0 | 0.09 | 66 | 12.4 | 0.22 | 7 |
| LNU401 | 65494.1 | 43.8 | 0.24 | 30 | 500.0 | 0.20 | 51 | — | — | — |
| LNU401 | 65494.2 | — | — | — | 431.2 | 0.28 | 30 | — | — | — |
| LNU388 | 65487.2 | 38.1 | 0.15 | 14 | — | — | — | — | — | — |
| LNU388 | 65488.1 | 39.4 | 0.26 | 17 | 406.2 | 0.21 | 23 | — | — | — |
| LNU388 | 65489.4 | — | — | — | — | — | — | 12.8 | 0.07 | 11 |
| LNU377 | 64604.6 | 40.0 | 0.06 | 19 | 406.2 | 0.27 | 23 | — | — | — |
| LNU377 | 64605.1 | 43.8 | 0.01 | 30 | — | — | — | 12.9 | L | 12 |
| LNU348 | 64472.2 | — | — | — | 392.9 | 0.29 | 19 | — | — | — |
| LNU339 | 65058.2 | — | — | — | 406.2 | 0.21 | 23 | — | — | — |
| LNU337 | 64955.2 | — | — | — | 412.5 | 0.21 | 25 | — | — | — |
| LNU336 | 64448.3 | 38.8 | 0.11 | 16 | 418.8 | 0.15 | 26 | 12.2 | 0.13 | 5 |
| LNU336 | 64449.3 | 38.8 | 0.23 | 16 | 462.5 | 0.28 | 40 | 12.0 | 0.21 | 4 |
| LNU336 | 64449.4 | 40.6 | 0.19 | 21 | — | — | — | — | — | — |
| LNU333 | 65295.2 | 38.8 | 0.11 | 16 | 437.5 | 0.10 | 32 | — | — | — |
| LNU333 | 65297.1 | — | — | — | — | — | — | 12.9 | L | 12 |
| LNU333 | 65297.2 | 43.1 | 0.03 | 29 | 456.2 | 0.06 | 38 | — | — | — |
| LNU324 | 64233.4 | 41.2 | 0.11 | 23 | 500.0 | 0.03 | 51 | — | — | — |
| LNU318 | 65067.1 | 38.1 | 0.22 | 14 | — | — | — | 12.0 | 0.21 | 4 |
| LNU318 | 65067.2 | — | — | — | — | — | — | 12.0 | 0.21 | 4 |
| LNU304 | 64572.2 | 38.1 | 0.15 | 14 | 443.8 | 0.12 | 34 | — | — | — |
| LNU304 | 64575.2 | — | — | — | — | — | — | 12.9 | 0.13 | 12 |
| LNU296 | 65062.2 | — | — | — | 400.0 | 0.24 | 21 | — | — | — |
| LNU296 | 65064.1 | — | — | — | 450.0 | 0.12 | 36 | 12.4 | 0.22 | 7 |
| LNU292 | 64085.1 | — | — | — | 400.0 | 0.24 | 21 | — | — | — |
| CONT. | — | 33.5 | — | — | 331.2 | — | — | 11.6 | — | — |
| LNU519 | 64681.3 | — | — | — | 743.8 | 0.18 | 10 | — | — | — |
| LNU469 | 64311.5 | — | — | — | — | — | — | 10.4 | 0.15 | 7 |
| LNU469 | 64311.8 | 77.5 | 0.11 | 25 | — | — | — | 10.1 | 0.19 | 4 |
| LNU459 | 64541.4 | — | — | — | — | — | — | 10.1 | 0.23 | 3 |
| LNU442 | 64060.2 | — | — | — | — | — | — | 10.3 | 0.12 | 6 |
| LNU420 | 64008.4 | 74.4 | 0.04 | 20 | — | — | — | — | — | — |
| LNU416 | 64137.1 | 69.4 | 0.17 | 12 | — | — | — | — | — | — |
| LNU409 | 64687.2 | — | — | — | 806.2 | 0.11 | 20 | — | — | — |
| LNU409 | 64689.3 | — | — | — | 755.4 | 0.19 | 12 | 10.5 | 0.11 | 8 |
| LNU408 | 64248.10 | — | — | — | 737.5 | 0.21 | 10 | — | — | — |
| LNU363 | 64410.2 | — | — | — | 750.0 | 0.15 | 11 | — | — | — |
| LNU314 | 64433.1 | — | — | — | — | — | — | 10.4 | 0.03 | 7 |
| CONT. | — | 61.8 | — | — | 673.2 | — | — | 9.7 | — | — |
| LNU514 | 64364.2 | 73.8 | 0.15 | 16 | — | — | — | — | — | — |
| LNU509 | 64690.3 | 71.9 | 0.26 | 13 | — | — | — | — | — | — |
| LNU397 | 64376.4 | 71.2 | 0.16 | 12 | 800.0 | 0.18 | 13 | — | — | — |
| LNU369 | 64389.2 | 68.8 | 0.26 | 8 | — | — | — | — | — | — |
| LNU342 | 64036.2 | 77.5 | 0.21 | 22 | — | — | — | — | — | — |
| CONT. | — | 63.6 | — | — | 705.7 | — | — | — | — | — |
| LNU513 | 63458.2 | 214.0 | 0.15 | 36 | 2432.1 | 0.19 | 40 | — | — | — |
| LNU512 | 63470.1 | 185.0 | 0.25 | 17 | — | — | — | 9.9 | 0.08 | 7 |
| LNU451 | 63496.2 | 190.6 | 0.06 | 21 | 2243.8 | 0.03 | 29 | — | — | — |
| LNU451 | 63499.1 | — | — | — | — | — | — | 9.6 | 0.27 | 3 |
| LNU451 | 63499.5 | 198.8 | 0.23 | 26 | 2306.2 | 0.25 | 33 | 10.0 | 0.03 | 8 |
| LNU451 | 63500.1 | — | — | — | 2018.7 | 0.14 | 16 | 10.1 | 0.02 | 9 |
| LNU424 | 63474.3 | 183.8 | 0.12 | 16 | 2181.2 | 0.17 | 25 | 9.9 | 0.03 | 7 |
| LNU415 | 63691.2 | — | — | — | — | — | — | 9.6 | 0.27 | 3 |
| LNU415 | 63692.2 | — | — | — | — | — | — | 9.7 | 0.13 | 4 |
| LNU415 | 63693.4 | — | — | — | — | — | — | 9.7 | 0.23 | 4 |
| LNU411 | 63514.3 | 191.2 | 0.06 | 21 | 2250.0 | 0.02 | 29 | 9.6 | 0.27 | 3 |
| LNU411 | 63515.3 | 173.8 | 0.28 | 10 | 1981.2 | 0.16 | 14 | — | — | — |
| LNU375 | 63452.2 | 199.6 | 0.03 | 26 | 2375.0 | L | 37 | 10.1 | 0.20 | 9 |
| LNU375 | 63454.1 | 184.8 | 0.13 | 17 | 2086.6 | 0.07 | 20 | — | — | — |
| LNU375 | 63454.2 | — | — | — | — | — | — | 9.7 | 0.13 | 4 |
| LNU370 | 63544.3 | 179.4 | 0.20 | 14 | 2143.8 | 0.04 | 23 | — | — | — |
| LNU370 | 63545.6 | 200.0 | 0.07 | 27 | 2306.2 | 0.08 | 33 | — | — | — |
| LNU370 | 63547.1 | — | — | — | 1943.8 | 0.27 | 12 | — | — | — |
| LNU370 | 63548.2 | — | — | — | 1956.2 | 0.20 | 12 | — | — | — |
| LNU357 | 63532.3 | — | — | — | — | — | — | 9.9 | 0.03 | 7 |
| LNU357 | 63533.1 | 210.6 | 0.01 | 33 | 2556.2 | 0.01 | 47 | 10.1 | 0.20 | 9 |
| LNU357 | 63533.8 | 184.4 | 0.10 | 17 | 2100.0 | 0.06 | 21 | — | — | — |
| LNU357 | 63534.1 | 175.0 | 0.27 | 11 | 1993.8 | 0.22 | 15 | — | — | — |
| LNU356 | 63445.1 | — | — | — | 1931.2 | 0.26 | 11 | — | — | — |
| LNU351 | 63466.1 | — | — | — | 2066.1 | 0.14 | 19 | 10.0 | 0.12 | 8 |

TABLE 94-continued

Genes showing improved plant biomass production at standard nitrogen growth conditions

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LNU330 | 63439.1 | — | — | — | — | — | — | 9.8 | 0.09 | 5 |
| LNU326 | 63433.2 | — | — | — | — | — | — | 9.6 | 0.27 | 3 |
| LNU326 | 63433.4 | 186.2 | 0.09 | 18 | 2125.0 | 0.06 | 22 | — | — | — |
| LNU326 | 63435.1 | 177.5 | 0.27 | 12 | 2056.2 | 0.21 | 18 | — | — | — |
| LNU319 | 63527.1 | 175.6 | 0.24 | 11 | 2000.0 | 0.16 | 15 | — | — | — |
| LNU319 | 63528.1 | 183.1 | 0.26 | 16 | — | — | — | — | — | — |
| LNU319 | 63530.1 | — | — | — | 1919.6 | 0.28 | 10 | — | — | — |
| LNU319 | 63530.3 | 192.5 | 0.07 | 22 | 2212.5 | 0.07 | 27 | — | — | — |
| LNU308 | 63414.1 | 185.6 | 0.09 | 18 | 2093.8 | 0.06 | 20 | — | — | — |
| LNU308 | 63414.4 | 173.8 | 0.30 | 10 | 2056.2 | 0.09 | 18 | — | — | — |
| LNU308 | 63415.3 | — | — | — | 2037.5 | 0.17 | 17 | — | — | — |
| LNU308 | 63417.5 | 184.4 | 0.30 | 17 | — | — | — | — | — | — |
| LNU308 | 63417.8 | 200.0 | 0.03 | 27 | 2300.0 | 0.02 | 32 | 9.9 | 0.08 | 7 |
| LNU302 | 63378.3 | — | — | — | — | — | — | 9.6 | 0.27 | 3 |
| LNU302 | 63380.1 | 186.9 | 0.08 | 18 | 2181.2 | 0.03 | 25 | 9.6 | 0.27 | 3 |
| LNU302 | 63381.1 | 190.6 | 0.06 | 21 | 2162.5 | 0.04 | 24 | — | — | — |
| LNU302 | 63382.2 | 205.6 | 0.02 | 30 | 2462.5 | L | 42 | — | — | — |
| LNU291 | 63385.2 | — | — | — | 1937.5 | 0.24 | 11 | — | — | — |
| LNU291 | 63387.1 | 181.2 | 0.22 | 15 | 2112.5 | 0.12 | 21 | 10.1 | 0.20 | 9 |
| CONT. | — | 157.9 | — | — | 1739.6 | — | — | 9.3 | — | — |
| LNU496 | 64194.2 | — | — | — | — | — | — | 10.2 | 0.22 | 4 |
| LNU496 | 64195.6 | 59.4 | 0.25 | 6 | — | — | — | — | — | — |
| LNU482 | 64164.2 | — | — | — | 762.5 | 0.22 | 8 | — | — | — |
| LNU477 | 63886.1 | 65.0 | L | 16 | 787.5 | 0.09 | 12 | 10.8 | 0.03 | 10 |
| LNU477 | 63888.1 | 60.0 | 0.10 | 7 | — | — | — | — | — | — |
| LNU477 | 63889.5 | — | — | — | 768.8 | 0.19 | 9 | 10.2 | 0.22 | 4 |
| LNU469 | 64311.8 | — | — | — | 843.8 | 0.24 | 20 | 10.9 | 0.11 | 12 |
| LNU444 | 64182.1 | — | — | — | — | — | — | 10.6 | 0.06 | 8 |
| LNU444 | 64182.3 | 60.6 | 0.16 | 9 | — | — | — | — | — | — |
| LNU442 | 64056.1 | — | — | — | 818.8 | 0.15 | 16 | 10.6 | L | 8 |
| LNU442 | 64060.2 | 60.6 | 0.03 | 9 | 806.2 | 0.06 | 14 | — | — | — |
| LNU430 | 63935.1 | 61.9 | 0.26 | 11 | 850.0 | 0.13 | 21 | 10.3 | 0.02 | 5 |
| LNU430 | 63936.1 | 60.0 | 0.10 | 7 | — | — | — | — | — | — |
| LNU391 | 63980.6 | 59.4 | 0.08 | 6 | — | — | — | — | — | — |
| LNU376 | 63987.3 | 70.6 | 0.26 | 26 | 918.8 | 0.04 | 30 | 11.0 | L | 12 |
| LNU366 | 64027.9 | — | — | — | — | — | — | 10.2 | 0.06 | 4 |
| LNU366 | 64028.3 | — | — | — | — | — | — | 11.0 | L | 12 |
| LNU363 | 64409.2 | 59.4 | 0.25 | 6 | — | — | — | — | — | — |
| LNU353 | 64032.3 | — | — | — | 818.8 | 0.08 | 16 | — | — | — |
| LNU314 | 64437.2 | — | — | — | — | — | — | 10.5 | 0.02 | 7 |
| CONT. | — | 55.8 | — | — | 704.2 | — | — | 9.8 | — | — |
| LNU511 | 65036.2 | 72.5 | 0.23 | 23 | 900.0 | 0.20 | 23 | — | — | — |
| LNU511 | 65037.1 | 72.5 | 0.02 | 23 | 1012.5 | 0.15 | 38 | — | — | — |
| LNU511 | 65037.3 | 65.6 | 0.10 | 12 | — | — | — | 11.2 | 0.20 | 4 |
| LNU492 | 64174.1 | 72.5 | 0.08 | 23 | — | — | — | 11.4 | L | 6 |
| LNU492 | 64174.2 | 78.1 | 0.22 | 33 | 906.2 | 0.07 | 24 | — | — | — |
| LNU492 | 64175.1 | 66.2 | 0.23 | 13 | 856.2 | 0.12 | 17 | — | — | — |
| LNU492 | 64176.4 | 78.8 | 0.09 | 34 | 993.8 | L | 36 | — | — | — |
| LNU476 | 64041.2 | 68.1 | 0.03 | 16 | 931.2 | 0.02 | 27 | — | — | — |
| LNU476 | 64042.1 | 73.1 | 0.11 | 25 | 925.0 | 0.16 | 26 | — | — | — |
| LNU476 | 64043.3 | 66.9 | 0.15 | 14 | — | — | — | 11.6 | 0.23 | 8 |
| LNU471 | 64838.1 | 63.8 | 0.17 | 9 | — | — | — | — | — | — |
| LNU471 | 64838.3 | 80.6 | 0.05 | 37 | 950.0 | 0.08 | 30 | 11.9 | 0.07 | 10 |
| LNU471 | 64839.2 | 79.4 | 0.11 | 35 | 918.8 | 0.03 | 26 | — | — | — |
| LNU471 | 64841.3 | 63.8 | 0.15 | 9 | 862.5 | 0.23 | 18 | 11.4 | L | 6 |
| LNU463 | 64280.4 | — | — | — | 862.5 | 0.09 | 18 | — | — | — |
| LNU463 | 64281.3 | 79.4 | 0.16 | 35 | 987.5 | L | 35 | — | — | — |
| LNU463 | 64282.12 | 66.4 | 0.21 | 13 | — | — | — | — | — | — |
| LNU463 | 64283.4 | 65.6 | 0.20 | 12 | — | — | — | 11.4 | 0.01 | 6 |
| LNU454 | 64796.2 | — | — | — | — | — | — | 11.5 | 0.27 | 7 |
| LNU454 | 64796.3 | 75.0 | L | 28 | 881.2 | 0.06 | 20 | — | — | — |
| LNU454 | 64797.2 | — | — | — | — | — | — | 11.6 | L | 7 |
| LNU454 | 64800.5 | 71.2 | 0.03 | 21 | 818.8 | 0.25 | 12 | — | — | — |
| LNU422 | 64965.2 | 78.8 | 0.14 | 34 | 993.8 | 0.26 | 36 | — | — | — |
| LNU422 | 64966.2 | — | — | — | 837.5 | 0.19 | 14 | — | — | — |
| LNU422 | 64969.1 | 66.9 | 0.06 | 14 | — | — | — | — | — | — |
| LNU413 | 65019.1 | — | — | — | 968.8 | 0.09 | 32 | 11.4 | 0.03 | 6 |
| LNU413 | 65019.2 | 64.4 | 0.12 | 10 | 831.2 | 0.17 | 14 | — | — | — |
| LNU413 | 65021.4 | 79.4 | 0.06 | 35 | 987.5 | L | 35 | — | — | — |
| LNU413 | 65021.5 | 69.4 | 0.02 | 18 | 862.5 | 0.12 | 18 | — | — | — |
| LNU413 | 65022.4 | 75.6 | 0.03 | 29 | 868.8 | 0.24 | 19 | — | — | — |
| LNU410 | 64971.1 | — | — | — | 806.2 | 0.28 | 10 | — | — | — |
| LNU410 | 64971.2 | — | — | — | 912.5 | 0.17 | 25 | — | — | — |

TABLE 94-continued

Genes showing improved plant biomass production at standard nitrogen growth conditions

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LNU410 | 64974.3 | — | — | — | — | — | — | 11.3 | 0.30 | 5 |
| LNU387 | 64808.1 | — | — | — | 906.2 | 0.04 | 24 | 11.1 | 0.14 | 3 |
| LNU387 | 64811.2 | — | — | — | — | — | — | 11.2 | 0.05 | 4 |
| LNU387 | 64811.3 | 66.9 | 0.06 | 14 | 862.5 | 0.09 | 18 | 11.6 | 0.30 | 7 |
| LNU382 | 64428.2 | — | — | — | 881.2 | 0.06 | 20 | 11.6 | 0.30 | 7 |
| LNU382 | 64429.3 | 73.1 | L | 25 | 850.0 | 0.11 | 16 | 11.1 | 0.14 | 3 |
| LNU382 | 64430.1 | 66.9 | 0.04 | 14 | 893.8 | 0.05 | 22 | — | — | — |
| LNU373 | 64826.4 | — | — | — | 837.5 | 0.16 | 14 | 11.5 | 0.27 | 7 |
| LNU373 | 64827.2 | 73.1 | 0.11 | 25 | 893.8 | 0.04 | 22 | — | — | — |
| LNU373 | 64828.1 | — | — | — | 893.8 | 0.06 | 22 | 11.1 | 0.13 | 3 |
| LNU373 | 64830.1 | — | — | — | 837.5 | 0.19 | 14 | — | — | — |
| LNU361 | 64832.1 | 82.5 | 0.07 | 40 | 1068.8 | 0.07 | 46 | — | — | — |
| LNU361 | 64836.2 | 83.8 | L | 43 | 981.2 | 0.04 | 34 | — | — | — |
| LNU355 | 65012.1 | 68.1 | 0.03 | 16 | 818.8 | 0.25 | 12 | — | — | — |
| LNU355 | 65012.2 | 70.0 | 0.01 | 19 | 881.2 | 0.06 | 20 | — | — | — |
| LNU355 | 65014.2 | — | — | — | 900.0 | 0.06 | 23 | — | — | — |
| LNU355 | 65015.2 | 80.0 | L | 36 | 956.2 | 0.01 | 31 | 11.4 | L | 6 |
| LNU332 | 64821.1 | 73.1 | 0.25 | 25 | 856.2 | 0.16 | 17 | 11.4 | 0.03 | 6 |
| LNU332 | 64822.4 | — | — | — | — | — | — | 11.6 | L | 8 |
| LNU332 | 64824.3 | — | — | — | — | — | — | 11.6 | 0.19 | 7 |
| LNU332 | 64824.4 | 63.8 | 0.15 | 9 | — | — | — | 11.2 | 0.20 | 4 |
| LNU307 | 64958.2 | — | — | — | — | — | — | 11.3 | 0.02 | 5 |
| LNU307 | 64959.2 | 66.2 | 0.05 | 13 | 856.2 | 0.10 | 17 | — | — | — |
| LNU307 | 64960.2 | — | — | — | 831.2 | 0.17 | 14 | 11.1 | 0.14 | 3 |
| LNU303 | 65042.2 | 65.0 | 0.18 | 11 | 825.0 | 0.19 | 13 | 11.1 | 0.07 | 3 |
| LNU303 | 65043.1 | 63.1 | 0.21 | 8 | — | — | — | — | — | — |
| LNU303 | 65043.2 | 70.6 | 0.07 | 20 | 875.0 | 0.07 | 20 | 11.6 | 0.11 | 8 |
| LNU303 | 65046.1 | 68.1 | 0.04 | 16 | 912.5 | 0.03 | 25 | 11.4 | 0.23 | 6 |
| LNU303 | 65046.3 | 65.0 | 0.30 | 11 | 812.5 | 0.25 | 11 | — | — | — |
| LNU300 | 65030.2 | 71.2 | L | 21 | — | — | — | — | — | — |
| LNU300 | 65031.3 | 78.8 | 0.27 | 34 | 1012.5 | L | 38 | — | — | — |
| LNU300 | 65033.1 | 83.8 | 0.10 | 43 | 943.8 | 0.02 | 29 | — | — | — |
| LNU300 | 65033.3 | — | — | — | 875.0 | 0.07 | 20 | — | — | — |
| CONT. | — | 58.7 | — | — | 731.8 | — | — | 10.8 | — | — |
| LNU517 | 64297.9 | — | — | — | — | — | — | 10.5 | L | 14 |
| LNU514 | 64364.2 | — | — | — | — | — | — | 9.8 | 0.13 | 6 |
| LNU514 | 64365.3 | — | — | — | — | — | — | 9.8 | 0.13 | 6 |
| LNU514 | 64366.1 | — | — | — | — | — | — | 9.8 | 0.29 | 6 |
| LNU509 | 64690.3 | — | — | — | — | — | — | 10.2 | 0.05 | 10 |
| LNU509 | 64690.6 | 79.4 | 0.19 | 7 | — | — | — | — | — | — |
| LNU509 | 64692.3 | — | — | — | — | — | — | 10.4 | 0.17 | 12 |
| LNU509 | 64692.6 | — | — | — | — | — | — | 9.9 | 0.09 | 7 |
| LNU504 | 64453.2 | — | — | — | — | — | — | 9.8 | 0.06 | 5 |
| LNU501 | 64196.1 | 83.8 | 0.06 | 13 | — | — | — | 9.7 | 0.19 | 5 |
| LNU501 | 64197.1 | 82.8 | 0.20 | 11 | — | — | — | 9.9 | L | 7 |
| LNU501 | 64723.1 | — | — | — | — | — | — | 10.1 | L | 9 |
| LNU461 | 64666.1 | — | — | — | — | — | — | 10.0 | 0.02 | 8 |
| LNU461 | 64667.4 | 94.4 | L | 27 | 1106.2 | 0.01 | 25 | — | — | — |
| LNU461 | 64668.5 | — | — | — | — | — | — | 10.3 | 0.23 | 11 |
| LNU461 | 64669.3 | 83.1 | 0.02 | 12 | — | — | — | 9.6 | 0.30 | 3 |
| LNU397 | 64375.1 | — | — | — | — | — | — | 10.1 | 0.01 | 9 |
| LNU396 | 64315.13 | 91.2 | 0.01 | 23 | — | — | — | 10.1 | 0.19 | 9 |
| LNU386 | 64393.1 | 80.0 | 0.21 | 8 | — | — | — | 9.4 | 0.25 | 2 |
| LNU386 | 64395.3 | — | — | — | — | — | — | 9.9 | 0.09 | 7 |
| LNU381 | 64286.4 | 87.5 | 0.17 | 18 | 956.2 | 0.24 | 8 | — | — | — |
| LNU372 | 64481.1 | — | — | — | — | — | — | 10.2 | 0.05 | 10 |
| LNU372 | 64483.3 | — | — | — | — | — | — | 10.5 | L | 14 |
| LNU372 | 64485.1 | — | — | — | — | — | — | 10.0 | 0.02 | 8 |
| LNU372 | 64485.3 | 83.8 | 0.27 | 13 | — | — | — | — | — | — |
| LNU369 | 64386.1 | 81.2 | 0.05 | 9 | — | — | — | — | — | — |
| LNU369 | 64387.1 | — | — | — | — | — | — | 10.1 | 0.12 | 9 |
| LNU369 | 64389.2 | 87.9 | L | 18 | — | — | — | — | — | — |
| LNU365 | 64711.2 | 92.5 | 0.22 | 24 | — | — | — | — | — | — |
| LNU365 | 64712.3 | — | — | — | — | — | — | 10.2 | 0.26 | 10 |
| LNU350 | 64674.2 | — | — | — | 1025.0 | 0.14 | 15 | — | — | — |
| LNU350 | 64674.4 | 82.7 | 0.03 | 11 | — | — | — | — | — | — |
| LNU350 | 64677.2 | 89.9 | L | 21 | — | — | — | 10.0 | L | 8 |
| LNU345 | 64333.4 | 81.2 | 0.06 | 9 | — | — | — | — | — | — |
| LNU345 | 64337.1 | — | — | — | 1015.2 | 0.07 | 14 | 9.6 | 0.12 | 4 |
| LNU342 | 64035.4 | — | — | — | — | — | — | 10.1 | 0.01 | 9 |
| LNU342 | 64036.2 | 81.9 | 0.29 | 10 | — | — | — | 10.8 | 0.05 | 16 |
| LNU313 | 64663.2 | — | — | — | — | — | — | 10.5 | L | 14 |
| LNU313 | 64664.1 | — | — | — | — | — | — | 9.8 | 0.06 | 5 |

TABLE 94-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU294 | 64657.2 | — | — | — | — | — | — | 9.5 | 0.25 | 3 |
| LNU294 | 64658.7 | — | — | — | — | — | — | 9.6 | 0.30 | 3 |
| CONT. | — | 74.4 | — | — | 887.5 | — | — | 9.2 | — | — |
| LNU520 | 64156.14 | — | — | — | 681.2 | 0.10 | 8 | — | — | — |
| LNU481 | 64138.6 | 61.6 | 0.21 | 18 | — | — | — | — | — | — |
| LNU481 | 64141.1 | — | — | — | — | — | — | 9.9 | 0.07 | 5 |
| LNU477 | 63888.1 | — | — | — | — | — | — | 9.6 | 0.20 | 2 |
| LNU472 | 63920.6 | — | — | — | 756.2 | 0.21 | 20 | — | — | — |
| LNU472 | 63949.8 | 67.5 | 0.21 | 29 | — | — | — | — | — | — |
| LNU458 | 63893.1 | — | — | — | — | — | — | 10.2 | 0.12 | 9 |
| LNU456 | 63991.8 | — | — | — | — | — | — | 10.1 | 0.28 | 7 |
| LNU439 | 64615.4 | — | — | — | 789.3 | 0.18 | 25 | 9.8 | 0.03 | 4 |
| LNU419 | 63896.2 | — | — | — | 775.0 | 0.27 | 23 | 9.9 | 0.07 | 5 |
| LNU419 | 63897.5 | — | — | — | 768.8 | 0.04 | 22 | 9.8 | 0.22 | 4 |
| LNU407 | 64219.2 | 57.5 | 0.10 | 10 | — | — | — | 10.1 | 0.09 | 7 |
| LNU393 | 63977.3 | 60.0 | 0.02 | 15 | 693.8 | 0.05 | 10 | — | — | — |
| LNU393 | 63978.6 | — | — | — | 731.2 | 0.28 | 16 | 9.6 | 0.20 | 2 |
| LNU374 | 63997.5 | — | — | — | — | — | — | 10.4 | 0.10 | 10 |
| LNU335 | 64169.2 | — | — | — | 875.0 | 0.26 | 39 | 9.8 | 0.22 | 4 |
| CONT. | — | 52.4 | — | — | 629.2 | — | — | 9.4 | — | — |
| LNU520 | 64156.14 | 68.8 | 0.06 | 22 | 531.2 | 0.26 | 12 | 9.8 | 0.06 | 6 |
| LNU518 | 64014.3 | 80.6 | L | 43 | — | — | — | — | — | — |
| LNU518 | 64014.5 | 65.0 | 0.29 | 16 | 559.8 | 0.03 | 18 | 9.6 | 0.18 | 4 |
| LNU518 | 64015.4 | — | — | — | — | — | — | 9.9 | 0.06 | 6 |
| LNU518 | 64016.3 | 64.4 | 0.21 | 14 | — | — | — | 9.6 | 0.27 | 3 |
| LNU518 | 64016.4 | 62.5 | 0.29 | 11 | — | — | — | 9.9 | 0.06 | 6 |
| LNU500 | 64221.2 | 85.6 | 0.07 | 52 | 556.2 | 0.06 | 18 | — | — | — |
| LNU500 | 64223.1 | 67.5 | 0.13 | 20 | 575.0 | 0.02 | 22 | 9.8 | 0.14 | 6 |
| LNU500 | 64223.2 | — | — | — | — | — | — | 9.7 | 0.13 | 4 |
| LNU496 | 64193.3 | 68.8 | 0.05 | 22 | — | — | — | — | — | — |
| LNU496 | 64194.2 | — | — | — | 518.8 | 0.17 | 10 | — | — | — |
| LNU493 | 64190.1 | 62.5 | 0.29 | 11 | — | — | — | — | — | — |
| LNU493 | 64190.3 | — | — | — | — | — | — | 10.1 | 0.02 | 9 |
| LNU493 | 64191.3 | — | — | — | 543.8 | 0.19 | 15 | — | — | — |
| LNU493 | 64191.4 | — | — | — | 543.8 | 0.19 | 15 | — | — | — |
| LNU481 | 64138.6 | — | — | — | 556.2 | 0.15 | 18 | — | — | — |
| LNU481 | 64140.1 | 68.1 | 0.09 | 21 | 518.8 | 0.23 | 10 | 9.8 | 0.12 | 5 |
| LNU481 | 64141.1 | — | — | — | — | — | — | 10.2 | L | 10 |
| LNU458 | 63893.3 | — | — | — | — | — | — | 9.8 | 0.12 | 5 |
| LNU419 | 63897.6 | 65.0 | 0.21 | 16 | 568.8 | 0.02 | 20 | — | — | — |
| LNU405 | 64158.9 | — | — | — | — | — | — | 9.8 | 0.06 | 6 |
| LNU405 | 64159.6 | — | — | — | — | — | — | 9.9 | 0.04 | 6 |
| LNU405 | 64159.8 | 73.8 | 0.29 | 31 | 556.2 | 0.03 | 18 | — | — | — |
| LNU343 | 64208.1 | — | — | — | 606.2 | 0.01 | 28 | 10.5 | L | 13 |
| LNU343 | 64208.2 | — | — | — | — | — | — | 9.6 | 0.27 | 3 |
| LNU343 | 64208.4 | 63.1 | 0.28 | 12 | 612.5 | 0.23 | 30 | — | — | — |
| LNU340 | 64290.11 | — | — | — | 518.8 | 0.17 | 10 | — | — | — |
| LNU340 | 64290.7 | — | — | — | 525.0 | 0.24 | 11 | 9.9 | 0.09 | 7 |
| LNU340 | 64292.5 | — | — | — | — | — | — | 9.8 | 0.06 | 6 |
| LNU328 | 64150.1 | 68.1 | 0.14 | 21 | 581.2 | 0.01 | 23 | 10.1 | 0.02 | 9 |
| LNU328 | 64150.2 | — | — | — | 537.5 | 0.16 | 14 | — | — | — |
| LNU328 | 64150.4 | — | — | — | — | — | — | 9.8 | 0.08 | 5 |
| LNU327 | 64487.2 | — | — | — | 618.8 | 0.30 | 31 | — | — | — |
| LNU327 | 64491.2 | — | — | — | 568.8 | 0.02 | 20 | — | — | — |
| LNU322 | 63918.1 | 66.9 | 0.07 | 19 | — | — | — | — | — | — |
| LNU312 | 64002.2 | 75.0 | 0.18 | 33 | — | — | — | 10.2 | 0.25 | 10 |
| LNU312 | 64002.3 | — | — | — | — | — | — | 9.7 | 0.13 | 4 |
| LNU306 | 64131.2 | — | — | — | 562.5 | 0.03 | 19 | — | — | — |
| LNU306 | 64132.1 | — | — | — | — | — | — | 9.8 | 0.06 | 6 |
| LNU305 | 64114.1 | — | — | — | — | — | — | 9.8 | 0.12 | 5 |
| CONT. | — | 56.2 | — | — | 472.9 | — | — | 9.3 | — | — |
| LNU503 | 64203.1 | — | — | — | 1556.2 | 0.29 | 13 | — | — | — |
| LNU498 | 64185.3 | — | — | — | 1568.8 | 0.05 | 14 | — | — | — |
| LNU482 | 64165.4 | — | — | — | 1468.8 | 0.17 | 7 | — | — | — |
| LNU444 | 64182.3 | 153.8 | 0.07 | 23 | 1500.0 | 0.17 | 9 | — | — | — |
| LNU444 | 64183.1 | 156.9 | L | 25 | 1512.5 | 0.07 | 10 | — | — | — |
| LNU430 | 63934.3 | — | — | — | 1493.8 | 0.28 | 9 | — | — | — |
| LNU430 | 63936.2 | — | — | — | 1525.0 | 0.28 | 11 | — | — | — |
| LNU393 | 63977.5 | 136.2 | 0.21 | 9 | — | — | — | — | — | — |
| LNU393 | 63977.6 | — | — | — | 1450.0 | 0.25 | 6 | — | — | — |
| LNU385 | 64245.3 | 137.5 | 0.05 | 10 | — | — | — | — | — | — |
| LNU366 | 64027.9 | 135.0 | 0.06 | 8 | — | — | — | 11.1 | 0.27 | 5 |
| LNU366 | 64028.3 | 138.1 | 0.06 | 10 | 1668.8 | 0.03 | 22 | — | — | — |

TABLE 94-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU335 | 64168.1 | 139.4 | 0.24 | 11 | — | — | — | — | — | — |
| LNU317 | 64093.3 | — | — | — | — | — | — | 11.2 | 0.27 | 6 |
| CONT. | — | 125.5 | — | — | 1372.5 | — | — | 10.5 | — | — |
| LNU462 | 63503.1 | — | — | — | — | — | — | 11.7 | 0.08 | 6 |
| LNU462 | 63504.1 | — | — | — | 1950.0 | 0.20 | 6 | — | — | — |
| LNU455 | 64187.4 | 174.4 | L | 11 | — | — | — | — | — | — |
| LNU455 | 64187.5 | — | — | — | 1987.5 | L | 8 | 11.9 | 0.01 | 8 |
| LNU450 | 63712.3 | 165.0 | 0.11 | 5 | — | — | — | 11.4 | 0.07 | 3 |
| LNU448 | 63706.5 | 172.5 | 0.16 | 10 | — | — | — | — | — | — |
| LNU425 | 63911.12 | 171.3 | 0.02 | 10 | — | — | — | 11.4 | 0.14 | 3 |
| LNU425 | 63911.7 | — | — | — | 2056.2 | L | 12 | — | — | — |
| LNU425 | 63911.9 | 176.2 | 0.12 | 13 | 1950.0 | 0.02 | 6 | — | — | — |
| LNU402 | 63913.4 | — | — | — | — | — | — | 11.6 | 0.13 | 5 |
| LNU402 | 63914.2 | 176.2 | 0.06 | 13 | — | — | — | — | — | — |
| LNU399 | 63944.2 | — | — | — | — | — | — | 11.6 | 0.30 | 5 |
| LNU392 | 63696.2 | — | — | — | — | — | — | 11.8 | L | 7 |
| LNU390 | 63538.1 | — | — | — | — | — | — | 11.8 | L | 7 |
| LNU347 | 63510.4 | — | — | — | — | — | — | 11.4 | 0.20 | 4 |
| LNU329 | 63427.3 | 177.5 | 0.24 | 13 | — | — | — | — | — | — |
| LNU329 | 63428.1 | 165.6 | 0.15 | 6 | — | — | — | 11.4 | 0.05 | 4 |
| LNU329 | 63428.2 | — | — | — | 2031.2 | L | 11 | — | — | — |
| LNU329 | 63430.3 | — | — | — | — | — | — | 11.3 | 0.13 | 3 |
| LNU323 | 63420.1 | 171.2 | 0.03 | 9 | — | — | — | 11.4 | 0.20 | 4 |
| LNU323 | 63421.2 | — | — | — | — | — | — | 11.5 | 0.07 | 4 |
| LNU323 | 63424.1 | — | — | — | 1981.2 | 0.10 | 8 | — | — | — |
| LNU323 | 63424.4 | 176.9 | 0.01 | 13 | — | — | — | — | — | — |
| CONT. | — | 156.5 | — | — | 1835.4 | — | — | 11.0 | — | — |
| LNU511 | 65037.1 | 65.0 | 0.10 | 15 | 668.8 | 0.14 | 11 | — | — | — |
| LNU511 | 65040.2 | 67.5 | 0.02 | 20 | 806.2 | 0.01 | 33 | — | — | — |
| LNU492 | 64174.1 | 72.0 | L | 27 | 703.6 | 0.21 | 16 | — | — | — |
| LNU492 | 64174.2 | — | — | — | — | — | — | 10.9 | 0.29 | 4 |
| LNU492 | 64175.1 | — | — | — | 687.5 | 0.08 | 14 | 10.9 | 0.15 | 4 |
| LNU492 | 64176.4 | — | — | — | — | — | — | 10.8 | 0.29 | 3 |
| LNU476 | 64041.2 | — | — | — | 687.5 | 0.12 | 14 | — | — | — |
| LNU471 | 64838.1 | — | — | — | 668.8 | 0.17 | 11 | — | — | — |
| LNU471 | 64838.3 | 66.9 | 0.04 | 18 | 668.8 | 0.14 | 11 | — | — | — |
| LNU471 | 64839.2 | — | — | — | 693.8 | 0.07 | 15 | — | — | — |
| LNU471 | 64841.3 | 61.2 | 0.24 | 8 | — | — | — | — | — | — |
| LNU471 | 64842.1 | 74.4 | 0.23 | 32 | 793.8 | 0.22 | 31 | — | — | — |
| LNU463 | 64281.3 | 62.5 | 0.15 | 11 | — | — | — | — | — | — |
| LNU463 | 64283.4 | — | — | — | 693.8 | 0.07 | 15 | — | — | — |
| LNU454 | 64796.2 | — | — | — | 668.8 | 0.14 | 11 | — | — | — |
| LNU454 | 64797.2 | 76.9 | L | 36 | 818.8 | L | 36 | — | — | — |
| LNU454 | 64799.2 | 65.0 | 0.06 | 15 | — | — | — | 10.9 | 0.17 | 5 |
| LNU454 | 64800.5 | 66.9 | 0.03 | 18 | 718.8 | 0.03 | 19 | — | — | — |
| LNU422 | 64966.1 | — | — | — | — | — | — | 10.8 | 0.28 | 4 |
| LNU422 | 64969.1 | 66.9 | 0.27 | 18 | — | — | — | — | — | — |
| LNU413 | 65021.4 | 75.0 | 0.29 | 33 | 781.2 | 0.12 | 29 | — | — | — |
| LNU413 | 65022.4 | 67.5 | 0.05 | 20 | 700.0 | 0.05 | 16 | 11.3 | 0.04 | 8 |
| LNU410 | 64973.2 | 66.2 | 0.04 | 17 | 706.2 | 0.05 | 17 | — | — | — |
| LNU387 | 64810.4 | 70.0 | 0.08 | 24 | 762.5 | L | 26 | — | — | — |
| LNU387 | 64811.2 | 63.1 | 0.23 | 12 | 693.8 | 0.06 | 15 | — | — | — |
| LNU382 | 64428.2 | 76.2 | 0.03 | 35 | 900.0 | L | 49 | — | — | — |
| LNU382 | 64432.1 | 62.5 | 0.22 | 11 | — | — | — | — | — | — |
| LNU373 | 64830.1 | — | — | — | 700.0 | 0.16 | 16 | — | — | — |
| LNU361 | 64834.1 | — | — | — | 706.2 | 0.27 | 17 | 11.1 | 0.05 | 6 |
| LNU361 | 64835.2 | — | — | — | 662.5 | 0.24 | 10 | — | — | — |
| LNU361 | 64836.2 | 66.9 | 0.04 | 18 | — | — | — | — | — | — |
| LNU355 | 65012.2 | 78.8 | 0.11 | 39 | 825.0 | 0.20 | 37 | — | — | — |
| LNU355 | 65013.2 | 73.8 | L | 31 | 793.8 | 0.05 | 31 | — | — | — |
| LNU355 | 65015.2 | — | — | — | 675.0 | 0.17 | 12 | — | — | — |
| LNU332 | 64821.1 | 69.4 | 0.27 | 23 | 712.5 | 0.21 | 18 | — | — | — |
| LNU332 | 64822.4 | 68.8 | 0.02 | 22 | 706.2 | 0.05 | 17 | 10.8 | 0.29 | 3 |
| LNU332 | 64823.1 | 69.4 | 0.01 | 23 | — | — | — | 11.2 | 0.06 | 7 |
| LNU332 | 64824.3 | 60.6 | 0.28 | 7 | — | — | — | — | — | — |
| LNU307 | 64960.1 | — | — | — | 762.5 | 0.18 | 26 | — | — | — |
| LNU307 | 64962.2 | 68.1 | 0.02 | 21 | 718.8 | 0.07 | 19 | — | — | — |
| LNU303 | 65043.1 | — | — | — | 712.5 | 0.03 | 18 | — | — | — |
| LNU300 | 65033.3 | 60.6 | 0.28 | 7 | — | — | — | — | — | — |
| CONT. | — | 56.5 | — | — | 604.2 | — | — | 10.4 | — | — |
| LNU513 | 63458.2 | — | — | — | 1750.0 | 0.22 | 9 | — | — | — |
| LNU513 | 63458.3 | 141.2 | 0.26 | 10 | 1750.0 | 0.20 | 9 | 12.1 | 0.03 | 5 |
| LNU513 | 63460.2 | 155.6 | 0.05 | 21 | 1868.8 | 0.29 | 17 | — | — | — |

TABLE 94-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LNU512 | 63470.1 | 156.2 | 0.04 | 22 | 1906.2 | 0.04 | 19 | 12.1 | 0.11 | 5 |
| LNU451 | 63497.5 | 158.8 | 0.03 | 24 | 2068.8 | L | 29 | — | — | — |
| LNU424 | 63476.3 | — | — | — | 1831.2 | 0.14 | 14 | — | — | — |
| LNU415 | 63691.2 | 148.1 | 0.11 | 15 | — | — | — | — | — | — |
| LNU375 | 63452.2 | 140.6 | 0.29 | 9 | — | — | — | — | — | — |
| LNU375 | 63454.1 | 146.2 | 0.29 | 14 | 1893.8 | 0.03 | 18 | — | — | — |
| LNU375 | 63454.2 | 148.8 | 0.10 | 16 | 1743.8 | 0.22 | 9 | — | — | — |
| LNU357 | 63532.3 | 151.9 | 0.17 | 18 | 1875.0 | 0.04 | 17 | — | — | — |
| LNU357 | 63533.8 | 162.5 | 0.02 | 26 | 2075.0 | L | 29 | — | — | — |
| LNU357 | 63534.4 | 158.8 | 0.14 | 24 | 2075.0 | 0.10 | 29 | — | — | — |
| LNU356 | 63444.1 | 146.2 | 0.25 | 14 | 1875.0 | 0.14 | 17 | — | — | — |
| LNU351 | 63466.1 | 154.4 | 0.11 | 20 | 1918.8 | 0.03 | 20 | — | — | — |
| LNU344 | 63520.4 | 151.2 | 0.09 | 18 | 1800.0 | 0.11 | 12 | — | — | — |
| LNU344 | 63521.1 | 150.0 | 0.10 | 17 | 1781.2 | 0.15 | 11 | — | — | — |
| LNU330 | 63438.1 | 157.5 | 0.05 | 23 | — | — | — | — | — | — |
| LNU330 | 63441.2 | 154.4 | 0.17 | 20 | 1918.8 | 0.24 | 20 | 12.2 | 0.02 | 7 |
| LNU326 | 63433.4 | 143.8 | 0.22 | 12 | 1775.0 | 0.15 | 11 | — | — | — |
| LNU326 | 63435.1 | 147.5 | 0.11 | 15 | — | — | — | — | — | — |
| LNU319 | 63527.1 | 156.9 | 0.04 | 22 | 1912.5 | 0.06 | 19 | 11.9 | 0.15 | 3 |
| LNU319 | 63530.1 | 153.8 | 0.26 | 20 | 1893.8 | 0.05 | 18 | 12.1 | 0.02 | 6 |
| LNU319 | 63530.3 | 165.0 | 0.01 | 28 | 2081.2 | 0.02 | 30 | — | — | — |
| LNU302 | 63378.3 | 160.0 | 0.02 | 25 | 1912.5 | 0.03 | 19 | — | — | — |
| LNU291 | 63385.1 | 158.8 | 0.05 | 24 | 2056.2 | 0.21 | 28 | — | — | — |
| LNU291 | 63385.2 | 153.8 | 0.26 | 20 | 1937.5 | 0.15 | 21 | — | — | — |
| LNU291 | 63387.3 | — | — | — | 1975.0 | 0.27 | 23 | — | — | — |
| CONT. | — | 128.5 | — | — | 1602.4 | — | — | 11.5 | — | — |

Table 94.
"CONT."—Control;
"Ave."—Average;
"% Incr." = % increment;
"p-val."—p-value;
L means that p-value is less than 0.01, p < 0.1 was considered as significant.

TABLE 95

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU507 | 64584.2 | 68.4 | 0.16 | 18 | 8.6 | 0.16 | 18 | 5.1 | 0.07 | 12 |
| LNU507 | 64585.2 | 67.0 | 0.21 | 16 | 8.4 | 0.21 | 16 | 5.1 | 0.05 | 13 |
| LNU494 | 65299.1 | — | — | — | — | — | — | 4.8 | 0.26 | 6 |
| LNU479 | 65497.5 | 75.3 | 0.04 | 30 | 9.4 | 0.04 | 30 | 5.2 | 0.03 | 15 |
| LNU479 | 65499.1 | 76.5 | 0.23 | 32 | 9.6 | 0.23 | 32 | 5.3 | 0.09 | 17 |
| LNU418 | 65027.2 | 82.8 | L | 43 | 10.4 | L | 43 | 5.4 | 0.02 | 20 |
| LNU401 | 65493.3 | — | — | — | — | — | — | 5.0 | 0.29 | 11 |
| LNU401 | 65494.1 | 78.3 | 0.18 | 35 | 9.8 | 0.18 | 35 | 5.3 | 0.11 | 17 |
| LNU388 | 65487.1 | 70.1 | 0.15 | 21 | 8.8 | 0.15 | 21 | 5.2 | 0.03 | 15 |
| LNU377 | 64604.6 | 71.1 | 0.09 | 23 | 8.9 | 0.09 | 23 | 5.0 | 0.08 | 11 |
| LNU368 | 64004.3 | 72.8 | 0.06 | 26 | 9.1 | 0.06 | 26 | 5.1 | 0.07 | 13 |
| LNU344 | 63521.1 | 80.1 | 0.06 | 39 | 10.0 | 0.06 | 39 | 5.4 | 0.06 | 19 |
| LNU339 | 65055.1 | 66.0 | 0.25 | 14 | 8.2 | 0.25 | 14 | 4.9 | 0.17 | 8 |
| LNU337 | 64955.2 | 71.3 | 0.08 | 23 | 8.9 | 0.08 | 23 | 5.1 | 0.05 | 13 |
| LNU324 | 64234.3 | 72.8 | 0.17 | 26 | 9.1 | 0.17 | 26 | 5.2 | 0.17 | 14 |
| LNU318 | 65067.2 | — | — | — | — | — | — | 4.9 | 0.22 | 7 |
| LNU296 | 65060.2 | 71.1 | 0.09 | 23 | 8.9 | 0.09 | 23 | 5.1 | 0.05 | 13 |
| CONT. | — | 57.8 | — | — | 7.2 | — | — | 4.5 | — | — |
| LNU507 | 64584.1 | 92.5 | 0.08 | 18 | 11.6 | 0.08 | 18 | 5.8 | 0.13 | 11 |
| LNU494 | 65300.2 | 98.9 | 0.14 | 26 | 12.4 | 0.14 | 26 | 6.2 | 0.16 | 18 |
| LNU494 | 65302.1 | 87.5 | 0.20 | 12 | 10.9 | 0.20 | 12 | 5.6 | 0.08 | 8 |
| LNU494 | 65303.2 | 98.3 | 0.15 | 25 | 12.3 | 0.15 | 25 | 5.9 | 0.11 | 12 |
| LNU479 | 65497.3 | 101.7 | 0.04 | 30 | 12.7 | 0.04 | 30 | 6.1 | L | 17 |
| LNU479 | 65499.1 | 109.9 | L | 40 | 13.7 | L | 40 | 6.3 | L | 20 |
| LNU401 | 65493.2 | 91.7 | 0.20 | 17 | 11.5 | 0.20 | 17 | 5.9 | 0.15 | 12 |
| LNU401 | 65493.3 | 95.6 | 0.21 | 22 | 11.9 | 0.21 | 22 | 5.8 | 0.15 | 11 |
| LNU401 | 65494.1 | 95.9 | 0.20 | 22 | 12.0 | 0.20 | 22 | 5.9 | 0.17 | 13 |

TABLE 95-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU401 | 65494.2 | — | — | — | — | — | — | 5.5 | 0.28 | 5 |
| LNU388 | 65488.1 | — | — | — | — | — | — | 5.9 | 0.02 | 12 |
| LNU377 | 64605.1 | 100.3 | 0.07 | 28 | 12.5 | 0.07 | 28 | 6.1 | 0.02 | 17 |
| LNU348 | 64472.2 | — | — | — | — | — | — | 5.6 | 0.20 | 6 |
| LNU339 | 65058.2 | 86.5 | 0.30 | 10 | 10.8 | 0.30 | 10 | — | — | — |
| LNU336 | 64448.3 | — | — | — | — | — | — | 5.7 | 0.06 | 9 |
| LNU336 | 64449.4 | — | — | — | — | — | — | 6.1 | 0.13 | 17 |
| LNU333 | 65295.2 | — | — | — | — | — | — | 5.7 | 0.07 | 8 |
| LNU333 | 65297.2 | 88.3 | 0.17 | 13 | 11.0 | 0.17 | 13 | 5.8 | 0.03 | 12 |
| LNU324 | 64233.4 | 100.8 | 0.03 | 29 | 12.6 | 0.03 | 29 | 6.2 | 0.06 | 19 |
| LNU304 | 64572.2 | 89.7 | 0.12 | 14 | 11.2 | 0.12 | 14 | 5.8 | 0.04 | 10 |
| LNU304 | 64573.1 | — | — | — | — | — | — | 5.6 | 0.15 | 7 |
| LNU296 | 65062.2 | — | — | — | — | — | — | 5.7 | 0.06 | 9 |
| LNU292 | 64081.2 | — | — | — | — | — | — | 5.7 | 0.23 | 9 |
| LNU292 | 64084.1 | — | — | — | — | — | — | 5.6 | 0.25 | 6 |
| LNU292 | 64085.4 | — | — | — | — | — | — | 5.6 | 0.19 | 7 |
| CONT. | — | 78.4 | — | — | 9.8 | — | — | 5.2 | — | — |
| LNU469 | 64308.5 | 59.7 | 0.22 | 12 | 7.5 | 0.22 | 12 | 4.8 | 0.09 | 6 |
| LNU469 | 64311.8 | 60.7 | 0.23 | 14 | 7.6 | 0.23 | 14 | — | — | — |
| LNU459 | 64541.4 | 58.8 | 0.17 | 10 | 7.3 | 0.17 | 10 | — | — | — |
| LNU442 | 64056.1 | — | — | — | — | — | — | 4.7 | 0.14 | 5 |
| LNU442 | 64553.1 | — | — | — | — | — | — | 4.7 | 0.17 | 5 |
| LNU409 | 64687.2 | 62.3 | 0.04 | 17 | 7.8 | 0.04 | 17 | 5.0 | 0.01 | 11 |
| LNU363 | 64410.2 | 66.6 | 0.13 | 25 | 8.3 | 0.13 | 25 | 5.1 | 0.13 | 13 |
| LNU314 | 64433.1 | 61.6 | 0.11 | 15 | 7.7 | 0.11 | 15 | 4.8 | 0.14 | 7 |
| LNU314 | 64433.3 | — | — | — | — | — | — | 4.7 | 0.17 | 5 |
| CONT. | — | 53.4 | — | — | 6.7 | — | — | 4.5 | — | — |
| LNU517 | 64296.4 | 53.2 | 0.12 | 20 | 6.6 | 0.12 | 20 | 4.5 | 0.15 | 7 |
| LNU501 | 64197.10 | 51.6 | 0.09 | 16 | 6.5 | 0.09 | 16 | 4.4 | 0.19 | 5 |
| LNU397 | 64376.4 | 49.7 | 0.12 | 12 | 6.2 | 0.12 | 12 | 4.4 | 0.27 | 4 |
| LNU369 | 64387.2 | 48.1 | 0.25 | 8 | 6.0 | 0.25 | 8 | — | — | — |
| LNU369 | 64389.2 | — | — | — | — | — | — | 4.6 | 0.24 | 10 |
| LNU342 | 64036.2 | 52.9 | 0.03 | 19 | 6.6 | 0.03 | 19 | 4.7 | 0.02 | 11 |
| CONT. | — | 44.4 | — | — | 5.5 | — | — | 4.2 | — | — |
| LNU513 | 63458.2 | 49.5 | L | 35 | 6.2 | L | 35 | 4.4 | L | 15 |
| LNU512 | 63468.3 | 40.3 | 0.10 | 10 | 5.0 | 0.10 | 10 | 4.0 | 0.19 | 4 |
| LNU512 | 63470.1 | 43.2 | 0.04 | 17 | 5.4 | 0.04 | 17 | 4.1 | 0.26 | 7 |
| LNU451 | 63496.2 | 39.8 | 0.14 | 8 | 5.0 | 0.14 | 8 | 4.0 | 0.12 | 5 |
| LNU451 | 63499.1 | 41.9 | 0.04 | 14 | 5.2 | 0.04 | 14 | — | — | — |
| LNU451 | 63499.5 | 46.0 | 0.08 | 25 | 5.8 | 0.08 | 25 | 4.2 | 0.10 | 10 |
| LNU451 | 63500.1 | 44.3 | 0.05 | 20 | 5.5 | 0.05 | 20 | — | — | — |
| LNU424 | 63474.3 | 41.7 | 0.21 | 13 | 5.2 | 0.21 | 13 | — | — | — |
| LNU424 | 63476.3 | 40.4 | 0.09 | 10 | 5.1 | 0.09 | 10 | — | — | — |
| LNU415 | 63692.3 | 39.5 | 0.22 | 7 | 4.9 | 0.22 | 7 | — | — | — |
| LNU415 | 63693.4 | 43.2 | 0.12 | 17 | 5.4 | 0.12 | 17 | 4.1 | 0.17 | 6 |
| LNU411 | 63514.3 | 44.8 | L | 22 | 5.6 | L | 22 | 4.1 | 0.04 | 7 |
| LNU411 | 63515.3 | 42.0 | 0.03 | 14 | 5.2 | 0.03 | 14 | 4.1 | 0.05 | 7 |
| LNU411 | 63518.1 | 39.5 | 0.17 | 7 | 4.9 | 0.17 | 7 | — | — | — |
| LNU375 | 63452.2 | 41.2 | 0.05 | 12 | 5.1 | 0.05 | 12 | 4.0 | 0.21 | 5 |
| LNU375 | 63454.1 | 45.6 | 0.02 | 24 | 5.7 | 0.02 | 24 | 4.2 | 0.02 | 11 |
| LNU375 | 63454.2 | 46.8 | 0.21 | 27 | 5.8 | 0.21 | 27 | 4.4 | 0.24 | 16 |
| LNU370 | 63545.6 | 45.0 | 0.16 | 22 | 5.6 | 0.16 | 22 | 4.3 | 0.08 | 11 |
| LNU370 | 63547.1 | 39.0 | 0.27 | 6 | 4.9 | 0.27 | 6 | — | — | — |
| LNU370 | 63548.2 | 40.8 | 0.07 | 11 | 5.1 | 0.07 | 11 | — | — | — |
| LNU357 | 63532.3 | 39.6 | 0.17 | 8 | 5.0 | 0.17 | 8 | — | — | — |
| LNU357 | 63533.1 | 52.9 | 0.07 | 44 | 6.6 | 0.07 | 44 | 4.5 | 0.05 | 18 |
| LNU357 | 63533.8 | 44.2 | L | 20 | 5.5 | L | 20 | 4.1 | 0.10 | 8 |
| LNU357 | 63534.1 | 42.8 | 0.23 | 16 | 5.3 | 0.23 | 16 | — | — | — |
| LNU356 | 63444.2 | 39.3 | 0.20 | 7 | 4.9 | 0.20 | 7 | — | — | — |
| LNU356 | 63445.1 | 39.6 | 0.16 | 8 | 4.9 | 0.16 | 8 | — | — | — |
| LNU351 | 63462.1 | 38.8 | 0.29 | 5 | 4.8 | 0.29 | 5 | — | — | — |
| LNU351 | 63464.1 | 41.1 | 0.09 | 12 | 5.1 | 0.09 | 12 | 4.1 | 0.04 | 7 |
| LNU330 | 63438.1 | 40.8 | 0.06 | 11 | 5.1 | 0.06 | 11 | 4.0 | 0.14 | 5 |
| LNU326 | 63433.4 | 44.0 | L | 20 | 5.5 | L | 20 | 4.2 | 0.05 | 10 |
| LNU326 | 63435.1 | 43.2 | 0.11 | 18 | 5.4 | 0.11 | 18 | 4.1 | 0.08 | 6 |
| LNU319 | 63527.1 | 39.7 | 0.14 | 8 | 5.0 | 0.14 | 8 | — | — | — |
| LNU319 | 63528.1 | — | — | — | — | — | — | 4.2 | 0.24 | 9 |
| LNU319 | 63530.3 | 45.9 | L | 25 | 5.7 | L | 25 | 4.3 | L | 12 |
| LNU308 | 63414.1 | 43.2 | 0.16 | 18 | 5.4 | 0.16 | 18 | 4.1 | 0.20 | 8 |
| LNU308 | 63414.4 | 40.4 | 0.21 | 10 | 5.1 | 0.21 | 10 | 4.0 | 0.24 | 4 |
| LNU308 | 63415.3 | 43.6 | 0.01 | 19 | 5.5 | 0.01 | 19 | 4.1 | 0.04 | 7 |
| LNU308 | 63417.5 | — | — | — | — | — | — | 4.1 | 0.17 | 9 |

TABLE 95-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU308 | 63417.8 | 49.3 | L | 34 | 6.2 | L | 34 | 4.4 | L | 14 |
| LNU302 | 63378.3 | 39.6 | 0.16 | 8 | 5.0 | 0.16 | 8 | 3.9 | 0.30 | 3 |
| LNU302 | 63380.1 | 45.0 | L | 22 | 5.6 | L | 22 | 4.1 | 0.06 | 7 |
| LNU302 | 63381.1 | 42.4 | 0.02 | 15 | 5.3 | 0.02 | 15 | 4.0 | 0.11 | 5 |
| LNU302 | 63382.2 | 48.8 | L | 33 | 6.1 | L | 33 | 4.4 | L | 14 |
| LNU291 | 63385.2 | 39.3 | 0.20 | 7 | 4.9 | 0.20 | 7 | — | — | — |
| LNU291 | 63387.1 | 45.8 | L | 24 | 5.7 | L | 24 | 4.2 | 0.05 | 11 |
| CONT. | — | 36.8 | — | — | 4.6 | — | — | 3.8 | — | — |
| LNU482 | 64164.8 | — | — | — | — | — | — | 5.1 | 0.20 | 4 |
| LNU477 | 63886.1 | — | — | — | — | — | — | 5.1 | 0.30 | 3 |
| LNU477 | 63888.1 | — | — | — | — | — | — | 5.4 | 0.30 | 10 |
| LNU477 | 63889.5 | 71.1 | 0.05 | 14 | 8.9 | 0.05 | 14 | 5.1 | 0.18 | 4 |
| LNU469 | 64311.8 | 75.0 | 0.28 | 20 | 9.4 | 0.28 | 20 | — | — | — |
| LNU444 | 64182.1 | 70.5 | 0.16 | 13 | 8.8 | 0.16 | 13 | 5.2 | 0.22 | 5 |
| LNU442 | 64056.1 | 68.3 | 0.13 | 9 | 8.5 | 0.13 | 9 | 5.1 | 0.18 | 4 |
| LNU442 | 64060.2 | — | — | — | 8.8 | 0.06 | 13 | 5.3 | 0.02 | 9 |
| LNU376 | 63987.3 | 81.3 | L | 30 | 10.2 | L | 30 | 5.6 | 0.02 | 13 |
| LNU363 | 64410.2 | 68.1 | 0.18 | 9 | 8.5 | 0.18 | 9 | 5.2 | 0.06 | 6 |
| CONT. | — | 62.5 | — | — | 7.8 | — | — | 4.9 | — | — |
| LNU511 | 65036.2 | 114.4 | L | 36 | 14.3 | L | 36 | 6.4 | 0.04 | 14 |
| LNU511 | 65037.1 | 121.5 | 0.06 | 45 | 15.2 | 0.06 | 45 | 6.6 | 0.04 | 17 |
| LNU492 | 64174.2 | 102.7 | 0.18 | 22 | 12.8 | 0.18 | 22 | 6.0 | 0.13 | 7 |
| LNU492 | 64175.1 | 93.8 | 0.20 | 12 | 11.7 | 0.20 | 12 | — | — | — |
| LNU492 | 64176.4 | 112.0 | 0.03 | 34 | 14.0 | 0.03 | 34 | 6.4 | L | 13 |
| LNU476 | 64041.2 | 103.5 | 0.22 | 23 | 12.9 | 0.22 | 23 | 6.3 | 0.18 | 13 |
| LNU476 | 64042.1 | 104.4 | L | 24 | 13.0 | L | 24 | 6.3 | 0.01 | 12 |
| LNU476 | 64043.3 | 90.4 | 0.29 | 8 | 11.3 | 0.29 | 8 | — | — | — |
| LNU471 | 64838.3 | 111.2 | 0.04 | 33 | 13.9 | 0.04 | 33 | 6.4 | 0.20 | 13 |
| LNU471 | 64839.2 | 105.0 | 0.01 | 25 | 13.1 | 0.01 | 25 | 6.3 | 0.01 | 11 |
| LNU471 | 64841.3 | 99.8 | 0.05 | 19 | 12.5 | 0.05 | 19 | — | — | — |
| LNU471 | 64842.1 | 106.7 | L | 27 | 13.3 | L | 27 | 6.2 | 0.01 | 11 |
| LNU463 | 64280.4 | 99.3 | 0.06 | 18 | 12.4 | 0.06 | 18 | 5.9 | 0.13 | 5 |
| LNU463 | 64281.3 | 119.8 | 0.03 | 43 | 15.0 | 0.03 | 43 | 6.7 | 0.05 | 19 |
| LNU463 | 64283.4 | 93.7 | 0.14 | 12 | 11.7 | 0.14 | 12 | 5.9 | 0.23 | 4 |
| LNU454 | 64796.3 | 99.4 | 0.03 | 19 | 12.4 | 0.03 | 19 | 6.1 | 0.03 | 9 |
| LNU454 | 64797.2 | 93.3 | 0.24 | 11 | 11.7 | 0.24 | 11 | — | — | — |
| LNU422 | 64966.2 | — | — | — | — | — | — | 5.8 | 0.28 | 4 |
| LNU422 | 64969.1 | 94.1 | 0.30 | 12 | 11.8 | 0.30 | 12 | — | — | — |
| LNU413 | 65019.1 | 119.6 | 0.06 | 43 | 14.9 | 0.06 | 43 | 6.8 | 0.17 | 20 |
| LNU413 | 65019.2 | 101.4 | 0.02 | 21 | 12.7 | 0.02 | 21 | 6.1 | 0.03 | 8 |
| LNU413 | 65021.4 | 108.3 | L | 29 | 13.5 | L | 29 | 6.6 | 0.07 | 17 |
| LNU413 | 65021.5 | 101.7 | 0.02 | 21 | 12.7 | 0.02 | 21 | 6.2 | 0.01 | 11 |
| LNU413 | 65022.4 | 97.1 | 0.26 | 16 | 12.1 | 0.26 | 16 | — | — | — |
| LNU410 | 64974.3 | 101.6 | 0.22 | 21 | 12.7 | 0.22 | 21 | — | — | — |
| LNU387 | 64808.1 | 97.8 | 0.04 | 17 | 12.2 | 0.04 | 17 | 6.0 | 0.10 | 6 |
| LNU387 | 64810.4 | — | — | — | — | — | — | 5.8 | 0.25 | 4 |
| LNU387 | 64811.3 | 104.9 | L | 25 | 13.1 | L | 25 | 6.3 | L | 13 |
| LNU382 | 64428.2 | 97.9 | 0.09 | 17 | 12.2 | 0.09 | 17 | 6.1 | 0.22 | 8 |
| LNU382 | 64429.3 | 96.3 | 0.07 | 15 | 12.0 | 0.07 | 15 | 5.9 | 0.23 | 5 |
| LNU382 | 64430.1 | 104.8 | L | 25 | 13.1 | L | 25 | 6.4 | L | 13 |
| LNU373 | 64827.2 | 104.7 | L | 25 | 13.1 | L | 25 | 6.1 | 0.04 | 8 |
| LNU373 | 64828.1 | 103.3 | 0.01 | 23 | 12.9 | 0.01 | 23 | 6.3 | L | 12 |
| LNU373 | 64830.3 | 91.4 | 0.27 | 9 | 11.4 | 0.27 | 9 | — | — | — |
| LNU361 | 64832.1 | 139.6 | L | 66 | 17.5 | L | 66 | 7.3 | L | 29 |
| LNU361 | 64836.2 | 107.0 | 0.26 | 28 | 13.4 | 0.26 | 28 | 6.3 | 0.23 | 11 |
| LNU355 | 65012.1 | 100.2 | 0.03 | 19 | 12.5 | 0.03 | 19 | 6.2 | 0.02 | 10 |
| LNU355 | 65012.2 | 93.8 | 0.11 | 12 | 11.7 | 0.11 | 12 | 6.0 | 0.07 | 7 |
| LNU355 | 65014.2 | 97.4 | 0.25 | 16 | 12.2 | 0.25 | 16 | — | — | — |
| LNU355 | 65015.2 | 105.9 | 0.20 | 26 | 13.2 | 0.20 | 26 | 6.3 | 0.07 | 12 |
| LNU332 | 64821.1 | 102.3 | 0.02 | 22 | 12.8 | 0.02 | 22 | 6.1 | 0.04 | 9 |
| LNU307 | 64959.2 | 97.2 | 0.05 | 16 | 12.1 | 0.05 | 16 | 6.0 | 0.08 | 7 |
| LNU307 | 64960.2 | 97.0 | 0.09 | 16 | 12.1 | 0.09 | 16 | 6.0 | 0.12 | 6 |
| LNU303 | 65042.2 | 92.8 | 0.16 | 11 | 11.6 | 0.16 | 11 | 6.0 | 0.20 | 6 |
| LNU303 | 65043.2 | 100.2 | 0.09 | 19 | 12.5 | 0.09 | 19 | 6.1 | 0.05 | 9 |
| LNU303 | 65046.1 | 114.4 | 0.04 | 36 | 14.3 | 0.04 | 36 | 6.3 | 0.12 | 12 |
| LNU300 | 65030.2 | 102.4 | 0.02 | 22 | 12.8 | 0.02 | 22 | 6.3 | 0.18 | 11 |
| LNU300 | 65031.3 | 115.7 | 0.02 | 38 | 14.5 | 0.02 | 38 | 6.6 | 0.14 | 17 |
| LNU300 | 65033.1 | 111.8 | L | 33 | 14.0 | L | 33 | 6.4 | 0.07 | 14 |
| CONT. | — | 83.9 | — | — | 10.5 | — | — | 5.6 | — | — |
| LNU517 | 64297.9 | 66.5 | 0.02 | 27 | 8.3 | 0.02 | 27 | 4.9 | 0.28 | 6 |
| LNU514 | 64364.2 | 61.0 | 0.12 | 16 | 7.6 | 0.12 | 16 | — | — | — |
| LNU514 | 64366.1 | 59.3 | 0.21 | 13 | 7.4 | 0.21 | 13 | — | — | — |

TABLE 95-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LNU509 | 64690.3 | 73.2 | L | 39 | 9.2 | L | 39 | 5.3 | 0.03 | 14 |
| LNU509 | 64692.3 | 70.0 | L | 33 | 8.7 | L | 33 | 5.1 | 0.08 | 10 |
| LNU509 | 64692.6 | 68.2 | 0.02 | 30 | 8.5 | 0.02 | 30 | 5.2 | 0.04 | 12 |
| LNU501 | 64197.1 | 62.4 | 0.07 | 19 | 7.8 | 0.07 | 19 | — | — | — |
| LNU461 | 64666.1 | 64.1 | 0.12 | 22 | 8.0 | 0.12 | 22 | — | — | — |
| LNU461 | 64667.4 | 61.4 | 0.08 | 17 | 7.7 | 0.08 | 17 | 4.9 | 0.19 | 7 |
| LNU461 | 64668.5 | 67.3 | 0.23 | 28 | 8.4 | 0.23 | 28 | — | — | — |
| LNU397 | 64374.1 | 59.9 | 0.20 | 14 | 7.5 | 0.20 | 14 | — | — | — |
| LNU397 | 64375.1 | 66.5 | 0.10 | 27 | 8.3 | 0.10 | 27 | 5.0 | 0.23 | 9 |
| LNU397 | 64376.4 | 59.2 | 0.18 | 13 | 7.4 | 0.18 | 13 | — | — | — |
| LNU396 | 64315.13 | 74.9 | L | 42 | 9.4 | L | 42 | 5.5 | L | 18 |
| LNU372 | 64481.1 | 66.0 | 0.02 | 26 | 8.2 | 0.02 | 26 | 5.0 | 0.21 | 9 |
| LNU372 | 64483.3 | 70.4 | 0.07 | 34 | 8.8 | 0.07 | 34 | 5.1 | 0.10 | 10 |
| LNU372 | 64485.1 | 62.8 | 0.05 | 19 | 7.8 | 0.05 | 19 | — | — | — |
| LNU372 | 64485.3 | 61.9 | 0.07 | 18 | 7.7 | 0.07 | 18 | 5.1 | 0.08 | 11 |
| LNU369 | 64386.1 | 65.0 | 0.05 | 24 | 8.1 | 0.05 | 24 | 5.0 | 0.20 | 8 |
| LNU369 | 64387.1 | 63.7 | 0.06 | 21 | 8.0 | 0.06 | 21 | — | — | — |
| LNU369 | 64389.2 | 62.7 | 0.28 | 19 | 7.8 | 0.28 | 19 | — | — | — |
| LNU365 | 64711.2 | 58.4 | 0.21 | 11 | 7.3 | 0.21 | 11 | — | — | — |
| LNU365 | 64712.3 | 63.7 | 0.06 | 21 | 8.0 | 0.06 | 21 | — | — | — |
| LNU350 | 64674.2 | 68.9 | L | 31 | 8.6 | L | 31 | 5.3 | 0.03 | 14 |
| LNU345 | 64337.1 | 63.9 | 0.06 | 22 | 8.0 | 0.06 | 22 | 5.1 | 0.17 | 10 |
| LNU342 | 64035.4 | 59.9 | 0.14 | 14 | 7.5 | 0.14 | 14 | — | — | — |
| LNU342 | 64036.2 | 66.0 | 0.02 | 26 | 8.3 | 0.02 | 26 | 5.0 | 0.13 | 8 |
| LNU313 | 64661.8 | 66.7 | 0.04 | 27 | 8.3 | 0.04 | 27 | 5.1 | 0.16 | 10 |
| LNU313 | 64663.2 | 70.9 | L | 35 | 8.9 | L | 35 | 5.1 | 0.07 | 11 |
| LNU313 | 64664.1 | 61.5 | 0.20 | 17 | 7.7 | 0.20 | 17 | 4.9 | 0.26 | 6 |
| LNU294 | 64657.2 | 64.3 | 0.09 | 22 | 8.0 | 0.09 | 22 | 5.1 | 0.26 | 11 |
| CONT. | — | 52.6 | — | — | 6.6 | — | — | 4.6 | — | — |
| LNU477 | 63889.4 | — | — | — | — | — | — | 5.0 | 0.08 | 4 |
| LNU439 | 64615.4 | 64.0 | 0.03 | 10 | 8.0 | 0.03 | 10 | — | — | — |
| LNU425 | 63911.11 | 63.4 | 0.26 | 9 | 7.9 | 0.26 | 9 | — | — | — |
| LNU419 | 63896.2 | 68.2 | L | 17 | 8.5 | L | 17 | 5.2 | L | 7 |
| LNU419 | 63897.5 | — | — | — | — | — | — | 5.0 | 0.06 | 4 |
| CONT. | — | 58.3 | — | — | 7.3 | — | — | 4.8 | — | — |
| LNU520 | 64156.7 | 60.1 | 0.05 | 16 | 7.5 | 0.05 | 16 | 4.8 | 0.15 | 9 |
| LNU518 | 64014.5 | 56.5 | 0.23 | 9 | 7.1 | 0.23 | 9 | 4.6 | 0.18 | 5 |
| LNU518 | 64016.4 | — | — | — | — | — | — | 4.6 | 0.23 | 4 |
| LNU493 | 64190.3 | 57.2 | 0.24 | 10 | 7.1 | 0.24 | 10 | — | — | — |
| LNU493 | 64191.3 | 60.5 | 0.03 | 16 | 7.6 | 0.03 | 16 | 4.7 | 0.04 | 7 |
| LNU472 | 63920.6 | 57.7 | 0.11 | 11 | 7.2 | 0.11 | 11 | 4.7 | 0.16 | 7 |
| LNU419 | 63896.2 | — | — | — | — | — | — | 4.6 | 0.22 | 4 |
| LNU419 | 63897.5 | — | — | — | — | — | — | 4.8 | 0.03 | 8 |
| LNU419 | 63897.6 | 64.8 | 0.16 | 25 | 8.1 | 0.16 | 25 | 4.9 | 0.07 | 11 |
| LNU343 | 64208.1 | 69.9 | L | 34 | 8.7 | L | 34 | 5.0 | L | 14 |
| LNU343 | 64208.2 | 56.3 | 0.20 | 8 | 7.0 | 0.20 | 8 | 4.6 | 0.14 | 6 |
| LNU343 | 64209.2 | — | — | — | — | — | — | 4.5 | 0.28 | 3 |
| LNU340 | 64290.7 | 56.3 | 0.20 | 8 | 7.0 | 0.20 | 8 | 4.7 | 0.08 | 8 |
| LNU340 | 64291.10 | 55.4 | 0.29 | 7 | 6.9 | 0.29 | 7 | — | — | — |
| LNU328 | 64150.1 | 63.5 | 0.15 | 22 | 7.9 | 0.15 | 22 | 5.1 | 0.18 | 15 |
| LNU328 | 64150.2 | — | — | — | — | — | — | 4.6 | 0.14 | 5 |
| LNU327 | 64491.2 | 57.2 | 0.14 | 10 | 7.1 | 0.14 | 10 | 4.6 | 0.21 | 4 |
| LNU312 | 64002.2 | 59.3 | 0.17 | 14 | 7.4 | 0.17 | 14 | 4.7 | 0.16 | 6 |
| CONT. | — | 52.0 | — | — | 6.5 | — | — | 4.4 | — | — |
| LNU503 | 64203.1 | 75.8 | 0.08 | 19 | 9.5 | 0.08 | 19 | 5.3 | 0.04 | 9 |
| LNU498 | 64185.3 | 69.7 | 0.26 | 9 | 8.7 | 0.26 | 9 | — | — | — |
| LNU430 | 63936.2 | — | — | — | — | — | — | 5.3 | 0.17 | 7 |
| LNU366 | 64028.3 | 76.3 | 0.28 | 20 | 9.5 | 0.28 | 20 | 5.2 | 0.27 | 6 |
| CONT. | — | 63.7 | — | — | 8.0 | — | — | 4.9 | — | — |
| LNU462 | 63504.1 | 88.9 | 0.28 | 5 | 11.1 | 0.28 | 5 | — | — | — |
| LNU455 | 64187.5 | 97.8 | 0.02 | 16 | 12.2 | 0.02 | 16 | 6.1 | 0.29 | 8 |
| LNU425 | 63911.7 | 92.0 | 0.03 | 9 | 11.5 | 0.03 | 9 | 5.9 | 0.06 | 5 |
| LNU392 | 63698.2 | — | — | — | — | — | — | 5.8 | 0.02 | 3 |
| LNU390 | 63539.4 | — | — | — | — | — | — | 5.8 | 0.08 | 3 |
| LNU329 | 63428.2 | 94.4 | 0.05 | 12 | 11.8 | 0.05 | 12 | 5.8 | 0.06 | 3 |
| LNU323 | 63424.1 | 96.1 | L | 14 | 12.0 | L | 14 | 6.0 | 0.27 | 7 |
| CONT. | — | 84.6 | — | — | 10.6 | — | — | 5.6 | — | — |
| LNU511 | 65037.1 | — | — | — | — | — | — | 5.1 | 0.30 | 4 |
| LNU511 | 65040.2 | 77.4 | 0.02 | 18 | 9.7 | 0.02 | 18 | 5.4 | 0.01 | 11 |
| LNU492 | 64175.1 | 71.8 | 0.15 | 10 | 9.0 | 0.15 | 10 | 5.2 | 0.15 | 6 |
| LNU471 | 64839.2 | 76.5 | 0.01 | 17 | 9.6 | 0.01 | 17 | 5.4 | 0.03 | 11 |
| LNU471 | 64842.1 | 84.3 | L | 29 | 10.5 | L | 29 | 5.6 | L | 16 |

TABLE 95-continued

Genes showing improved plant biomass production at standard nitrogen growth conditions

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LNU463 | 64283.4 | 79.2 | 0.01 | 21 | 9.9 | 0.01 | 21 | 5.6 | L | 14 |
| LNU454 | 64797.2 | 78.1 | 0.02 | 19 | 9.8 | 0.02 | 19 | 5.3 | 0.02 | 9 |
| LNU454 | 64799.2 | 78.1 | L | 19 | 9.8 | L | 19 | 5.3 | 0.03 | 9 |
| LNU454 | 64800.5 | — | — | — | — | — | — | 5.1 | 0.25 | 4 |
| LNU413 | 65021.4 | 73.8 | 0.11 | 13 | 9.2 | 0.11 | 13 | 5.3 | 0.04 | 8 |
| LNU413 | 65022.4 | 91.2 | 0.05 | 39 | 11.4 | 0.05 | 39 | 5.7 | L | 17 |
| LNU410 | 64971.1 | — | — | — | — | — | — | 5.2 | 0.21 | 7 |
| LNU387 | 64810.4 | 70.7 | 0.15 | 8 | 8.8 | 0.15 | 8 | 5.2 | 0.06 | 7 |
| LNU387 | 64811.3 | — | — | — | — | — | — | 5.1 | 0.15 | 5 |
| LNU382 | 64428.2 | 82.4 | L | 26 | 10.3 | L | 26 | 5.6 | L | 14 |
| LNU373 | 64830.1 | — | — | — | — | — | — | 5.2 | 0.29 | 6 |
| LNU361 | 64834.1 | 77.5 | 0.01 | 18 | 9.7 | 0.01 | 18 | 5.3 | 0.03 | 9 |
| LNU355 | 65012.2 | 86.3 | 0.05 | 32 | 10.8 | 0.05 | 32 | 5.7 | 0.03 | 16 |
| LNU355 | 65013.2 | — | — | — | — | — | — | 5.4 | 0.29 | 10 |
| LNU355 | 65014.2 | 79.6 | L | 21 | 9.9 | L | 21 | 5.3 | 0.03 | 9 |
| LNU332 | 64822.4 | 70.9 | 0.15 | 8 | 8.9 | 0.15 | 8 | 5.1 | 0.18 | 4 |
| LNU307 | 64960.1 | — | — | — | — | — | — | 5.3 | 0.13 | 9 |
| CONT. | — | 65.5 | — | — | 8.2 | — | — | 4.9 | — | — |
| LNU513 | 63458.3 | 72.5 | 0.22 | 9 | 9.1 | 0.22 | 9 | — | — | — |
| LNU512 | 63468.3 | 72.3 | 0.24 | 9 | 9.0 | 0.24 | 9 | 5.2 | 0.27 | 5 |
| LNU451 | 63497.5 | 81.4 | 0.04 | 23 | 10.2 | 0.04 | 23 | 5.5 | 0.13 | 10 |
| LNU424 | 63476.3 | 74.4 | 0.13 | 12 | 9.3 | 0.13 | 12 | — | — | — |
| LNU415 | 63691.2 | 73.2 | 0.25 | 10 | 9.2 | 0.25 | 10 | 5.2 | 0.27 | 5 |
| LNU357 | 63532.3 | 85.0 | 0.02 | 28 | 10.6 | 0.02 | 28 | 5.6 | 0.02 | 13 |
| LNU357 | 63533.8 | 85.9 | L | 30 | 10.7 | L | 30 | 5.7 | 0.01 | 15 |
| LNU357 | 63534.4 | 80.1 | 0.09 | 21 | 10.0 | 0.09 | 21 | 5.5 | 0.26 | 11 |
| LNU351 | 63466.1 | 77.5 | 0.26 | 17 | 9.7 | 0.26 | 17 | — | — | — |
| LNU344 | 63520.4 | 74.9 | 0.11 | 13 | 9.4 | 0.11 | 13 | 5.4 | 0.18 | 9 |
| LNU344 | 63521.1 | 76.1 | 0.08 | 15 | 9.5 | 0.08 | 15 | — | — | — |
| LNU330 | 63438.1 | 83.6 | 0.30 | 26 | 10.4 | 0.30 | 26 | 5.5 | 0.25 | 11 |
| LNU330 | 63441.2 | 76.0 | 0.08 | 15 | 9.5 | 0.08 | 15 | 5.3 | 0.18 | 7 |
| LNU326 | 63433.2 | — | — | — | — | — | — | 5.3 | 0.30 | 8 |
| LNU319 | 63527.1 | 73.7 | 0.16 | 11 | 9.2 | 0.16 | 11 | — | — | — |
| LNU319 | 63530.1 | 78.6 | 0.18 | 19 | 9.8 | 0.18 | 19 | — | — | — |
| LNU319 | 63530.3 | 79.2 | 0.06 | 19 | 9.9 | 0.06 | 19 | — | — | — |
| LNU302 | 63378.3 | 86.6 | L | 31 | 10.8 | L | 31 | 5.7 | 0.01 | 15 |
| LNU291 | 63385.1 | 81.5 | 0.03 | 23 | 10.2 | 0.03 | 23 | 5.6 | 0.11 | 13 |
| LNU291 | 63387.3 | 82.6 | 0.16 | 25 | 10.3 | 0.16 | 25 | 5.5 | 0.16 | 11 |
| CONT. | — | 66.3 | — | — | 8.3 | — | — | 5.0 | — | — |

Table 95:
"CONT."—Control;
"Ave."—Average;
"% Incr." = % increment;
"p-val."—p-value;
L means that p-value is less than 0.01, p < 0.1 was considered as significant.

The genes listed in Table 96 improved plant NUE when grown at standard nitrogen concentration levels. These genes produced faster developing plants when grown under limiting nitrogen growth conditions, compared to control plants as measured by growth rate of leaf number, rosette diameter and plot coverage.

TABLE 96

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LNU507 | 64087.1 | — | — | — | — | — | — | 0.5 | 0.30 | 14 |
| LNU507 | 64584.2 | — | — | — | 8.9 | 0.29 | 21 | 0.5 | 0.15 | 20 |
| LNU507 | 64585.2 | — | — | — | — | — | — | 0.5 | 0.08 | 24 |
| LNU479 | 65497.5 | — | — | — | 9.9 | 0.09 | 34 | 0.5 | 0.13 | 21 |
| LNU479 | 65499.1 | — | — | — | 9.9 | 0.10 | 34 | 0.5 | 0.16 | 19 |
| LNU418 | 65027.2 | — | — | — | 10.8 | 0.03 | 45 | 0.5 | 0.12 | 21 |
| LNU401 | 65493.3 | — | — | — | 8.9 | 0.30 | 21 | 0.5 | 0.11 | 23 |
| LNU401 | 65494.1 | — | — | — | 10.2 | 0.07 | 38 | 0.5 | 0.10 | 23 |
| LNU388 | 65487.1 | — | — | — | 9.1 | 0.24 | 23 | 0.5 | 0.10 | 23 |
| LNU377 | 64604.6 | — | — | — | 9.4 | 0.18 | 27 | 0.5 | 0.16 | 19 |
| LNU368 | 64004.3 | — | — | — | 9.5 | 0.14 | 29 | 0.5 | 0.18 | 18 |

TABLE 96-continued

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU344 | 63521.1 | 0.9 | 0.19 | 22 | 10.6 | 0.04 | 43 | 0.5 | 0.04 | 29 |
| LNU339 | 65055.1 | — | — | — | — | — | — | 0.5 | 0.18 | 18 |
| LNU337 | 64952.1 | — | — | — | — | — | — | 0.5 | 0.13 | 22 |
| LNU337 | 64953.1 | 0.9 | 0.23 | 21 | — | — | — | — | — | — |
| LNU337 | 64954.1 | 0.9 | 0.22 | 20 | — | — | — | — | — | — |
| LNU337 | 64955.2 | — | — | — | 9.4 | 0.18 | 26 | 0.5 | 0.10 | 23 |
| LNU324 | 64234.3 | — | — | — | 9.5 | 0.16 | 28 | 0.5 | 0.22 | 17 |
| LNU318 | 65067.1 | — | — | — | — | — | — | 0.5 | 0.27 | 15 |
| LNU318 | 65067.2 | — | — | — | — | — | — | 0.5 | 0.19 | 17 |
| LNU296 | 65060.2 | — | — | — | 9.2 | 0.21 | 24 | 0.5 | 0.22 | 16 |
| CONT. | — | 0.7 | — | — | 7.4 | — | — | 0.4 | — | — |
| LNU507 | 64584.1 | — | — | — | 11.1 | 0.20 | 22 | 0.5 | 0.10 | 22 |
| LNU507 | 64585.2 | — | — | — | — | — | — | 0.5 | 0.24 | 16 |
| LNU494 | 65300.2 | — | — | — | 11.9 | 0.08 | 30 | 0.5 | 0.05 | 28 |
| LNU494 | 65303.2 | — | — | — | 11.4 | 0.14 | 25 | — | — | — |
| LNU479 | 65497.3 | — | — | — | 12.3 | 0.04 | 34 | 0.5 | 0.07 | 24 |
| LNU479 | 65497.5 | — | — | — | 12.6 | 0.06 | 38 | 0.5 | 0.08 | 28 |
| LNU479 | 65498.3 | 0.7 | 0.23 | 20 | — | — | — | — | — | — |
| LNU479 | 65499.1 | — | — | — | 13.3 | 0.01 | 45 | 0.5 | 0.05 | 27 |
| LNU423 | 64596.1 | — | — | — | 11.2 | 0.24 | 22 | — | — | — |
| LNU418 | 65027.2 | 0.7 | 0.20 | 20 | — | — | — | — | — | — |
| LNU401 | 65493.2 | — | — | — | 10.8 | 0.29 | 18 | 0.5 | 0.22 | 16 |
| LNU401 | 65493.3 | — | — | — | 11.4 | 0.15 | 25 | 0.5 | 0.21 | 17 |
| LNU401 | 65494.1 | 0.7 | 0.18 | 19 | 11.6 | 0.11 | 27 | 0.5 | 0.12 | 21 |
| LNU401 | 65494.2 | 0.8 | 0.07 | 28 | — | — | — | — | — | — |
| LNU388 | 65488.1 | 0.7 | 0.19 | 20 | — | — | — | 0.5 | 0.12 | 21 |
| LNU388 | 65489.4 | 0.8 | 0.01 | 37 | — | — | — | — | — | — |
| LNU377 | 64602.2 | 0.8 | 0.14 | 23 | — | — | — | — | — | — |
| LNU377 | 64604.3 | 0.7 | 0.21 | 19 | — | — | — | — | — | — |
| LNU377 | 64605.1 | 0.8 | 0.15 | 23 | 11.9 | 0.08 | 29 | 0.5 | 0.18 | 18 |
| LNU348 | 64472.2 | — | — | — | — | — | — | 0.5 | 0.28 | 14 |
| LNU339 | 65055.1 | 0.8 | 0.10 | 26 | — | — | — | — | — | — |
| LNU339 | 65058.2 | — | — | — | — | — | — | 0.5 | 0.21 | 17 |
| LNU337 | 64955.2 | — | — | — | 10.9 | 0.28 | 19 | — | — | — |
| LNU336 | 64448.3 | 0.7 | 0.22 | 19 | — | — | — | 0.5 | 0.23 | 16 |
| LNU336 | 64449.3 | — | — | — | — | — | — | 0.5 | 0.12 | 22 |
| LNU336 | 64449.4 | — | — | — | — | — | — | 0.5 | 0.21 | 17 |
| LNU333 | 65295.2 | — | — | — | — | — | — | 0.5 | 0.23 | 16 |
| LNU333 | 65297.1 | 0.8 | 0.03 | 36 | — | — | — | — | — | — |
| LNU333 | 65297.2 | — | — | — | — | — | — | 0.5 | 0.15 | 19 |
| LNU324 | 64233.4 | — | — | — | 12.2 | 0.05 | 33 | 0.5 | 0.05 | 28 |
| LNU324 | 64234.4 | 0.8 | 0.14 | 26 | — | — | — | — | — | — |
| LNU318 | 65066.6 | — | — | — | — | — | — | 0.5 | 0.26 | 15 |
| LNU304 | 64572.2 | — | — | — | — | — | — | 0.5 | 0.17 | 18 |
| LNU304 | 64573.1 | — | — | — | — | — | — | 0.5 | 0.19 | 17 |
| LNU304 | 64575.2 | 0.8 | 0.04 | 35 | — | — | — | — | — | — |
| LNU296 | 65062.2 | — | — | — | — | — | — | 0.5 | 0.16 | 18 |
| LNU292 | 64081.2 | — | — | — | — | — | — | 0.5 | 0.27 | 15 |
| LNU292 | 64084.1 | — | — | — | — | — | — | 0.5 | 0.24 | 16 |
| LNU292 | 64085.1 | 0.7 | 0.22 | 19 | — | — | — | 0.5 | 0.26 | 15 |
| LNU292 | 64085.4 | 0.7 | 0.20 | 20 | — | — | — | — | — | — |
| CONT. | — | 0.6 | — | — | 9.2 | — | — | 0.4 | — | — |
| LNU508 | 64459.5 | 0.7 | 0.22 | 23 | — | — | — | — | — | — |
| LNU469 | 64308.4 | — | — | — | 8.4 | 0.19 | 23 | — | — | — |
| LNU469 | 64311.5 | 0.7 | 0.21 | 22 | — | — | — | — | — | — |
| LNU442 | 64060.2 | 0.7 | 0.22 | 22 | — | — | — | — | — | — |
| LNU409 | 64687.2 | — | — | — | 8.0 | 0.25 | 17 | 0.5 | 0.14 | 16 |
| LNU409 | 64689.3 | 0.7 | 0.26 | 20 | — | — | — | — | — | — |
| LNU363 | 64410.2 | — | — | — | 8.6 | 0.11 | 26 | 0.4 | 0.24 | 13 |
| LNU314 | 64433.1 | — | — | — | 7.9 | 0.29 | 16 | — | — | — |
| CONT. | — | 0.6 | — | — | 6.8 | — | — | 0.4 | — | — |
| LNU517 | 64296.4 | — | — | — | 6.7 | 0.17 | 21 | — | — | — |
| LNU501 | 64197.10 | — | — | — | 6.4 | 0.29 | 16 | — | — | — |
| LNU397 | 64373.3 | — | — | — | 6.7 | 0.19 | 21 | 0.4 | 0.21 | 15 |
| LNU369 | 64387.1 | 0.6 | 0.29 | 18 | — | — | — | — | — | — |
| LNU369 | 64389.2 | — | — | — | 6.7 | 0.19 | 21 | — | — | — |
| LNU342 | 64036.2 | — | — | — | 6.7 | 0.17 | 21 | 0.4 | 0.21 | 15 |
| CONT. | — | 0.5 | — | — | 5.5 | — | — | 0.4 | — | — |
| LNU513 | 63458.2 | — | — | — | 6.3 | 0.03 | 34 | 0.4 | 0.06 | 14 |
| LNU512 | 63470.1 | — | — | — | 5.5 | 0.24 | 17 | — | — | — |
| LNU451 | 63496.2 | — | — | — | — | — | — | 0.4 | 0.13 | 11 |
| LNU451 | 63499.5 | — | — | — | 5.9 | 0.10 | 25 | 0.4 | 0.17 | 10 |
| LNU451 | 63500.1 | — | — | — | 5.7 | 0.20 | 20 | — | — | — |
| LNU415 | 63693.4 | — | — | — | 5.6 | 0.25 | 17 | — | — | — |

TABLE 96-continued

| | | RGR Of Leaf Number | | | RGR Of Plot Coverage | | | RGR Of Rosette Diameter | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LNU411 | 63514.3 | — | — | — | 5.7 | 0.16 | 21 | — | — | — |
| LNU375 | 63452.2 | 0.7 | 0.22 | 17 | — | — | — | 0.4 | 0.30 | 8 |
| LNU375 | 63454.1 | — | — | — | 5.9 | 0.12 | 24 | 0.4 | 0.08 | 13 |
| LNU375 | 63454.2 | — | — | — | 6.0 | 0.09 | 27 | 0.4 | 0.10 | 14 |
| LNU370 | 63545.2 | — | — | — | — | — | — | 0.4 | 0.13 | 12 |
| LNU370 | 63545.6 | — | — | — | 5.8 | 0.13 | 23 | 0.4 | 0.08 | 13 |
| LNU357 | 63533.1 | — | — | — | 6.8 | 0.01 | 43 | 0.4 | 0.06 | 15 |
| LNU357 | 63533.8 | — | — | — | 5.7 | 0.17 | 21 | — | — | — |
| LNU357 | 63534.1 | — | — | — | 5.5 | 0.29 | 16 | 0.4 | 0.28 | 8 |
| LNU351 | 63464.1 | — | — | — | — | — | — | 0.4 | 0.29 | 8 |
| LNU326 | 63433.4 | — | — | — | 5.7 | 0.18 | 20 | 0.4 | 0.09 | 13 |
| LNU326 | 63435.1 | — | — | — | 5.6 | 0.24 | 18 | — | — | — |
| LNU319 | 63528.1 | — | — | — | 5.8 | 0.16 | 22 | — | — | — |
| LNU319 | 63530.3 | — | — | — | 5.9 | 0.11 | 24 | 0.4 | 0.11 | 12 |
| LNU308 | 63414.1 | — | — | — | 5.6 | 0.25 | 18 | 0.4 | 0.18 | 10 |
| LNU308 | 63415.3 | — | — | — | 5.6 | 0.21 | 19 | — | — | — |
| LNU308 | 63417.5 | — | — | — | 5.6 | 0.22 | 19 | 0.4 | 0.17 | 10 |
| LNU308 | 63417.8 | — | — | — | 6.4 | 0.03 | 35 | 0.4 | 0.02 | 16 |
| LNU302 | 63380.1 | — | — | — | 5.8 | 0.15 | 22 | 0.4 | 0.18 | 10 |
| LNU302 | 63381.1 | — | — | — | 5.5 | 0.27 | 16 | 0.4 | 0.22 | 9 |
| LNU302 | 63382.2 | — | — | — | 6.3 | 0.04 | 33 | 0.4 | 0.05 | 15 |
| LNU291 | 63385.1 | 0.7 | 0.29 | 16 | — | — | — | — | — | — |
| LNU291 | 63387.1 | 0.7 | 0.28 | 15 | 5.9 | 0.11 | 25 | 0.4 | 0.20 | 9 |
| CONT. | — | 0.6 | — | — | 4.7 | — | — | 0.3 | — | — |
| LNU477 | 63888.1 | — | — | — | 9.7 | 0.19 | 21 | — | — | — |
| LNU469 | 64311.8 | — | — | — | 9.4 | 0.26 | 17 | — | — | — |
| LNU442 | 64056.1 | 0.7 | 0.26 | 15 | — | — | — | — | — | — |
| LNU376 | 63987.3 | 0.7 | 0.26 | 14 | 10.5 | 0.06 | 30 | 0.5 | 0.13 | 15 |
| LNU314 | 64433.1 | 0.8 | 0.21 | 19 | — | — | — | — | — | — |
| CONT. | — | 0.6 | — | — | 8.0 | — | — | 0.4 | — | — |
| LNU511 | 65036.2 | — | — | — | 14.1 | 0.01 | 37 | 0.6 | 0.23 | 11 |
| LNU511 | 65037.1 | — | — | — | 14.8 | L | 44 | — | — | — |
| LNU511 | 65037.3 | — | — | — | 12.1 | 0.27 | 18 | — | — | — |
| LNU492 | 64174.2 | — | — | — | 12.8 | 0.11 | 24 | — | — | — |
| LNU492 | 64176.4 | — | — | — | 13.9 | 0.03 | 35 | 0.6 | 0.14 | 15 |
| LNU476 | 64041.2 | — | — | — | 12.8 | 0.12 | 24 | 0.6 | 0.12 | 16 |
| LNU476 | 64042.1 | — | — | — | 13.0 | 0.08 | 27 | 0.6 | 0.16 | 14 |
| LNU471 | 64838.3 | — | — | — | 13.8 | 0.03 | 34 | — | — | — |
| LNU471 | 64839.2 | — | — | — | 12.9 | 0.08 | 26 | — | — | — |
| LNU471 | 64841.3 | — | — | — | 12.5 | 0.16 | 21 | — | — | — |
| LNU471 | 64842.1 | — | — | — | 13.1 | 0.06 | 28 | — | — | — |
| LNU463 | 64280.4 | — | — | — | 12.2 | 0.21 | 19 | — | — | — |
| LNU463 | 64281.3 | — | — | — | 14.8 | L | 44 | 0.6 | 0.07 | 18 |
| LNU454 | 64796.3 | — | — | — | 12.0 | 0.24 | 17 | — | — | — |
| LNU454 | 64797.2 | 0.8 | 0.23 | 20 | — | — | — | — | — | — |
| LNU422 | 64965.2 | — | — | — | 13.8 | 0.05 | 34 | 0.6 | 0.13 | 17 |
| LNU413 | 65019.1 | — | — | — | 14.8 | L | 43 | 0.6 | 0.08 | 19 |
| LNU413 | 65019.2 | — | — | — | 12.1 | 0.23 | 18 | — | — | — |
| LNU413 | 65021.4 | — | — | — | 13.3 | 0.05 | 29 | 0.6 | 0.12 | 15 |
| LNU413 | 65021.5 | — | — | — | 12.5 | 0.14 | 21 | — | — | — |
| LNU410 | 64971.2 | — | — | — | 12.8 | 0.16 | 24 | 0.6 | 0.27 | 12 |
| LNU410 | 64974.3 | — | — | — | 12.5 | 0.16 | 22 | — | — | — |
| LNU387 | 64808.1 | — | — | — | 11.9 | 0.29 | 16 | — | — | — |
| LNU387 | 64811.3 | — | — | — | 12.8 | 0.10 | 25 | 0.6 | 0.22 | 12 |
| LNU382 | 64428.2 | — | — | — | 12.0 | 0.27 | 16 | — | — | — |
| LNU382 | 64430.1 | — | — | — | 12.8 | 0.11 | 24 | — | — | — |
| LNU373 | 64826.4 | — | — | — | 12.1 | 0.25 | 18 | — | — | — |
| LNU373 | 64827.2 | — | — | — | 12.8 | 0.10 | 25 | — | — | — |
| LNU373 | 64828.1 | — | — | — | 12.7 | 0.12 | 23 | 0.6 | 0.25 | 11 |
| LNU361 | 64832.1 | — | — | — | 17.5 | L | 70 | 0.7 | L | 30 |
| LNU361 | 64836.2 | — | — | — | 13.2 | 0.08 | 28 | — | — | — |
| LNU355 | 65012.1 | — | — | — | 12.2 | 0.21 | 19 | — | — | — |
| LNU355 | 65014.2 | — | — | — | 12.1 | 0.25 | 18 | 0.6 | 0.29 | 11 |
| LNU355 | 65015.2 | — | — | — | 13.3 | 0.06 | 29 | 0.6 | 0.17 | 13 |
| LNU332 | 64821.1 | — | — | — | 12.7 | 0.12 | 24 | 0.6 | 0.22 | 12 |
| LNU332 | 64822.4 | — | — | — | 12.7 | 0.17 | 23 | — | — | — |
| LNU332 | 64824.3 | 0.8 | 0.28 | 17 | — | — | — | — | — | — |
| LNU307 | 64959.2 | — | — | — | 12.2 | 0.22 | 18 | 0.6 | 0.28 | 11 |
| LNU307 | 64960.2 | — | — | — | 12.0 | 0.27 | 16 | — | — | — |
| LNU303 | 65043.2 | — | — | — | 12.4 | 0.17 | 21 | 0.6 | 0.28 | 10 |
| LNU303 | 65046.1 | — | — | — | 14.0 | 0.02 | 36 | — | — | — |
| LNU300 | 65030.2 | — | — | — | 12.7 | 0.12 | 23 | 0.6 | 0.23 | 12 |
| LNU300 | 65031.3 | — | — | — | 14.4 | 0.01 | 40 | 0.6 | 0.13 | 15 |
| LNU300 | 65033.1 | — | — | — | 13.8 | 0.03 | 34 | 0.6 | 0.24 | 12 |

TABLE 96-continued

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.7 | — | — | 10.3 | — | — | 0.5 | — | — |
| LNU517 | 64296.3 | 0.7 | 0.17 | 26 | 9.2 | 0.07 | 34 | — | — | — |
| LNU517 | 64297.9 | — | — | — | 8.6 | 0.14 | 25 | — | — | — |
| LNU509 | 64690.3 | 0.7 | 0.17 | 25 | 9.5 | 0.03 | 39 | — | — | — |
| LNU509 | 64692.3 | 0.7 | 0.25 | 22 | 9.0 | 0.06 | 31 | — | — | — |
| LNU509 | 64692.6 | — | — | — | 8.9 | 0.08 | 30 | — | — | — |
| LNU504 | 64455.6 | 0.7 | 0.10 | 28 | — | — | — | — | — | — |
| LNU501 | 64197.1 | — | — | — | 8.1 | 0.15 | 18 | — | — | — |
| LNU461 | 64666.1 | — | — | — | 8.3 | 0.23 | 20 | — | — | — |
| LNU461 | 64668.5 | 0.7 | 0.23 | 21 | 8.7 | 0.13 | 26 | — | — | — |
| LNU397 | 64375.1 | — | — | — | 8.7 | 0.13 | 26 | — | — | — |
| LNU396 | 64315.13 | — | — | — | 9.8 | 0.02 | 43 | 0.5 | 0.19 | 16 |
| LNU372 | 64481.1 | — | — | — | 8.4 | 0.16 | 23 | — | — | — |
| LNU372 | 64483.3 | 0.7 | 0.15 | 24 | 9.1 | 0.06 | 32 | — | — | — |
| LNU372 | 64485.1 | — | — | — | 8.0 | 0.29 | 17 | — | — | — |
| LNU372 | 64485.3 | — | — | — | 8.1 | 0.30 | 17 | — | — | — |
| LNU369 | 64386.1 | — | — | — | 8.4 | 0.18 | 22 | — | — | — |
| LNU369 | 64387.1 | — | — | — | 8.3 | 0.22 | 20 | — | — | — |
| LNU365 | 64712.3 | 0.7 | 0.29 | 18 | 8.2 | 0.24 | 19 | — | — | — |
| LNU350 | 64674.2 | 0.7 | 0.25 | 21 | 9.1 | 0.06 | 33 | 0.5 | 0.23 | 15 |
| LNU345 | 64333.4 | — | — | — | 8.4 | 0.21 | 23 | — | — | — |
| LNU345 | 64337.1 | — | — | — | 8.5 | 0.17 | 24 | — | — | — |
| LNU342 | 64036.2 | 0.7 | 0.29 | 20 | 8.7 | 0.13 | 26 | — | — | — |
| LNU313 | 64661.8 | — | — | — | 8.5 | 0.14 | 24 | — | — | — |
| LNU313 | 64663.2 | — | — | — | 9.1 | 0.05 | 33 | — | — | — |
| LNU294 | 64657.2 | — | — | — | 8.4 | 0.19 | 22 | — | — | — |
| CONT. | — | 0.6 | — | — | 6.9 | — | — | 0.4 | — | — |
| LNU458 | 63893.1 | 0.7 | 0.20 | 20 | — | — | — | — | — | — |
| LNU419 | 63896.2 | — | — | — | 9.0 | 0.23 | 17 | — | — | — |
| LNU403 | 64236.3 | — | — | — | — | — | — | 0.5 | 0.26 | 9 |
| CONT. | — | 0.6 | — | — | 7.7 | — | — | 0.5 | — | — |
| LNU520 | 64156.14 | — | — | — | — | — | — | 0.4 | 0.25 | 10 |
| LNU520 | 64156.7 | — | — | — | 7.8 | 0.25 | 17 | 0.4 | 0.13 | 14 |
| LNU493 | 64190.3 | 0.7 | 0.17 | 24 | — | — | — | — | — | — |
| LNU493 | 64191.3 | — | — | — | 7.7 | 0.27 | 16 | — | — | — |
| LNU481 | 64141.1 | 0.7 | 0.26 | 20 | — | — | — | — | — | — |
| LNU472 | 63920.6 | — | — | — | — | — | — | 0.4 | 0.29 | 10 |
| LNU419 | 63897.4 | — | — | — | 7.9 | 0.24 | 19 | — | — | — |
| LNU419 | 63897.5 | — | — | — | — | — | — | 0.5 | 0.04 | 19 |
| LNU419 | 63897.6 | 0.7 | 0.20 | 26 | 8.2 | 0.12 | 24 | — | — | — |
| LNU343 | 64208.1 | 0.7 | 0.17 | 25 | 9.0 | 0.03 | 34 | 0.4 | 0.18 | 12 |
| LNU340 | 64290.7 | — | — | — | — | — | — | 0.4 | 0.29 | 10 |
| LNU328 | 64150.1 | — | — | — | 8.2 | 0.12 | 23 | 0.5 | 0.03 | 21 |
| LNU328 | 64151.2 | 0.7 | 0.23 | 21 | — | — | — | — | — | — |
| LNU312 | 64002.2 | 0.7 | 0.20 | 21 | 7.7 | 0.28 | 16 | 0.4 | 0.22 | 12 |
| LNU305 | 64114.1 | 0.7 | 0.25 | 17 | — | — | — | — | — | — |
| CONT. | — | 0.6 | — | — | 6.7 | — | — | 0.4 | — | — |
| LNU503 | 64203.1 | — | — | — | 10.0 | 0.26 | 20 | 0.5 | 0.28 | 12 |
| LNU444 | 64182.3 | 0.8 | 0.28 | 15 | — | — | — | — | — | — |
| LNU430 | 63936.2 | — | — | — | — | — | — | 0.5 | 0.26 | 13 |
| LNU366 | 64028.3 | — | — | — | 10.0 | 0.27 | 20 | — | — | — |
| LNU335 | 64169.2 | 0.9 | 0.12 | 21 | — | — | — | — | — | — |
| LNU317 | 64093.3 | 0.8 | 0.28 | 14 | — | — | — | — | — | — |
| CONT. | — | 0.7 | — | — | 8.4 | — | — | 0.5 | — | — |
| LNU499 | 64146.11 | 0.8 | 0.18 | 15 | — | — | — | — | — | — |
| LNU499 | 64146.12 | 0.8 | 0.22 | 14 | — | — | — | — | — | — |
| LNU499 | 64146.7 | 0.8 | 0.28 | 11 | — | — | — | — | — | — |
| LNU468 | 63492.2 | 0.8 | 0.28 | 12 | — | — | — | — | — | — |
| LNU468 | 63492.3 | 0.8 | 0.04 | 24 | — | — | — | — | — | — |
| LNU468 | 63493.4 | 0.8 | 0.17 | 16 | — | — | — | — | — | — |
| LNU467 | 63716.1 | 0.8 | 0.26 | 12 | — | — | — | — | — | — |
| LNU467 | 63718.2 | 0.8 | 0.17 | 14 | — | — | — | — | — | — |
| LNU462 | 63503.1 | 0.8 | 0.10 | 19 | — | — | — | — | — | — |
| LNU462 | 63503.2 | 0.8 | 0.23 | 13 | — | — | — | — | — | — |
| LNU462 | 63505.1 | 0.8 | 0.24 | 12 | — | — | — | — | — | — |
| LNU455 | 64187.5 | 0.8 | 0.07 | 20 | 12.8 | 0.23 | 16 | — | — | — |
| LNU450 | 63708.6 | 0.8 | 0.20 | 14 | — | — | — | — | — | — |
| LNU450 | 63709.4 | 0.8 | 0.04 | 23 | — | — | — | — | — | — |
| LNU450 | 63710.2 | 0.8 | 0.13 | 16 | — | — | — | — | — | — |
| LNU425 | 63911.7 | 0.8 | 0.06 | 23 | — | — | — | 0.6 | 0.22 | 9 |
| LNU402 | 63913.1 | 0.8 | 0.21 | 14 | — | — | — | — | — | — |
| LNU402 | 63913.4 | 0.8 | 0.17 | 14 | — | — | — | — | — | — |
| LNU402 | 63915.1 | 0.9 | 0.03 | 25 | — | — | — | — | — | — |
| LNU399 | 63944.2 | 0.9 | 0.01 | 28 | — | — | — | — | — | — |

TABLE 96-continued

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU399 | 63944.6 | 0.8 | 0.15 | 16 | — | — | — | — | — | — |
| LNU399 | 63946.1 | 0.8 | 0.22 | 15 | — | — | — | — | — | — |
| LNU395 | 64142.5 | 0.8 | 0.23 | 13 | — | — | — | — | — | — |
| LNU395 | 64142.8 | 0.8 | 0.14 | 16 | — | — | — | — | — | — |
| LNU392 | 63696.2 | 0.8 | 0.18 | 15 | — | — | — | — | — | — |
| LNU392 | 63697.4 | 0.8 | 0.15 | 15 | — | — | — | — | — | — |
| LNU392 | 63698.2 | 0.8 | 0.13 | 16 | — | — | — | — | — | — |
| LNU392 | 63700.3 | 0.8 | 0.25 | 13 | — | — | — | — | — | — |
| LNU390 | 63538.1 | 0.8 | 0.05 | 22 | — | — | — | — | — | — |
| LNU390 | 63539.2 | 0.8 | 0.12 | 16 | — | — | — | — | — | — |
| LNU390 | 63540.9 | 0.8 | 0.14 | 16 | — | — | — | — | — | — |
| LNU349 | 63989.1 | 0.8 | 0.03 | 23 | — | — | — | — | — | — |
| LNU349 | 63989.5 | 0.8 | 0.24 | 13 | — | — | — | — | — | — |
| LNU349 | 63989.6 | 0.8 | 0.14 | 16 | — | — | — | — | — | — |
| LNU349 | 63990.2 | 0.9 | 0.01 | 29 | — | — | — | — | — | — |
| LNU347 | 63510.4 | 0.8 | 0.16 | 15 | — | — | — | — | — | — |
| LNU329 | 63428.2 | 0.8 | 0.28 | 14 | — | — | — | — | — | — |
| LNU329 | 63429.1 | 0.8 | 0.15 | 16 | — | — | — | — | — | — |
| LNU329 | 63430.3 | 0.8 | 0.20 | 13 | — | — | — | — | — | — |
| LNU323 | 63420.1 | 0.8 | 0.08 | 19 | — | — | — | — | — | — |
| LNU323 | 63421.2 | 0.8 | 0.08 | 19 | — | — | — | — | — | — |
| CONT. | — | 0.7 | — | — | 11.0 | — | — | 0.5 | — | — |
| LNU511 | 65037.3 | — | — | — | — | — | — | 0.5 | 0.28 | 9 |
| LNU511 | 65040.2 | — | — | — | 10.0 | 0.16 | 19 | 0.5 | 0.08 | 15 |
| LNU492 | 64175.1 | 0.9 | 0.14 | 20 | — | — | — | 0.5 | 0.20 | 11 |
| LNU492 | 64176.4 | — | — | — | 9.8 | 0.29 | 16 | — | — | — |
| LNU471 | 64839.2 | — | — | — | 10.0 | 0.16 | 19 | 0.5 | 0.06 | 17 |
| LNU471 | 64842.1 | — | — | — | 11.0 | 0.03 | 30 | 0.5 | 0.02 | 21 |
| LNU463 | 64281.3 | — | — | — | — | — | — | 0.5 | 0.27 | 10 |
| LNU463 | 64283.4 | — | — | — | 10.1 | 0.13 | 20 | 0.5 | 0.05 | 18 |
| LNU463 | 64283.5 | — | — | — | — | — | — | 0.5 | 0.13 | 14 |
| LNU454 | 64797.2 | — | — | — | 10.1 | 0.16 | 20 | 0.5 | 0.22 | 11 |
| LNU454 | 64799.2 | — | — | — | 10.1 | 0.15 | 20 | 0.5 | 0.12 | 13 |
| LNU454 | 64800.5 | — | — | — | — | — | — | 0.5 | 0.14 | 13 |
| LNU413 | 65021.4 | — | — | — | — | — | — | 0.5 | 0.20 | 11 |
| LNU413 | 65022.4 | — | — | — | 11.7 | 0.01 | 39 | 0.5 | 0.02 | 20 |
| LNU410 | 64971.1 | — | — | — | — | — | — | 0.5 | 0.19 | 11 |
| LNU387 | 64808.1 | — | — | — | — | — | — | 0.5 | 0.08 | 16 |
| LNU387 | 64810.4 | — | — | — | — | — | — | 0.5 | 0.13 | 13 |
| LNU387 | 64811.2 | — | — | — | — | — | — | 0.5 | 0.30 | 9 |
| LNU382 | 64428.2 | — | — | — | 10.7 | 0.06 | 27 | 0.5 | 0.02 | 21 |
| LNU382 | 64429.3 | — | — | — | — | — | — | 0.5 | 0.29 | 9 |
| LNU373 | 64830.1 | 0.8 | 0.24 | 14 | — | — | — | 0.5 | 0.19 | 11 |
| LNU361 | 64834.1 | 0.8 | 0.20 | 16 | 10.1 | 0.15 | 20 | 0.5 | 0.06 | 16 |
| LNU355 | 65012.2 | — | — | — | 11.1 | 0.03 | 31 | 0.5 | 0.02 | 21 |
| LNU355 | 65013.2 | — | — | — | 10.2 | 0.15 | 22 | 0.5 | 0.06 | 18 |
| LNU355 | 65014.2 | — | — | — | 10.3 | 0.11 | 23 | 0.5 | 0.15 | 12 |
| LNU332 | 64823.1 | 0.9 | 0.18 | 18 | — | — | — | — | — | — |
| LNU307 | 64959.2 | — | — | — | — | — | — | 0.5 | 0.12 | 13 |
| LNU307 | 64960.1 | — | — | — | — | — | — | 0.5 | 0.12 | 14 |
| LNU303 | 65043.1 | — | — | — | — | — | — | 0.5 | 0.28 | 10 |
| LNU303 | 65043.2 | — | — | — | 9.7 | 0.29 | 15 | 0.5 | 0.16 | 13 |
| LNU300 | 65032.1 | 0.8 | 0.29 | 14 | — | — | — | — | — | — |
| CONT. | — | 0.7 | — | — | 8.4 | — | — | 0.4 | — | — |
| LNU513 | 63458.3 | 0.9 | 0.15 | 14 | — | — | — | — | — | — |
| LNU512 | 63470.1 | 0.9 | 0.07 | 17 | — | — | — | — | — | — |
| LNU451 | 63497.5 | — | — | — | 10.5 | 0.14 | 23 | — | — | — |
| LNU357 | 63532.3 | — | — | — | 11.0 | 0.08 | 29 | — | — | — |
| LNU357 | 63533.8 | 0.9 | 0.15 | 15 | 11.1 | 0.06 | 30 | 0.5 | 0.10 | 16 |
| LNU357 | 63534.4 | — | — | — | 10.3 | 0.19 | 21 | — | — | — |
| LNU351 | 63466.1 | — | — | — | 10.0 | 0.28 | 17 | — | — | — |
| LNU344 | 63520.4 | — | — | — | — | — | — | 0.5 | 0.22 | 12 |
| LNU330 | 63438.1 | — | — | — | 10.9 | 0.12 | 27 | 0.5 | 0.18 | 14 |
| LNU330 | 63441.2 | 1.0 | 0.05 | 19 | — | — | — | — | — | — |
| LNU319 | 63527.1 | 0.9 | 0.25 | 11 | — | — | — | — | — | — |
| LNU319 | 63528.1 | 0.9 | 0.29 | 11 | 10.4 | 0.20 | 21 | — | — | — |
| LNU319 | 63530.1 | 0.9 | 0.15 | 15 | 10.1 | 0.23 | 19 | — | — | — |
| LNU319 | 63530.3 | — | — | — | 10.2 | 0.22 | 19 | — | — | — |
| LNU302 | 63378.3 | — | — | — | 11.3 | 0.05 | 33 | 0.6 | 0.07 | 18 |

TABLE 96-continued

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LNU291 | 63385.1 | — | — | — | 10.5 | 0.14 | 23 | 0.5 | 0.19 | 13 |
| LNU291 | 63387.3 | — | — | — | 10.7 | 0.12 | 25 | 0.5 | 0.18 | 13 |
| CONT. | — | 0.8 | — | — | 8.5 | — | — | 0.5 | — | — |

Table 96.
"CONT."—Control;
"Ave."—Average;
"% Incr." = % increment;
"p-val."—p-value;
L means that p-value is less than 0.01, p < 0.1 was considered as significant.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (4406 sequences)

SEQ ID NO: 1 - DNA, 1648 bp, Triticum aestivum
gccaaaccaacccaaaaagcatttggtacgaggactctaggagagtgaagccatgaagaagagcgttgtcctgtaccctggcgtcggcgtcggccacctggtgccgatggtggaggtcgccaagctcttcctcaagcacggcctggccgtcaccgtggtgctcatcgacccgcaggtcgagtccacggacttctcctccgccgtcgcccgcgctagggcctccaacccctccgtcgccttccacgtcctgccaacgccgcccgccgattccaactccgacaccgcgcccaccaaccccgtcgtccagattttccggctcctgaaatccatgaacgcccccctcctcgacttcctccgctcgctgccctccgtcgacgcactcgtcctcgacatgttctgcgtcgacgcccaagatgtcgccgccgagctcaagctgccggtctactacttctacgcgtcggccgccgccgacctcgcgctcttcctcaacctgccgactatgctcgccggcagtaaggtaaaggagctcggcgactctatcatcacttccccgggtgttcctccgttgaaagcttcggacttacccgaggttacacacaacgatgaagtactcaagaccatcttaggcatgttcgaccgaatgccagattccaatggaattctcattaattccttcgagtcgctggagacgcgcgcggtgcgcgctcttaaggacgggctctgcgtccctggtcgtgccacgccgccggtctactgcatcgggcctttggtgtcgggaggcggtgaccaggagcacgagtgcctccggtggctggacgcgcagccggaccagagcgtagtgttcctctccttcggcagcatgggcacgttctccgttcagcagctacaggagattgcaaatggattggataagtcaggggagagattcctgtgggtcgtgcggagcccgcgcaatcccgactacaagtacggcgattcgctgccggagcccgatctcgacgcgctcatgccggaagggttcttggagaggaccaaggacagaggactcgtgatcaagtcttgggcgccgcaggtggaggtcctgcgccacagggcgaccggcgcgttcatgacgcactgcggctggaactcgacgctggagggcatcacggcagggctgccgctgctgtgctggccgctgtacgcggagcagaaggtgaacaaggtgcacatagtggagggaatgaagctcggggtggagatgagaggctacaacgaagaggtggttaaggccgaggaggtggaggagaaggtcaggtgggttatggcgtccgagggcggcaaggcgctcagggagcgggtggcggcggcgaaggatgcagctgccgaggcgctcaaggaagggggctcgtctcacttggcgtttgtccaattcctcaacgacctggacatttccatagccccaaccgtgcagcattgatgtgaaacttgtaaactttatttaatgttcgatttgtagtagcgggctatctcattttgatattatatgcggactaggtttatttctggacccttccgcagctactgttggttgtcgaaaaaaattcgaaaaaaaaaaaaaaaaaaaaaaaaaacactgtcatgccgttacgtagcgaatcacgaattc

SEQ ID NO: 2 - DNA, 4320 bp, Sorghum bicolor
ggggaatccagggtctattatgtcgttttaccttacaattttgctagatacaaagcataaaaataaataatatatatacaaaaaatccagatgttgatgaaattccattttttgtgttactccattttttgtgttactttagtagattttactctgtttatcctttagtttaattctgtttgaatttcgctgtattctgtaatgtaaatagaacgaaatttattgtgtaaaatgaaatttcaataaaataaaaaaggagtcttcatgtcccgttatcgagggcctcgtttaaaaaaaatacgccgtctgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcgctggaaaagcgaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtcaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctattaattcgtattttcccgttcacctagcagaaatagattaaccctaggatccttttttcttttttgttatttcctagatgtgtattttacataccacagtaatttgctatagagaatttctattaattaaaggcattattgttggaataaattgttatttaatttgatacattgtgatcgctaacattgatgaattaagagaaacggaaagagagggattcgaaccctcggtaaacaaaagtctacatagcagttccaatgctacgccttgaaccgctcggccatctctcctacataatcttattatggaaaataaactgagtgaatagcgagttttcgtattcctgcagtacaggtacagccacaacggctcgggaattccatggctctattggattggatggaaaaattccttttcatctaagtggaaggatccagtatttttttactaggaattccgcttcctcgaaaagtttttctttggggaaaacaaaaataaaaagagaatggaagaattcttcttattccataagaaaataaaggaaccctagaattctatttgcataaggtacattacgccatacaatctaaatataaaaggggtatggggcaattaattactttgaaaacgcgaaatagctgatgagagaagttgttgttgagaaataggaaagtggaatgaaatccagtcttagtcaaatatttcatatctcttcttgtccaaacagaaggaaaaggagacaatttgagctgagcggaaaatccatacctctcttatccattccatttagagcatatggatcgatttataagaatcgagtgttttgtttttatgttattttgtgatagaatgaaaagaattctatatagaatgggttgggaattatgcctagatcccgtataaatggaaatttcattgataagacctcctcgattgtagccaatattttattgcaaataattccgacaacctccggggaaaaaagggcatttacttattatagagatggtgcgatttgactcttttttttattttagccctacctatatctcattcttacgagaaagagagagggttcgcatagagagaacaaaattagtaaaggaaacccgcgcttggggaaggtgaggtgaactaacaattccttctgtcgtgtatcctcgattgatgtggcctcagatgcttcaattgtagatttgagtattgagcgaaaggttacacctacaggataggttctgtattacaggccaatccgactctactagtaccaataggcagcataggggagaaaagcactacaccacgaaataggaatcaacaagagaaaaactttgttagaaattagccctttcctgattggtatcagggttgggaagaatggttgggataacaaacaaccatcaggtttgtactttggatacccttataaccatcaaaggtcgttgaagtggctaattcctctaaataggaggcgttgagaacaaagaaattcttggagctatcgttttcctctagcattaatataattcattggtgttaagaaaaacctcttgggggaaggttggctagagatttcttggaaaaataccagcccccttcggtccataatgagatgggactaattctatttttattctatagatttttcgcttagtactagtatagaagggagaagccgtatgagatgaaaacctcatgtacggttttggaacggagattttttgaatagaatgaacgaccgtaacggatgttggctcaatccgaaggaaattatgcggaagctttgcagaattattatgaagctacgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacgtgcgactatctccactatagaaagaagaaaaaaagaaaggaggaaattttctagtgaatactagaaaagagggctttctacatagggatcgtcaaaacaacgattttaccctatcagctgtaggaaggaaggacacttcacgagaatcaaaataggaagaaagtagagcctatactactattctatggataaagctgaaattgatagagaaaacaccgtaaagatcaattagtgagcgactgggtcgatacaactaaaaaaaactgcttcattataccacgatatgggacaaaatttaggaatccgcttatgtaataaagccgatccactaagggattaagcagcggtgtagtatcagatcccaaagatagtaagttcttttttctttcttatggaaaaaggtctttttccaggattctatagaaatttcatatatgaaagaaacgaaaccgagatagttacctttcagaaaattcgaacgaaggatataggtctatctatgcttcattcttctgaaggtgggagaaaagatcaaactgattattgatcaaaattagggtttgaaacttaggtaattaacttcttctgcttaacccaagaagaaattggattgatttttgagaaatcgaattcagttaatataggggaaattaagatagcaatttctgagccgtatgaggtaggaaactctcaagtacggttctagggaaaggaactgcctattccgaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggaagatcaaatcaagaatttcattatatccctttcttctaccttcaattttatatcatatttcataaggataaacaatagggataggctctggaacagaagtaataaagtacataaaagtcggcaatctaaatattcctacctaatatatcaggacggtcttattaataattctaatgagttatcttggaatttggaatcgaatcaaaaaatctatattatgctcactcaaggaaagtagatgtagatagggacttataccctcagaaaaaaaatacactagcttcttaaattaaaacgtaaaaaaagatttttttgttatgtcgggaaataatttcccagaataaccaatgtccgttaggcacctaatccttatgtcataatagatccgaacacttgccttggattgacttcaatatataattgctccagtgaataactaaaaaaaaatagaaggacggtagatagtaaagaaaaggac

SEQ ID NO: 3 - DNA, 1379 bp, Sorghum bicolor
acagtctaaaagaggggagccacctctttcccagttcacacggacccgtgtgtgagcgcacccctcctcgtgctcctatggaggccaccccgatctccgtgaaaccaccgtcgccggcgctggcggcgccacccccggccacgctggggcccagggacatgccaacgcatgccgtcggagggaccgagctggagccgtccagcatgaaccagctggcaatagccccggaccccaagcggcagagggtagaggaggctgcggatggtaacgggtgcaagcattgcgcctgcaagaagtccagatgcttgaagctctattgcccatgtttttctggaggtggttattgttctgataagtgtggctgccaaccatgtttcaacaaagaagctttttcagaaacagttcagactactcgcaaggtgttactttcaagacagaagcgtatgtcaatgaaaattaataggagacctgaggcaaatgctgaacctatggaagatgctcaccattcttcttcttcaactccaccaaggagaggttgcaactgcaagaaatcaagttgcctaaagaaatactgtgattgctaccaggatgggaccggatgttccttgttttgccgttgtgacgattgccagaatccttttgggaaaaatgaaggcataatagctgatgatagtaagcgctatctatatactggtgctgatttggatcacagcgagggtgaacatgactttgttgtggagcgctcgcctcgtctacaatcacctatctcgaaggagtcttctttccaccaaaccccacctcatcttagggtctcaagcagagacacacatgtgttcccacaggcgatatcccagtggcaggcactgccccgctcgtggcagcattgtgccaacaagaggaacagcaatgacagggtgatggacgactctgcaaactacaagaactcaaaccatgactggcagctatccaagcacgaggacagctacagcatatcgaagtgcgtccagatcctgaacggcatggtggagctgtcacaggtggagaaatcagttgcccccgatgtcttcctgcagccaggcaaccgggaaattttcatctccctcagcggcgatgtgcgcgccatgtggctgaagcgcaagattcagcacctggcctagggtgggttgccttgtgccgtccttccgagtggagattggaggggacattgagttatcttttagatcttgcgtgttctgctgatcgtgggcatgcacaggattctaggtttttttttcccctgtatattgagtgtattcctggattataaccattatgtattgtctttgtagagagccattttgagcctggtatccgttaataaaatgagattgtacacctac

SEQ ID NO: 4 - DNA, 1662 bp, Oryza sativa
agagagaaagaggcggtttcagaagcgcagagagagagagagagagtagaaaaatctccgcacgcaacgccaatccttccttccccttcttctcgcgagagagagagagagagagagagagagagagagagtagttcagttcccattctcgcctgctttcctcactcgcgatcgcgactccccccctcctcgtcgccggaagatggagcctgatcagagtggtgctgagcagacttctccacgtgggaatgattgggaagttgtccaacttactgcatcaacatatgcatctgcacctggaccaagaatgtctgagccttctgatgaggctgaagtcaagggatatgacacaaaaggggatgattcagctgcagcactgttgatgtctggtcatttctcggtttcaccgagtgaggttgagagtctccttaggggcactgacggcaaagagcaccagaaggagctttctggccaagatgcagtttctgccgaaggtgatgacgaaaaattccaggacacctgtgagcataaactgaaggatgaccttcactggattccatcctttgacaaagggaaaaacctttccctggttgacatggagtttgataaagcattccaagggatgggtttggttggtgaggaaccacttgggttctcatcatctcgttacaatccaattgatgctaacaatgagaagaaaactgaggagccaactgtgcaaaatgtgaaccgtgtcattgattcatccaaggttgttgcatctagtgaacaaaacaaacctgatgattctgaatttccacacgaagcttcatggaagaagcaactcttatcactgtacaagaatgtgaggaaaagcaacaaattctggcccatcgttgttgctactgctttggtgggagtcacatgtttttggaggcgctggcagaagggcaagttgcagcatcagccggtcaaattgtatcccagcagcaatgagaaaattaaccaagctgtaggaccgttgaatcgcatcaaggacatccttgttgccaacaatcacccagctccagctatccatggacatgctcgattgagctgattatgctcaccaagtcccgccaacatgctcagtttatgagacatctcctgaatatgtacccacttgagtcatcatcatcagtgaagaatgaatgcactggggcatcatctactcaatactgaaaatcgtctgggtgtttatgcgttgaagttatgtaattgattcaaacccccccttggatttgtatttatgtgtttagtgtgattcatcttcttcctcttttgagagtactgctcctggtttgtcaattgcagtgccctttcaggttgctgcagaaaacttgtatatatatatatatatatgatcatttaggttgatgatgtttttggtctgtctgtgttgtgtgatcctgcttatattgtcaacacttacgtttgatttcccaagaacagtttagcagaagctgtaactcgatgagtcaggctttcagataccaaagctttgattacatcacatattgtagtattgtctgaagccactactgggtctctttttaaaactgtgctatattccattttgtattactagcatatcatgaataaatacataattaccccacttttacattgaagaagacaaaacaa

SEQ ID NO: 5 - DNA, 1383 bp, Glycine max
acactttttgtaagtgactgtggtgtgggtaacagcagaagaatgctccgttcaactccaattccggcaccgtacaattcggtgccagttctctctcgcgcccgcacgtgtcactctctagcacctgcacgtgccgttcattcccattcctctttcgtttcgcggctcgtgttcccacaattccggcaatacatcgtaaatgttcccggccgagtgtttgtcgcggcagccgcaaagaagcaacggcgcggcggcgctgaactcgctgtaacggacgacggtttcgacgatgacgaggagtacgacgacgacgatttttatgatgagtacgatgatgatgatgatgatgaagaagaagagtttgatgatgatgaagatgatgaggggatgctttcattggagaagatgaataaatggtttgagaagaagccgaggggttttggcgaagggaaagtttacgacacttcggttgaggataagctgctcgaggaaatgcgccagagtagaatagcgcaggctgagaacttgaagaagcttatgagcaacccagtaaaacatgcttccaatgaaagtgttcaaaagaagaaagatgcagaacttgttccaattggaggtcgagtgtgcttggtgaacctaccaaagaaaaagaacatccataaagatctgaaatcagctttgcaagggattcctggcataattaatatagtcccagctgttactggaaacaagaagacgagggacccaatctgcaagggttttgcatatgttgatttcaagcgtgaagaagatgcagttaggttcgtagagttatacactggacaaactattacttttggtaaaattcagaagcagataaaatgtgagcttctaaatgtacagtcttcatcttctctgaaattaagcaaaaaccttagtgctgctccgcaacttgtggccgctgcctttgaagaagattcaaatgaggattctaacttggatggttctgcccgtagttcctgggatgagaccaattcttcagatgatttggatgacctggactatcagatgaatggagaagaacaggaagatgatgaggataatcaagagtctgtcactgctttgggggtagatcatgatgataatgtggaaatgaggatcgatcctgaaaatatttcacttccctcagagcaggttgacagaaaccccgcagctgtgcagaagtcgtctgccaaggttaaacaggagaatgcccgtaagaaaaaaccaatttccaaagagaaaaccaaaaaagttttagatgttcctggatcctcaagaaggttaaagatcagggagaaagctgtattaagtgaggttttctccaagtacggattaaaagctacacttgcttcaaaagataattag

SEQ ID NO: 6 - DNA, 1067 bp, Solanum lycopersicum
cattcaccaccacttcactacggcgtcgttttagctgcccgtctctttaccattaatggagttttacatgattttgaataattttgtcagctaagcgttgacagttgagaagcagattcagtagttcatctgctcaccaacactgattaattcctcataaatacccttctttcttcaaatacccaattggtttttttttggtatttttttttatacttttcaaagttttaagctttttggagtccgtcaatggctggagttttatcagttctaagacgtatttacctcacactttacaattgggttgtcttttttggatggtttcaagttttttattttgctgtgaaaactctgaaagaatctgggcatgaacatgtctatgatgctgtagagaagcctttgcttttagctcaaaccgcggccattttagagatacttcatggtttagtgggtttggtaagatcgccagtatcagcaacgcttccacaaataagttcaagattatatgtaacctggggtattctatggagtttccctgagcttcggtctcatattcttgttagttctctagtgattagctggtctataacggagatcattcggtattcattttttgggacaaaagaggcatttggctctgcaccttcgtggctcttgtggctaaggtatagtaccttcttgttgctgtatcctagtggcatcacaagtgaagttggtttgatatatagcgctctgccttacatcaagggatcggatatgtattctcttaggatgccaaacaaatggaacttctctttcgattactactatgcaggacttgttgccctcggtatctatgtcccaggtagtcctcacatgtacggttacatgctcgggcagagaaagaaagctctctccaaatcgaaaaaggagtagactcaattgaaatgtagctgttggagattgcaattttaatcttaatcaatgtatttcacctgttcaatttgttctttactaatttagacaatggaacaatttgcatttctctgatggaaatcaagtggttgaatgaaaatttacttgcagtt

SEQ ID NO: 7 - DNA, 1425 bp, Oryza sativa
gtgcgcccaccctctcccttctcttgtctctccccttcttcgccctccctcgccatggaggccaccccgatctccgtcaagccgccgtctccggtggcggcggcgccaccgccgccgccggtgcaggtgccggtcccgccccctccgcccccgccgctaccaccggcggcggccgccgtggagcccctgcccccgcagccggtggccgtggtggtggcagaggcggagccctgtagcatgaaccagctggcgctcactcccacccccaagcggcagaaggtggaggagagcgcggatgggaacgggtgcaagcattgcgcctgcaagaagtcgagatgcttgaagctctattgcccatgctttgctggtggaggttattgttctgaaaagtgtggatgccaaccatgcttcaacaaggccttatatgcagaaacagttcagaccactcgcaaggtgcttctttcacggcagaaacggatgtcactgaaaattaatcgaagatctgaggcaaatgcggaagctgtggaagatgctcatcattcttcttcttcaactccgcctaggcgaggttgcaattgcaagaaatcaagttgcctaaagaaatactgtgattgctaccaggatgggactggttgctctttgttttgccgatgtgaggactgcaggaatcctttcgggaaaaatgaaggcataatggcagaagaaagtaagcgctttttatacactggcgcagacctggaccacagtgaggatgaacaagactttatcgtggaacgttcacctcgcctgcagtcaccaatctcaaaagagtcctccttccagcaaactcccccgcatatcagagccacgaacagagatacacacatgttcccgcaggcgatatcgcagtggcagccccgctcatggcattgctccaagaggcagagcaacgaccgggtgatcgacgactcaggggagtacaagaactcgaatcacgactggcagttggccaagccagaggacagctacagcatatcgagatgcgtccagatcctcaacggcatggccgagctatctcaggtggagaaatcggttgcccccgatgtgttcctccaggcggggaaccgggaaatattcatctcgcttaacggtgacgtccgggccctgtggctgaaacgcaagatccagaacctgacttagggcatgccatttgtcaccttagtgttgttttggaggctgagattggagacaccattggatcatcaatccatttaggctatgcatgtcctgctggtcggttgaaaatgtgcaggatcttaggctcttcttgtatactgagttgtatcccaaatttccgtcatcttttctttgtagagagctagcagcagatgcgaactttggtaaccggttataataataaatgagttatgcacctacagggtgtac

SEQ ID NO: 8 - DNA, 2860 bp, Hordeum vulgare
taatctggcagtgaagcttccacctgatgtcataaagccagatcttggtccaaagacttacattgcgtatggtgttgctcaggagttaggaattggtgattcggtcaccaagattcattgcgacatgtctgatgcggtcaatatcctaacacatactgatgaaataaagctcaaagcagaaaggattacagctattgagaaaaagaaagagagtttggccagaaaagatgacagaaatcttcaagcttcacaaatagatcctggccgtgacatgtcgatagctgaattaatcaaggtgccgagacctgaaggaattgaagatggctcagtcattaagcagccactatctgatgctcttctagatgagcgggatggggctcaccaagacgtgatagcagatgaagctgagggaaacttgactctgaatgggcgagtggccattgaaggtgaaggggttcacaaagatgtggtagctgatgaagctgagggaaacttgaccgtgaatgggcgatcatccattgaaggtgatgtggatcatacagatctttccatttctaaggagattgaagaaggcacagttaaggagagggagggtgagggtagtcctttcagccgtgaagataaaagtgcatctccagataatacagatgtaacatgtgaacctactggtcatcaaacacgacccagacgaagtgccactcgttattctaatttatcagagagaaaaaagaaaggaagcacagggagaaaaaagaaagagagaaaaaagaaaggaagcacagaagatgagatgtctgaacttcccatatatcttgagccaaaagacgatggtctcccatttgcagacgaaaatcaaccagagggtggtgcattgtgggatatattccgccgggaagacgccagtaaactgcatgagtatctaacaaagcattcggaggagtttaggcattacaactatgaatcagtaaagcaggttattcatcctatacatgaccagtgcttttacctaacaaatgagcacaagagaaagctgaaggaagaatatggagttgagccttggacatttgaacagaagcttggtgatgcagtctttattcctgcaggatgtccccaccaagtcagaaatttgaagtcatgtataaaggttgcacttgactttgtttctccggaaaatttacaagagtgtatcaggctgacagaagagtttcgtctgcttccaaaagggcatagagtgagtgaagataagctagaggttaagaagatagcttttcatgcaatcaagaaagccattcattatatcaagaaaaaacctgaggataaaagctctgatgacgaagttcaagataaacctgttccaagaaaaaggaaacctggtccgaaaaagggaaaacttggtcgtccgaaaaaagggaaaactggcccagttgaacctgcagaaccagaggagcacgaagaacaatcagctcaggaaatgtccccagttgaagatgaaggtgcagaaatggaggcggaccaggggcaatcggctctggacatgtgtgaagcgaaacctggcacaagtgtccggtgtggttcgagaaaaagaaaacctggtagtctgaaaaaaggagaacctggctgtgcgaaaaagggagacctggtcgttcaaaaaagggaaaacctggtccaaacgaacctgcagaaccagaggaacaagacgaaggtgcagaaatggaggtggaccaagggcaatcagctttggacatgtctgaagggaaagatcgagctgctgaaatggagcaacaagaagagtcagctctgggcatgtctgaacctaaagatgaacctacagaaatggaggagcaccaggaagagtcggctcagggcatgtctgaacctaaagatgaccctgcagaaatggaggagcaacaggaacggtcagctctggacatgactgaagccgaagacaaacctgcggagatagtggagcacctggaagagtcagctctggacatgactgaagctgaagacaaacctgcagagatgaaggagcaccaggaccggtcagctcaggacatgactgaagccaaagacaagcctgcagagatggaggttcaccaagaacagccagctctagatatgtctgtagatgaagacgggcttgcagaaatgaaggggcaccgaggacagtcagctcaggacatgcctgaagtcgaagatggagctgcagaactggacatgcctgaagctaaagttgaagctgccaaagacatgcctgaagtaaaaaatggagctgcaaaaatggaggacatgcctgaagctaaagttgaagctgccaaagaaggcgagccatcagaaacagaagagcgccacgagcaaccatctgatggcatctctgaagctaaagaagaaggtcctgcagtggcccaggaggctgaggctaccaccatgcctagaacggcatgaggggcaacgctttgcgcccgccgctctgtagagaccgtgttccacccgtatgaccatgactatatccgttgtagtagcattttgcgagagcgcatcgacgagagaccgtcgagctccctgacccccgaacttgccgctcagcaggtgttcgagcgcctgtagggcgggctggggaggggaaccggaggcgctccgtgagaaccttggttgtggagcgccgcttggtagttgtctatctgtgggctgtggaagactggatgaacagccataattattttggtggtgtttttagtagtgctgacagcagggttgctgtatacttaaccttgtaagctgggacttgcatatcaacctccagtgaccgtattaataaaaaaaaaaaaaaaaaaaacactgtcatgccgttacgtagcga

SEQ ID NO: 9 - DNA, 1182 bp, Triticum aestivum
gctccgctcgccgctggaagatggagcctgaccagagtggcaccgggcgaacttctccccgcgggagcgactgggaggtcgtgcagctcaccgcttcgaactatgcatctgcacctggtccgccgagaactgagccttcggacgaggaggctgaaggccaggtgtatggcgcagaggggggtgattcggcagccgcggcactgctgatgtctggtcatttctcggtgccacagaatgagcctgagagtctccttgtggaaactgatactagcatagagcggcaggaggcgcgcggcagccagtatgcagtttctgacaagggtgaagatggtatgtacgaagaccagcaggagaaactgaaggacgatggtcttgaccggatcccgtccttcgacaaaggaaaaagcctttcctctgttgatatggagcctgacaatgggaacgcgttgcacggtgttagtcaggctggggaagaaccagtcacattctcatcatctggttacagtgcaacggacgccgagaaagaagctaccgagagtgccattgagaagaccgaagaaaaaccaccgctccaaaatatcgaccctgtcactgattcgtccaatgttgttgcttccggtgaggagagcaagcctgacggttctggagccccacgcaacgcgtggtggcagaagcaacttatatcgctgtacaggagcgctaaggagagcaacaagctctggcctatcgttgtggctgctgccgctttgatggggatggcgtatttccgccggcgctggcagaagggcaagctccagcttcagcaggtcaaattgcaacctgccagcagcaaggagagaatcaaccaggccaccgtaccgcttaaccgaatcaaggacattcttgtcgctggcaaccatccgagtccggctactcacggaaatgctcgattgggctgatgatgataaccatcccgccgatggatgatgtatcctgaaactagtgtatgcaatggagaaatacccgatgccgcagaacgtatgggcgtttatgcgtgctggctgtgtaattaaaccccaaaactcctcctgggcatgtaaatacacacgagttttgtgtggttgctttccctcctttggaaaaagtccctccttggccaggttcagtgtgctgctgcttcagtttgttagccactgtaacttc

SEQ ID NO: 10 - DNA, 1433 bp, Zea mays
cacacggatggaattggcgcgggcggcgggctggcagttgcgcagcaataactcccgctgcccaccggctcacctgtccttcatccgccccgatccgaccccaaatcaattccaaattcaatccggtctcagtggttggcccgccgctgccagtgccagatcgaatcggactctcggctcgtgtgcagcccaccggcgagacgccgaagctatatttttatgcccatctgatccgatgcgtggtgtggcgtcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctacgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctttctttggaacgaaggaggcatttggctttgcgccttcctggttattatggcttaggtacagcacctttatgttgttgtatcctactggtatctctagtgaagttggtctgatctacattgccttgccttacatgaaggcatcggagaaatactgtattaggatgcccaacaaatggaacttctcatacgattacttctattcatctgtccttgccctcctgatctatgttccaggaagcccacacatgtaccgttacatgctctcccagaggaagaaggcgctatcaaaggccaaagcggcatgatgatgccaagcaagggaatcggtggactggtttgcgtgatggatgccggaacatgttcaagttttcgacatcccctgtagaatctagtggtcgggggatatatattactagaatggggctcttcatatgaactgccccgtatgcgtaatgtgttgtaccggagtcatcatttcagatatcagctgttgcgtggttaaatcgtagtttgcttccggatcacccatcagttggggggtggattaccatgttgattatataaggcaatgcgttccgcatccttccctcaactggtgctgtgctctcttgtttctagcgtacgatgaatgatggattttatcccgggcctggaacattttgcatgctctagcttcatgttgattattatatagcaaaattagc

SEQ ID NO: 11 - DNA, 2490 bp, Zea mays
cgtatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagagtggtgctgtgcccatctttgtcaagctactcaactccctcagcgaggatgttcgtgaacaggctgtatgggctttaggtaatgttgctggtgactccccaaagtgccgtgatctggtacttggtcatggtgggctataccctttgctgcagcagcttaatgagcatgctaagctttcgatgcttaggaatgctacatggactctctccaacttctgtcgggggaagccacaaccaaactttgatcaggtcaaaccagcattgccagcactacagcaccttattcactctcaggatgaggaggtcctaactgatgcctgctgggcgctctcatacttgtctgatgggactaatgataaaatccaagctgttattgaatctggcgtgttccctcgccttgtggaacttctgatgcatccttcggcctctgtactcattccagctcttcgcacggtgggtaacattgtaactggggatgacatgcagactcagtgtgtcattgacaatcaagcacttccatgccttttgaatcttctgactaccaaccacaagaaaagcatcaagaaagaagcatgctggacgatctcaaacatcacagctggtaacaaggagcagattcaggctgtgatcaatgcaaatataattgcacctctggtgcaactcctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgagaacatcctgaaggttggcgaggcagagaaaaaccttggtgcaggtgatgtcaatgtctatgcacagatgattgatgatgctgagggcctggacaagattgagaacctgcagagccatgacaacaccgagatatatgagaaggctgtgaagatgctggaatcctactggctggaggaggaagatgatgccatgccctcaggcgacaatccccagaatggcttcaactttgggaaccagccctctgttccatcaggtggattcaactttggctgaagatgcccatttggaatggccgctgtgccattatgccttggctagtgctctgggctagtcagaggtgtggggtagcggcgtcaaccaagtcatggttgagtcccattggtctggtctcagggagttgtcatgtcagtcccagtcagcagggtcagtccttgggctgcattaccagtggtgcagcttggtcggtggtcagtcttgaaggtcagccggttggatcatttgggctcttgctcccaccagcaccacctctggtgggaggcatcaggcatggagtcgcgggtgttgtcgggagttgggttttgcctcctatacagcataaatgaattatattgttttacctgttggtagaaagaaccttgaaagatagggaacgtgtcgttttttgtcaaagcggttcctgtgctgtataacatgttgcatgagtattggcgcaacttataagacaatgtcaaatgggtttttgggagtcccattctggtttcttgagtcttcttcattggtgtctattgtgtaacatgtacacaggtttgtggttcgtcacgtcttgtcttgtctgttgtatttgccaccgttgtctggaagttgttgcgtgcttatctagaacagcagtataccagggttaattctctgacatttatggttcctaacttggtgggatcagattaaaaagttgtatggccatgacggtatcaaagaaataattccgtgcatttttgctccgttttatctgtatcg

SEQ ID NO: 12 - DNA, 895 bp, Zea mays
accccacttccttccacagccggaaaagagaaagcaggagcaccaattcggcgcatagccaagccaaggaaatggcgcactaccaccccgtgtccgcggacacttaccaagacctcgaggctggcttctccggccactcctcctcccctctgaagcccgcggcctcgccgaggcggcccggccgcatgttctgcgacccctgcgacgacggcgacgagctccacggccgccaccactacctcgacatctgcttccggtgccgtaaactcctgtccggcaacagagacatcttcatgtacagaggtgacctgccgttctgcagcgaggagtgccggcaggagcagatcgagatcgacgaggcgagggagcagcggctgaagcagacggggcgggccgagcagcagcggcagcggcagcagaagcagagcccccagaggatccccatctgggcgtggtaggatgagaaaaattttgggcgccgggaaaacgaacgaacgaacgtagtaggatttagctgcacctcaagaagaaccccccaagcaagggcgacgcgctgcgtgtggaaacaaacgcccgtggatcaccgccggctcgacgcaggaggaggaaggccacgcgccacggcacaggccggcagggcagggcagagagcccatccaaccggctgctgcgtctttttaccttcgtttgttgacgaaaccgaatggcctccctcctcctgatctccgaaagatggagacggaggggttggtttgtgcgtgagtttttgcacggttgcacgagtgaaatggtgtgcgtgctgatcgccgtgtaaaccctgtcgatacggtatgaaacaagcgagaggcctaaacaagtccctctcgaatttctcgtcagttcagctgtcctccgc

SEQ ID NO: 13 - DNA, 2968 bp, Solanum lycopersicum
gggttctgtatatttatctaattcatcccattcttcttttctttatagtatttatagtacaagtacactatttcagtaaacttcgcttcatttagttcagtttagttttagtttaggtttattctgtaaaataaaattcaataaaaaaaaaatagaaataagaattcattcgaaatactaaataagaataaggagtctttatgtcgcgttaccgaggacctcgtttcaaaaaaatacgacgcctgggggctttaccaggactaactaataaaaagcctaggaccggaagtgatcttagaaaccaatcgcgttccggtaaaaaatctcaatatcgtattcgtctagaagaaaaacaaaaattgcgttttcattatggtcttacagaacgacaattacttaaatacgttcgtatcgccagaaaagccaaggggtcaacaggtcaagttttactacaattacttgaaatgcgtttggataacatcctttttcgattgggtatggcttccactattcccgcagcccgtcaattagttaaccatcgacatattttagttaatggtcatatagtagatataccgagttatcgctgcaaaccccgagatattattacggcaaaggatgaacaaaaatccagagctctgattcaaatttctctcgattcatcccctcatgaggaattaccaaatcatttgacccttcagccattccaatataaaggattagtcaatcaaataatagatagtaaatgggtcggtttgaaaataaatgaattgctagtcgtagaatattattctcgtcagacttaaacctcagacttaaaccaagggttcgcaaaaatttcttccctttaggcgaagtaaattaacccaaggttaagtaagttaagtaagatcaatccgagtttgatctagatttcccccatttttgtatcatagaccaaggatctattttcattccttgtctattcttttctttccagtattttgattatgattatttttgagtattctattttacgcgtcacagcaattaggaattgagaatctatatctttagatcaaagaagggtctagctgttggaataatggtatacaatgctatttgagtccttgttgttagtaaaattggtgaattaagcgaaggtacggaaagagagggattcgaaccctcggtaaacaaaagcctacatagcagttccaatgctacgccttgaaccactcggccatctctcctacataatgattatgaccccaaaaccgagtgaatagcgagtcagtcataatccatattccattattggataggtacgaccaatccattttaactgaaaatttgtcatcaaagtcaaagcaaagaacggtttttctttccttcgaggctccgggataaagatacaatttttacgaaaaattgttcaaaaaaattcaattcatgtttgcaaaaacaacgttcccttctttttctgatatttttctatttttataacggattaattcaatgaattagaacgaatcaactgattgatggtctatatcttttagactatagttaatggatactcttaaatcataactgtaattataattatatagactatgattccataccagaaaattttttttaattccttttcggttttggagttctcaacaacaaatacctacccctctattagaatagaaattcatcaaaaatttagattcgattgtatagtgtatacccgttatgtacacaaaattggcagttattctattttcatcatagaatgattagtcgatcttttttcttctttgtaatttgtatcatgattcaatcaaaatttctcgagttcttctaatttgtaacttcaccgaaatcggaatagttcctatattactacattagtatgaaatcgaatcgcgttgaaatatttcttatttcttatttcttctcgattcctgtcaaaaaggaacaattggaatagaggattcatatcttttgtttttttgttaaaaaaaagaagtttttatgttatttcgtactatacaattcttttctttgtgggatctttttcccacgagaggtaatgaaaagaattctagaatggattgctacctatgcctagatcacggataaatggaaattttattgataagaccttttcaattgtagccgatatcttattacgagtaattccgacaacttccggagaaaaagaggcatttacctattacagagatggtgcgatttgattcttttttttttttgattttatatttattcatttttctcagtcttacgaggagaaaaacacatgattcgagaaaaaaaatctacgctttttgaaggtgaagtttggaaatagaacaattccttctgtcgtgtatcctcgattaatgcaacctcagatgctatgtttcaattatagattctagtattaagcgaaaggttacgcctagaggttctgtattacgggtcaatcctactctactagcgctaataggcagcataggggaagaagcgctacacctaggaatcaacaacacgaaaactttgttctaagtcagcccttttcttagcgggcttgggactaaaagaatggttgggacaacaaacatccatctcgttcgtcctttggatacccgtataaccatcgaaggctattgaagtgactaattcctggaaattaggaggcgttaaaaacaaaaaaattgtgggagttatcttatcatttctatctagtcccaataggcttgatgttaagaaagaatctcttgcaggaaggttggctagagatttcttgtaaaaacactagccctgctgagttcataatgagaatattttcatcgttgaatcttttttgattctatgtattattctcattatgcacataagggaggagccgtatgaggtgaaaatctcacgtacggttctggaacggagattctttcaattgaatgacgaccgtaacggatgtcggctcaatccg

SEQ ID NO: 14 - DNA, 1396 bp, Sorghum bicolor
ccaccacccgcgcccgcacccaaaataacctctcgcggatttttcctttcgccaaatccagcctccacacgcggagaaaattgcgaagcggaaccgacagagagaaagatagagagagagagagagagagagagagaggagggaggggagggagaaggcgagagaagatgcgctgcgccgccgccgcgcttgcggtcgccctcatcgctgccgtcgccggcgcagccgccgcggggtcgccggccgcgggcacgtgcgcgcggaggggcgcgccgccgttcctcgacgccgtcggatcccgctgccccttcgtccggatcgagccgtccccgcctctcgaggtgagaggagaggctgttgatactgagttgaaccttcgaaggaggggtgcttcatacttcattctcttttatgctgcatggtgtccattttcgagcaaattccaaccaacatttgaagctcttagcacgatgtaccctcagatacatcactttgctgttgaagaatcttctgctacaccaagtttgttttcaagatatggagtccgtggtttcccagccattctttttgtaaatgagactacgatggttcgatatcggggttcaaaagatcttaactctctggtcaatttctataaagagactacaggtctcgatccaattgcatatattgatgttgtccaccaagagagcacaggaagcttgagctcagttatgccatgggatcgttctctgcgtgaatttgccaaagatgagccatatttgttagctgcagttctttttatcatcctgaaggttgcagcgcacttcatacctgttgtcatgtctcatctgagagctttcttagttgtccgtgtccaaaacttgaacctagggatccgtaggggatcaaaccagctcttggaacgagcattgaatgttcttgatatgaggaggctttggagcaagctgagactgagcaacaaggcaacggacttgaggaagggagcaagtaatgcacgagcttgggcttcctcatttgcttctgtttcactgggtgaaccatcatcttcgagacaagcgtagccattttggagatgtttgttagggtagctgctcacatggtgcaaaactatttaatctttgcttcccatcctgctatgtagcactgtttctgtgcagtcaggaaggggagaaaccttacaggcatgtaaattttgaggacatcatgtgctgttgtatattaggattacctttgcatttgctaatgcaacccctaatcttcctgtccattaactagagttatttggccatgtatcatgaacatctttgtaggttttttaggatttctctccgtttgtggtgatgtattggtagtttacactgtaatctccattaaagaacttgttgtatggctg

SEQ ID NO: 15 - DNA, 917 bp, Oryza sativa
ctctctctcggcttcttcctccttgcgcgcagcctcgattctcgacttttcttgctgtggggagaagaatcgcgattgcgcgaggggatttcttgctgctcggagatgccgcggattccgctgatcaagttccccaagaggaatctcaagatcccatccccacccccaccagcggcgcaacctgcagatcagcacgcgtccctcttgtcccgattgggagttaaatcagaggcaccatcttcttccggggagattaaaaattaccgctttagatcagatgtgccttccccaccttcttatacggctgttggagggccagcttcactccttcctaaacgcaagccactgtcagaggaagaaattgaggctatcatgcaaggtggtatctactgatattgcatccgatgaataagataccaaaccttttaaatggggtcactagagccatgtcgatatggaccttttcgttgtactccctttttggtgtcaggaagcagctgccctgatactcctttttttgagtattgccaaaatgaccaattcgtgaaaactgaacatgcaatgcatcggttgtttgccaaaatacattgatcatggagttatgccatgcaactcaactaattgtcttattccattgctccaaatgttctgagacatttgtgctcatccatgctgcttcagcaattaatgctttcatcaaaatatcgtgtatctgccagttggacgaaatgatgctcctatattaacgatagataatttataagcacacaaaatagtcattaattagacaggctttgatgtgcttctctttttcgctggtgggggccttcgctgtcccagtgccgtgtaagtaagtaatcccatgtgatggacatatgaatagctctcattaatagttctgataattctttgtttgc

SEQ ID NO: 16 - DNA, 1368 bp, Hordeum vulgare
gccggcctgaacacaaaaacgaaatgccactgctacagctacagctgccgaccgcgtgctgcgccgccgcggcgtcggcccccttctcgttctcgcggccgccgccctcccggctgcgcgcgtcgcacgtcatcttcgccttccctcgcctgaggaaatacggccgccggagccgcgagccggtgcccaccaccctcgacgacgacgaggacgaggaggcggatgaggacgacgacgacggcgtggaggaggcggttgacgaggacatctttctcaagaaccggcccaagccggccggtttcggcgtggggaagacttacaccaccgacgttgaagagcagcttctccgggagatgggcctcggcggcgccgggcgcaagagcaaatcggctccgcccaagagcgtcaaaaccaacggctcggccacagaaaccagcgcagatgtcagtgatgatggcgttcatgttcgtatttggaacctcccgaaaaagaagaacatacataaggacctgaacctggctttcaaagggtttcctggcttggtaactataaacccagcaaactctggaactaagaagacccgtgatcctatttgcaagggttttgcatttgtcaaactggagtcagtggacgctgcaacgaggttcgttgaactgtattctcgtaaagctgtgtcgtttggcaaggttgagaagccaatcaagtgctgtattgttgaagggcacgcctctacggatccttcaggtccagcatccagtagtcaggcaccagggtcgaacccccaacggttggtagccgtaagatgagtggcacagttaatctgtcatcgatccagttgccactcggtacttcgacagatggagaattccgggaagaaggttcgctacatagatattggcatgcttcgctcaagattgcgaggatacagaccgtttgatcggaattcccgattttgtagatgatatcaagcattgacattagcaggaaaccctttctccaatgggtttatttagaagataggcagggattagactcagtttttcaaggtatgcggtggttttagttaaatttacgtgcccatatgaagagattgtgtctgaattaggtcctactgtttcggaggaggatttgaatctgaatctgcgacgtttaaaccccgagattaaagctgcttcaaagatgattgtgataccatgtcccggtgatagatgggttgtggggtaaaaacgttgagctgttttatcaatcaagtatgtgttgctgaaaatcgcccaagtagagcatggcgatgtgcgttgtacctaaattgtttatgggtgttttcgaaggaccaacgaggaagcgcaccaaggcactagccaagaggcc

SEQ ID NO: 17 - DNA, 1453 bp, Arabidopsis thaliana
gtgctccagaatttgtaagatcgggtggtgctatttaaatccaatatcagaaacacgtcgaacgagaccaatagagctagcttctgatacatttcgactttggcgtttctcgatctgttgtttctgctcccaaataaaaataaaaaaaaatcggatcggggatttccccaaatcgtaaaattaggttttgttcttcatttctagccctagcttagttttatcgttatcttattcattaaggtttgattctacctttgtttcgcttccctcctcgaattttgcaattccgttattaaaggatcctagtttttctggctcttgtactacgtcaagtttcatggattctcgagtttcgattctcttcgtctgtgcaatagccgtgtcatgctttacgtctgggtctgcttcatcaccagtggacttttccgtttgcaattacgaattcgagctgtttcgattcgatttagaggccaaatgtcctccttctctgtatccaactcctcctattgaggtagatggagactcactagacaggctaatggcttcacaacatggaaatgcttatatgtctgtactcttttatgcttcctggtgcccattctcacgtgctgtgcgccctaagtttgatatgttgagttccatgtttcctcaaatacaacacctagctgtggagcattctcaagcactgccatctgtcttttctaggtatggtatccatagcttaccttcaatcctgatggtaaatcaaactttaaatgctcggtaccatggtcgaaaggatcttatatccctgattgagttttatgaagaggcaacaggcctccaacctgtccagtatgtggctgaaggggaaccaacaggcttaaatgccggtgatggtaacttgatcacatggttgcgcaaggggacatctattagagaaatattcaaacaagatccgttcttggtactatctctgctgtttatctgtttacaaatggcaatccttgtcttccccatagctgaatcccgcatgagagcgttatgggcttcttacgttgccaatttgaacttgggaagatttggagagataagccaactgttcaaccgtggtattcacatggtcgatgtgaggaggttatggttgaaactaagtctcgtcaaaacaagaaacttccatgaaagggcaaagaacgcacaagcttgggcttcatcgctggcatctgtctctctaggccaaacttcatcagaccaatcctgatctcaagggtaagatcatgtcagtattgggaagagatgagcttttaagtgtgtgctggaaatctgagagttcctttaatgaatgttatatgacttatttgagtttgatttgtctgcaacgaagcatgtaaatccaggaacagctttgcttctgtttgtgaatatctttctcccttttttgttctataaatttgagatgtctgtttttggcctc

SEQ ID NO: 18 - DNA, 4027 bp, Zea mays
ctctgcccccgccgtacgccccacgccctcctccccgcgaggagccaccagcccaccatctacgccgcctgttctgatgccgccgcccacgcgaggccgaggccgaggccgtggccgcggccgcgggcgcgggcgcggtcgcggtcgcgggaggccaagtaaggacaccgttgctgaggactccgcgcacgccaccgaggaaagtggcgaggaaaacctccaggagaaggtgcaggaaggtggcaaggtaaacctcacggagaaggtgcaggaaggtggcgaggaaaacctcacggagaaggtgcaggaaggtggcgaggaaaacctcacggaaaaggagaatgaagggatagtggaggtctcaaaacccccccaaaggcgtcggaaggatcctgttgcagacccctcttctcttgagtctagtggtttcatgcgatttcgggagaggaggaatgcttcagcggttcaggagcaggggcctaagaagagaaggattactgaggattcaaacatgtgccatcagtgccagaggaatgatagcggaagagttgtacggtgccaaggctgtgtcgtccgaaaaagaaaatacagatattgtgtgaagtgcattaaacgctggtatccacatttatcagaggatgattttgcgaacaattgcccagtttgtcaaaataattgcaattgtaaggcttgtctgcggggagacataacccgagccaactcgaggaaaaaaaagaatgtgtctgaacaagataaaattaaattctcaatgcgtatcgtgcactttttgcttccttggctgaaacaattccatcaagagcagatgcaagagaaaagtgccgaggctgcaactaaaggtattgatgcagacaaactggaggtccctctaaccatttgtggaaaaaaggaacgtatatactgcaacaactgcaggacatctattgttgacttccacagaacctgcaataaatgtaactatgatctctgtctccagtgctgccaggagcttcgtcgaggccttgtttctggtaatgatgccaaggttgatggtggaggcaagcaagattttctatcgggagttagtcatgataaaatcataagcaaagggccatccgatggacagaatgacatgttgatagatagtgtagttcctggtgaaaacaacacttctagcttgagacagtggagtgtgaataaagatggaaccataccttgcccaccaaatgcatttggtggttgtgggagctctcttcttgaactgaagtgcttgtttaaagagaagtttattgctgaattactggagaaagctaattcagcgctcaataatgaaatggaggtgaagatagaaggatcaaaatgtccctgcttcactgaatccggtgacatggatgatggtatatcacggaaatcatcttgcagggagaattcctgtgataactacatatattgcccaaccgctacagatgtccaaaatggaagtttagaccatttccaggagcattggttgaagggtgaacctgtaattgtccgtgatacacttgcgttgacttctggattaagctgggaaccgatggttatgtggcgtgccttacgagaaaagaaagagaaagttgagaggctctcagttcttgctcttgaatgcttgggttggtgtgaggtcgatgtaaatattcatatgttttttgcggggtattcaagtgggcttgttggtccagacgatttgcccctgttgcttaagcttaaagattggccaccacatagttcttttgaggagcggctcccaaggcatggtgcagagtttatgtctgcattgccatttcgtgaatacactgatcctaaatggggacctcttaatctggcagtaaagcttcccgataatgttaataagccagaccttggtccaaagacttatattgcatacggtgtttccaaagagttgggaattggtgattctgtcaccaagcttcactgtgatatgtctgatgcggtcaatatcctcacacatactgatgaaataaaactcaaagcaaaaaggattgccgcggtggaaaagaagaagcggtgtttaggaatgaagattctatctaccaaggaagcaagtggaggccttcaacggtgtgcagattattttggtatgccaacagctcccagtgaatctaacaaggagccaaggcctgaagagtgtgtaaatgaactgggcattaaacaaccagtacagcatgttgcttccgaggagcaggaaggagttcaagatgatgccaaggcagatgcaaatgttatgaatgtttcttttggtaagggaaaatcagaagattcttttggcacaattaatggtaccaacagtggagataaaatagaatctcctagtggtttagcagaaagaacattgactcagcctaccactaagggttgcagtaagcagcgtggccgtagttctaatggtagaggaaacaggactaaaaaaatagaagaggggaatgcgtctggactaattgctgtggctcccgagtcagaagatgatgatgatgccccatttatagatggaaaccaagcagagggtggtgcactgtgggatatttttcgacgggaagatgtgagcaaactgcatgattatctaatgaagcatgctgatgagtttagacattgcaactttgagccagtgaagcaggttactcatcctatacatgatcagtgtttttatctaacaattgagcacaagagaaagcttaaggaagaatatggagtcgagccttggacatttgaacagaagctaggtgaggcagtatttatcccggcaggatgtccccaccaggttagaaatttgaagtcttgcataaaggttgcactagattttgtttctccggaaaatgtccgagagtgcatcaggttaacagaaggtttccgtctgctgccgaagtggcataaggtgaatgaagataaactcgaggttaagaagatagctcttcatgcattcaatcaagctattaaagatatcactgatgaatcatctaatagcaatgaaagcaaatggatccggagatagtgaggatcatgaaggccattgaatccatgcttgatgtcatggaagttagaacaacctgcattcgacatcttgctatcgagaacctgaatgaaaaccgtagtggcttatcggatgccgacaagataacaaaacctgattttagtgtattatgcatgatattagtaccttatataatacgtagcttggagaaaaggccattcaccgtttctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaaggatatggaaatggagaaagagcgcatgtatgcatgtgtaggtcagggagtggctcggatcagccttgagtcaatttccactgcgttttcttcggttatggatgagcacgaggagtaaaagaaacagaagaaggctgagtgtgattctcatatgcttattttcttgtcctgtgtaatggatgtgtgtatgtgaaccatatgcgaacttaaacgtctttgtttgtaccggtcaggccattctgagtgagggttccgtctcttctttttaggactccactgcgaggtgtcggtgtgtgagaaatggtgcaaacgtgtgtatgaaactctacgaggcatactcttatctagtattgtgtctagtgaagaatgggacacatccgatgctactgtaaactcacttgttgcactcactttttgagttggatttttctttcaaacttttttgtatgctctcttgagtttatctaacactagatttcataagtgtgcaccattgtccataactagactcacttaggtaaagctatccattccatgtcctctttataatgtgacataaataaggattttatcact

SEQ ID NO: 19 - DNA, 1728 bp, Arabidopsis thaliana
gtcgacgacaaaactctacacatgtccattaacgtctggatttcgattgtcaagaagttttgtaaaacgcaaactccgataatctttctctaatctccgatcgtgttttcttagtgagatggcggaagagaaggtaaaagatgaagctatgcaaataatgggaatgtttcaaattcttccgagacttgtcgtctttgatctcgattatactctctggcctttctactgtgagtgccgttcgaaacgagaaatgccatctatgtatccacaagcaaagggtatattgagtgctttgaaagagaagggtatcgaaatggctattgcttcgagatctcctacttcagatattgctaacacatttcttgataaattgaacattaagcccatgtttgtggccaaggaaatatactcaagttggagtcataagacggaacattttcagaagatacacacaagaacgggagtgccgtttaccgcgatgctcttcttcgatgatgaagaccgaaacattaaatcagtttcgaaaatgggagtgacaagcatccttgttggtgatggggttacgcttggagcatttagacaagggcttactgaatttactcaaaatcataatagtatcgagaagaataaacaggtttggcgtgacaagtattctggaaagcctacatcatcggagacagacaaagattaacattcatttgtgagagttatgatccattggtggacacaaaacattctcgagtgttgtatcaccatttttaactacaagtaatttactcggatatgttaagatttgtattgaacaagaaagattaatctagactaaaaacatgctcttctcgagaaaatgcagaaaacattggattgacttctattttttttttgttaacaaacacacttcaaattggtttttctctctcttctctctctcgcatatttgagagagagaaaccgtttgatgttctgccgtccggtagaaatccggtttattttcgacatccatcggctctttcatcgttggttggttggctttgtgtctagcattgtccgtatcttttgcggtgatgactagctttcttccggcataggtggctccgattagcacctttggccagctctatttctggcataggtggcttcgattagcacctatgactggctctgcttccgtattctcggtttcgagattgtccggctctatctccgatgattccacttctctccgatggtgtttggtccatatttttcttcttccttgtctcttttgtttcaatttgctttggtttgctttgctttgaattttttttacctctttcttttgatctgagattgttattcattagcctctcttgtataagggactgatttcgatctttatgcttaccggattttatttttgaagatcgacttgcggtactggtttgatgtgtttctttgtgcctttggtttgaggatgaagaaattggaactggcacttttcttttgccaaggttaattggagtgatggacattttagtttttaggttctaacggtgatgcctctaagttcatttttgagatgtctcgatgaaagattttgttggagaatcgaagaggaagttcttcttggagtcttaaacccttgcattaagaacaagatcaacttaccagtgataaatttatcattacattgtctcatgtacgttcttgtttttcgtaacaaataaagctatgaaaagtaaaattagg

SEQ ID NO: 20 - DNA, 2272 bp, Pennisetum glaucum
gccctcctcgctgccgccgctcttctccccggcactgccgtcgccgagggcgtcacgccctccgaagcgcgccggctccgcgacgagggattgactcataccaacaggagtgactttctgcgctttgggattgcatatttgcataagaacaagctagccttgttgttgatgccctagtttatggcaagtttattttcttaaacactggctcaaaaaatggtatctttcatgtaggtgaaagatatgttctatcatgcatttgatgggtacatgaagtatgctttcccactcgatgagccgcgacccttaagttgccaaggtgaagactcccttggtggttatgcacttactcttatcgactctttggataccttggctttactgggtgataaggagaaatttggggctgctgtggagtgggttaataaaaccgtctctgtttttgaaaccaacatacgtatccttgggggtctgttgtcagctcacctgattgccagtgactatgctactggtatgagaatccaatcttacgatgaccagttacttaatttagctgctgacttagctcagaggttgttgcctgcatttgacactcctacaggtattccatttggatctgtcaatttaaagtatggagttgatgaaaatgaaagcaagataacatcaactgctggtggtggtactttgacactggaatttggcatattgagtcgcttcactaataatactgtttttgaccgagttacaaaaaattcagtgcgtggaatatggtcacgcagatcaaaactcaaccttgttggtgcccatataaatgtctttactggtgaatggacacagaaggatgctggaattggcacaagcattgattctttctatgaataccttctaaaggcatatttattgttcggggacgaagagtacctgtatatatttcaggaggcttacaaggctgtcatgcactatctccatcatgatccttggtatgtggaggtaaatatgaattctggtgctactgtttggccactattcaatagcctgcaggcattctggccaggacttcaggttttagccggagatgttgatcctgctattcgaacgcatgctgccttcttcagtgtctggaaaaagtatggtttcacccctgaaggttttaatctcgctacatcctctgtccagaatggacaaaggagctatccgctacggccagagttgattgaaagcacatattggctgttcaaggctaccagagattatagataccttgatgttggaagggacatattagcaagtcttcaatatggtgctagatgtccttgtggctactgccacatatcagatgtggaaacacacaagcaggatgatcacatggagagttttttccttgcagaaacagttaaatatctctggcttctctttgatttagccgcgggccctgataacattgttgaaaatggaccatataagtacatatttagtacagaaggtcatttgctacccattactcctgagatagccttggtagatgaacattgttcgtattttggagcattctgtaatggcagtgcagaccatggatatggtacaagtgctagttctatgaaacataaaaaagcaaactatactcatttagatgatatcgaaaccgcttccagtcactattcagcatccaacatgtttgcaacaagaggttacatcaagggagtttgtccaggattgactcatgcacagaaacttgggatatcatactctgatgaagagggtagcgatatagagcagacttctgatggtcatgagcatcatgatgaatctacaatagaatctagcgcccaagcccaatcgagtaatattatacttatatctcacccagtggcaagccaacaggatcaggctttggagagcaggtctggacatggagatcatgctgatattgtggtaactgctgattctgattctgattctgtttctgattccatgagccatgataataatgatggttcactcggtgcgaacactgagcaacttattgaggacaccaagcggacctccaaacattcagaagatgaagatattgctcagaatttgaagttggaggatatcagctgacctttagttcatatagggaccaatttttgtacttatctgcagaatcttcaggatggaagcttgctcaatgcagaacaagttagtaagcaggcaatgttagagcctggtggatgctgcgatagtatctggctcgttgactagttgagatgagctgatgaggtcgtggggc

SEQ ID NO: 21 - DNA, 951 bp, Solanum lycopersicum
gccaaatcaaacagccaaacgcggcactaagaaatactctccaatcttcttcttcttctctctcaactgtaaaacaacaaaaaatggcggcttctgcacggcgatcaaccggaccggtgctccgttcattatctcccgccggcagattttactcatcgtcatctagaacttcgtcgtcttctgcttcatcgatccggtttacactggaccgtgaaacttccccaagccggtctatttccgtaatgaaccggcagaaaacactggcttcttctcagaagaagaggtgtatgtgttcgccgacgaatcatccaggttcgttccgttgtagtatgcataagaaaatggatattcgacggagtagtagtactagccaaacggcgtcgaattcgattcgattgcatatgaggcgatcggcgatgacgaattcgttagtgcgaatcggaactgttgaaggtgagcttgttaaaagagctttagcggctttgattcgtccttcttcgcatcaacagcgtcgccgttccgatttccaacgccgacctagtcgactttccgttatttccagttccggtgactcataagtcagttattctttctctagaaatttcattcaacaacgcgtgctgcgccgattcttagcgcagatctggccggatctccattgtttccggtgccggtgatacgtaggacgtgaatagagctgttagaagtttgcttttctgttgaatgctgacctcagcaatcgatgtctggccgtgaagtaacgtcagctgcaacgaggtggcggcggcgaactggagtgtacacggtggaggtcggaacggaacaacttttttgtgtactccggtgaccaaaacgttaggatccatatgtctaatagtctaaaatacatgaagaaaattataaaatcattcagttctcctaattatgaatgcgtcagtcagattctaatta

SEQ ID NO: 22 - DNA, 714 bp, Zea mays
aaagtgacccacctcaccaaccatcactcacccagtcaccctccataactcttctcctcctctctcccagtctcactcccctcacttcgtgcatggtcttcagagtagtagagagagcaggaggaggagcacgagagaggagcagcgaagaagaagaagaagagcagcaggcagcttccgatgtgctgctacgtgggcaaggccaccaagatcttcctgtgcctcgtggcggcgctcctggtcgcgggcctcgtcctcggcttcggcctggcccgccacacgtggagagccgaaaggacccggcagcaaccggactgccgctggcccgactgccagcagcagcaccagggcggcgaccccccgctcgtcccggatgccgtcaccacgcagcccaacccgctcacgcagccggccgtcgccgcgttccccggtgccaccgccaccccgtcgccgtccgccgccgtcgccgcgccgcccacgggcgtgccgtactttggaccacctggcccgttcgtcgtgggcctcggcccagctgctcatgcgtgaggggggctgtctttttcttttttttctttacttttgctcgtagtcctctcccttctggaatcagtgcttcagtattgtttattattactgtatcattttttatatgtttcgctagtttttgacccgtttcgctgtacagtttggtaaattaatccggttctccccctc

SEQ ID NO: 23 - DNA, 860 bp, Oryza sativa
actaacgaacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgctctctgctgcgagtgcggctgcggcgttgcatcgcatgctctttgtgaattgtgggtgagagagcggtggccggacgagctcgccggagaggaggaagaagaagaagacgacgagcttagctttgcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcgacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttctgcattttaagctggtctagccttctgtgccgttgatgatcattttggttggatataaataacgattttgattc

SEQ ID NO: 24 - DNA, 4038 bp, Sorghum bicolor
cccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcgcccttaaagtcgacactggtgaagacactgaagcagcagctgcagggagagaagcaccgggcgccatggcggagacggcgctgggcatggccaccacactggtgggcagcgcgctccgcgtcgcctcatcagcagcaaaggaggaggatgagcctgctgcttggggtgcacgaccacatctggttcattagcgatgagctaaagatgatgcaagccttcctcagagcagctgatggagcacgtgagaacattggggtgttgaaggcgtattcggagctgatccgtgatttggcctatgacattgaagatagcctagaggagttcatggtgtttatcaagaacaagagccttgtgaaacaacttctcagcttacgtgagcgtcatcgcattgctgtccagatacgcactctcaaactaagagtccaggaggtgagccaaaggaacacaaggtacaatgcaatcaagctcacaccatccacctccactaatgtgataggtgacacagagttcacccggaatttcacagctctaaatgttgaggaagcccagcttgtgggtttggatgagccaaagaagaaactgatggaattaataggcatattggatgaacccaaggaacatgaatcctccaatactggtccaagagtggtatcccttgttgggatgggtggcattggcaagacaactctcacgaagaaggtgtttgatagcaacgatcttagtgacaagtttggcactcgtgcttggatcacagtgtcacagtcattcgagcaaaaggagatttttaaggagatggtgaagcacctctttggagctgagtcattgcataagctcttagaagatcatcaagggcaacaggtattggaagtacatcttgctgactacctatccaaacgactaaaggaaacaaggtaccttattgttttggatgatgtttggaccattgatgcatggaatcgaattaaggttacttttcaagatagtggtaaggatgatagttgtgtggtagtgactacaaggaatcaaacattagctaaatactgtagtcccccatcacacatccaccaacctgacttcctagggaaagaagaggctagaaccttgtttctggaaaagacaaacagaagtcttgatgaactggagaaaggtgacaaaaccaaaggaattgttgaaaaaatattgaataaatgtggtggactaccacttgccattttgacaattggagccgtacttgccaataaggacactgaggagtgggagaatatatacatgcaactcccctgggatcttgcaaacaatccaagccttgatgcgctaaggcgagtggttagccttagttacaaccacttgccttcgcatctcaagccttgctttttgcatctcagtatctttcctgaagattttgagattgaaaagaaacacctagtgaataggtgggtagccgaagggttggtagcagatgacacaacaacaagaacacttgaagaagttgctgaaaattacttctatgagctcatcagccggagcctgattcaaccatctaagttagatatactgggaaacgtgaaaacatgcagagttcatgacattgtgcatgatattgcggtgtcaatctctaggcaggagaactatgcattcatacatggagaacacacctccaacatatcaacaagagtaggcatccgacatctatcatgtgttgctagcaggaaactgaacactgctatggatttaagctgtgtccggtctttaactgcgttcagtaagcctctagagctaaaatccttagtttggtcatccaagttcaagatgttgaggattctggatttaaaacatgctggatttacggcaatccaacaagatataaaatacatagggttgttgctacacttgaagtacttgcactttccaaagcgtataaatagtagtgtttatgcacttccaaagtctataggcaatctgcttggcttacagactctagacctacaaagatcaagtgtttcgaccctaccaatagaaatcactaagctgcataaccttcgcagccttcgatgtagcaaggtacctaattatgtttatttcaatccagcgcaacctacgacggagtggttcacggatgccatagaatgtttaacgagtgagagtggtgcaactgctgacctgcacatggccttgtctagttgttggtctaattcatccggcattaagttgcccaaaggagtgggaagattaaaagagctacaaatactagagaaagtggatatcaagcgaacaagtcggaaagcaatcaaggagctaggggaactaactcagccgaggaagataattgtgagagggagaggagcctccaagaaaaactgcaaggcattctgtgaggctgtgccaaaactgtgctccctccgttccctcaatgtgagtaccatggagagtaagaaagcagctgaggcgctggatatggtggtttcttttacatcccctgtctcttctcttgagcgtctcaaattgaaggggcttctacagaagatacctgcttgggttggtgaatgtgagaacttggtgaaggttgacttaaaatattgtcagctcaaggaattggtggccttggctgaactgcgcaacctggtacagcttcgtcttaaaaaagatgcattcgatgcagagaatttagtgttccacgagcatggattcccaaagctcaggatcttaatcataaaggatcattatgcaatggcactgaaggaggtgacctttgagcagagctcctcgcccaacatggaaacaataggcatcttccattgccatttggaagcagggatcaatggtatcaaacaccttccaaaactcaagaagatttgtattaacaacaatgatttggggaagcaaagtagcatgttacaagaggaagtggagaatcacacgaatcaccctgtgctgcaaataattccgggctccgcttttgatccaggacagaatttgtactcttgatctgccttcatgtctgcacagtccaagctcctgcacatcatcatcggcaggagcctcccttcttcgtaatcatcaggatcctttaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagcccggaagcataaagtgtaaagcctggggtgcctaatgagtgagctaactcacattaattg

SEQ ID NO: 25 - DNA, 739 bp, Triticum aestivum
gcctactaacctcactactcttaagccacaaaagatttttgctaccagcacctaagctccaatggagggtgagaagaactcgtccggggacctgatgtccagcagcaagctggtcgcggaggccgccaagacggcctacgagaagaagagcgtcgagggcatcgacaaggaaaaggtagccgccgcctccgccgacatcctcgactccgccgccaagtacggcaagctggaggacaagccggtggggcagtacctcgagaaggctgaggggtacctgaaacagtacagctccggcggcaccgagaaggagaaaaccgacgcacctgctgccgctgacgcaccgaagccggatgcacccaaggaggcagcgcctgcgcctgcccctgccgcggaggaagagaaatcgtccgatgggttcggtctcgacgacgtcatgaagggggctgcatcgctgtcggggaagaagagtggcgaggaggagaaggagagcggcggcggcggcgggttcatgaagatggctcaggggttcatgaagtagaagtctggtttctacatctacatgcatgtagctcttgttaagtttgtgcgctgcgttacttctgtattttgttactctataacgttgtggttgtgcttaattatgttagctgctgatatctggttctgtaaagtttcttaagtcatgtctgtctgtattgatgatcaataatccagttgtgctagctaccctttttttgtt

SEQ ID NO: 26 - DNA, 664 bp, Sorghum bicolor
taaagaacttcgatttgcgtagatggatcgccaccagagcgcgatgcagggcagcagtggtgccaacggcgccggtgctgccgtgcaagagtggctctaccctgctggcggctggcagccggagcaggccgtcgtcgtcggctcgttcctcacggagctgctggaggacgcgccggtggcggaccagccgccggaggacgtcgaccggctgagccgcgtcatccggtccctggaggctgagatccgcggaggtggtgggccgccgccgtcggcggccgcggcagacggtgggggcacggcggatcgtcacgtgccgggagatgtccataacggcgggctccaggactacctgctgctgccggaccttgatagcatccccagcccgtgggtggcagaagcgccgccgtcgttggagttctgggcggaggtgccggcggcggtggggcatgatatgggcggctggtacgtcgacggcgatggcgtcatggtcgggtacgagttcagagagcagtgctattacggctacagcgagagcccacacgttgagcaagtgtacagccccttgtgggaatgaatgataaaaaatctgtgaaaaaagaaatataaccattaaagaattcaagaaggcgaacctgatacctaaagctttcgactctttcttcat

SEQ ID NO: 27 - DNA, 2205 bp, Zea mays
aaaatgtagggccatgtgaaggtcgcgttcgttccttcgttccccaaggccttgccttgttctggttcagcatcagtgacgcttagcttcacaggaaccaggaccagcgaggtctctggctctctgcaacttgccatggggaccgcaacggcagcaatggacaggaatgcagatggagagcagggcaagaggaagaagaagggaggcttcaggaccatgccgctgatactagcaagcgaagtctgcgaccggtttgccacggccggcttcggcgccaacctgatcacgtacctgacgcagcagctgcacctcccgctggtggaggcctcgaacacgctaaccaacttcagcggcacgtcctccttgacgcccatcctaggcgcgttcgccgccgacgccttcgccggccgcttctggaccatcatcgcagggtccgtggtgtaccagctcggcatggtcggcgtggtggtgtccgcggtcctcccctcgctccggccgcccccgtgcgacgacccgccggcggccaccccgtgccagcgcgcctccgggtggcagctcgccctgctgtacctctcgctgctgctcacgtcgctgggctccggcgggatccggccgtgcgtcgtggcgttcggcgccgaccagttcgagcggctggacagcgccgaggaggaggagaaggccaaggccaaggcggaggcggagcggaagcggcgctacttcaacctctacttcttcaccatggggctggcggcgctgctggcgctgacggtggtggtgtacatccaggagaacgtggggtgggggtgggggttcgggatcccggccgtgggcatgttcatgtccatcgtcgtgttcctggtcggctacccgctctacgtgctggtcaagcccgggggcagcccgttcacgcggctcgcgcaggttgtcgcagccgcgttcaagaagcgcaacgccgccgtgcccgaggacccccgcatgctgtatcaggacaaggagctcgacgcgctcatctccaccaacggcaggctcctacacaccaatcagcttacgttcttcgaccgggcagcaatagtgacggcgggcgacatctccccgtccgggcaaccagacccgtggcgcctgtcgacggtgcaccgcgtggaggagctcaagtccatcgtccgcatgctgcccatctggtcggccggcatcatgctggccaccgccagctcgcacaactacaccttcaccatcatgcaggcgcggaccatggaccggcacatggggccccacttccagctcccgccggcgacgctgtccatcttctcgaacgcggccatgctcgtcaccctggccttgtacgaccgcgtcttcgtgcccctggcgcgccgcgtcacgggcctgccgtccgggatcacctacttccagcgcatgggcatcgggctggccatctccgtgctcagcgtcgccacggcggcgctcgtggagaccaagcgccgcgacgccgccgcccggcacgggctcctggacagcccggccgccgtcgtcccgctcagcgtgttctggctggtgccccagttcgccgtccacggcgtcggcgacgccttctcgtccgtggggcacatggagttcctgtacgaccaggcgcccgagagcatgcgcagcagcgccgccgcgctcttctggctcgccgcctccatcgggaactacatgggcacggtgctcgtcacggcggtgcagcgcgccacgcgtgggcgcggcgagtggctccaggacaacatcaaccgcggcaggatcgacaactactactggctcgtcacctgcatcacgctactcaacttgggctactacctcgtctgcttctatttctacaccatgaagccgctggaggtggcggatgactgtgacaaggactgtgagctctcctccctccagaaaaatggcagtggcgcggcgctagtgtgatggtgtaattaactggaagactagaaagcaagaatggtcttgttgttaataactagctatatacaatcagcagcgctgcaatgcacacggattacaatttactatagggatattgtagtgtatatcgagagtttataactataagctgtggtcgagcatgcatacgtacggtcataggaagatacaaacgcaacgatcatgatcgtgatcatgcaagctaaaagcaccatcgcatacagtttagtgtattttattgtgtcc

SEQ ID NO: 28 - DNA, 1178 bp, Triticum aestivum
aattcggcacgagggctccttcccgggttgattccttgaaatgtaccggtctcttcgagctcgctgtcagggacctggagtttctagagcaccgcggaggagatcaggttcaagccggccccaccgtcaactagcatcttagtgaccttgaggttgcggattgttggtgaaaccaacatcggcaagcacccgaccgcagttatgcgatccgggtggtcctcaatatcaaagatgataggcgtgccagaccatttcagaggcttgcgtgactcgacgggtggttctgctgcattaacttcccacacccactgcttgagctgacggtgcgaggtatgcagagaagcaccaccgtcaacacacaggacctctgtggctttctggaactcctgctcatcagcggcacgagggtcattcctacctgaaaagaaagagaagcattagcagtttgcagaagaaactactccatcgatctccatggaaatctacggtgacctcgaggccggctgcctcagccactccgtctctcccatcaagccgacgtccccgccgaggaaggccgtgcccggccgcctcttctgcgacccctgcgacgacgccggcgagctcctcggccaccaccactacctggacatctgcttcaactgccggaagcttctcgcaggaaacaaagacatcttcatgtacagaggtgacacgcccttctgtagcgaggagtgcaggcaggagcagatcgagatcgacgaggcgagagagaagcgctcgaatcagaccgggagggcggaggagcagcggcagagacagcagcagaagcagagcaccccgaggatcccggtctgggcgtggtagcagctttccggcaacaaagccgaaacgtaggattttcagcagcagttcatgatgaacaaaagctcgatgatgagttgggcaggctagatccagttgagggaagcttggatcgccggttcgacgggacgaccaccaccctccaggctgcaaacctgctgcatcttatgctgtctctgaaccgcatggatgggttctcatccttttgatctccgaagatggagactaagagttaaattttgtgtgtgaattatcgctggttttttgttcttgtgtcgcgtaaggttgtactatagcctgtcgatatgaaagaaaagagagaggcataacaaaag

SEQ ID NO: 29 - DNA, 946 bp, Sorghum bicolor
ccgtctccgtctccgcaccgcggccctcgtctccggctctccgctccgctctagtcgctccttccgccggcgagtggccgttgctgcagcgaggagaagagagcggagatgggcgacgagcgggtgaaggcggaggcgctgcagatcctgggcctcttccaggtgctcccacgcctcgtcgtcttcgacctcgactacaccctatggcccttctactgcgagtgccggtccaagagggattcgccgagccttttcaggcacgccaggggcatcatttacgcgctcaaggagaaggggatcgacatggcgattgcgtctcgctcgcccaccccggacaaagccaaggtattcctcgacaagttggagctccagtccatgttcgtcgcccaagaaatattctccagctggacccacaagactgagcatttccaaaagatccagaggaaaactggaattccctacaaatccatgcttttctttgatgacgaggacaggaatattgatccggtatcaaatttgggggtgacgagtgttttagtagagaacggggtgaaccttgacatgtttaagctgggtctcagtaactttgcaacaaaatatgctgcctccagcagaaaggaagacgaataacctcgaggaaaagtgatacattagaagaaaataccttcaaaacattgtacttgaatttcttgtgatcaattgccactatattcatggacaatttgtggatgaaggatgaccacacagacttagcttttgaactgatgcaacgcctgtctagtatatttatttgaaggcaaaacactgtgtgtctttatttcacgtgccaaaacaatatatcggtgcatctattttgctttatttttgtgtcagaattttcttgtgccttgtaacgccgcaagtattttctgttgacctgcgtttttcatgttaaattttgtttttc

SEQ ID NO: 30 - DNA, 1271 bp, Hordeum vulgare
ctctcgtccgtgcatcttctcatctcctcacaaatatctcgctgccggggcaggccaccgtcgcgcgcggcataatagcacggcgctttcagacagcctcctccgccaccaccggcaccgcccgcgcaattaacgccaccgctaataacgagcgcggctgcggcccagcaataccaacacacaccaccggcagcataccggtcgatcgactcgacatgtcgtcgaggccgagcaggagcgacgcgcacctgtccccggtggacgaggcggtgagggtggacgaggtgcgggggtactacgacggcgcggctcccaagcgccactccaagccctcccgcagcgaccactccgccgtgtacaccgacgcgctcgccggccccggcgtcgacggctcccaccccgagctcgacaagttccaggacctcgaagcccactccgagaaactggtgtgcgagggcgggaaggccggcgaggagttcgtggagacggagtactacaaggacctcggctgtgtcggcaagcagcatcacacgactgggacgggcttcatcaaggtggacaggcccgccggcggctcgttcgagctctctgaagacccgggtgcgacggagcgccatgcttcctccaaggggaaccccgccacaaacgactggatcccgtcagctgacacggtgtaccaggaggcgtcagacaagcccaacagaagcgacagctgagccgggcgatgatctacagccaacatgatcagatgcgtatgacttccggttaaatcggctattaaaaaaataaagggcgcgtattcgtgtatgtcagccatttgttattgggattcttgtgaggttctatctacagtacttgtcaaactctcaaactcgtgggtcgttttgggaacctgtgttgtggatgtggaactgaatgaagtgcaggacatatacagtaataaatcacaagtctgttcacttcgtattcgaactgtctgtctccaaaccaaacagacgagaaacaatcgtattagccttagagacaccaatcacaaattcacaagagtcgaagacacatggtattattttgctgtgcttatagagagacactcctcggtactcttaaaatagtactcctaggcggaaattttattgattgattgatgttggcacggcgcggacggcgaagagacggccggatcggtcagtcggaggcgaggcgcggcgggtggatgcggaggcgggcgagctcggcgtcgatgcggccggtgaggatgagggcgaacatgc

SEQ ID NO: 31 - DNA, 740 bp, Solanum lycopersicum
actccaatctacttcaacaatggccaacattattcattccattttctccccctttttcatcatcaacattattttcctctctttctcatgttacacgttagcaggacgcgatatcgcgaaaatcaacgataaaatcaaacaccccgatacgttctttccatacgatggaacggtcctaattcccggtatagggagggttgttgtcccacctaaaggcacacatgttaatccgtttacgtataaccctatcaccggctctaataatggcaacggtttagttattccaattcctgactctggcactgacgttggctcttacattcctggtggtgacgatacatttattcctaaccctgaagtcgaagtccctagtggtggtacaattcctgtaccaccataggtatcgtcattaataaaaataaaataaaaaaggacagtctgatgcatgcatagagcattttgaggtcacctcattgaatatcttatttttggttttgtgaaataaacatggaattattgcatgtcgaaattaatttaattatgtatttttttaaaatatatatagtgtggtgtgtgcgtgcatgtgtgtctttaatttattttttaatgtttctctccaataaacttcattatcttcgacgtgtattaattttgtgaaattaaattagtattctacttaatatagttgtaatatatatttggttaaatctaaaatataagctgttatcaattagcgatat

SEQ ID NO: 32 - DNA, 1671 bp, Sorghum bicolor
agtctccgcggacccatctccattgaccgaacggctccgcgtaaattacccggacagcgaccgcgaccggggacctcctccctccatcgaaccccaagcgcggcgctcccgttgtcccgcacccgctctaggccatgtcgcccgccgccgccaccaccacagccttcgccgcggtctccgtcgccatccccaaccctactgctccatcccgcggccgcgtgcgccttccgctacgcggggtccccgccgccgcacgccgcgccgtcgcctcgatggccgtgtccgcccccaggtccggcgccgccgcctcgttcctcgagcgccgcgagtccgagcgcgctctccacttcgtcaagtaccagggcctcggcaacgacttcatcatggtggacaacagggattcgtcggtgccgaaggtgacgccggaggaggccgcgaagctgtgcgaccgaaactttggcattggcgctgacggcgtcatcttcgtcatgccgggggtgaatggtgccgactacaccatgaggatcttcaactctgatggcagcgagccagagatgtgtggtaatggagtccgttgctttgctcggtttatagctgagattgaaaatctgcaggggacaaatagcttcactattcatactggtgctggaaagatcattcctgaaatacaaagtgatgggcaggtaaaggttgatatgggtgagcccatcctttccggaccagacatccccacaaaactgctacctaccaagaacaaagctgttgtccaagctgaattggcagttgagggcttaacatggcatgccacatgtgttagcatgggcaaccctcactgtgtcacatttggtgccaaggagttaaaggtgttgcaggttgacgatttaaaacttagcgaaattgggcctaaatttgagcatcatgaaatgtttcctgctcgcacaaacacagaattcgtacaggttttgtctcgctcacacctcaaaatgcgagtctgggagcgtggtgctggagcaactcttgcctgtggtaccggtgcttgtgcagtggttgttgcagctgttcttgagggtcgagctgagcggaaatgtgtagttgatttgcctggcgggccattggaaattgagtggagggaggatgacaatcatgtttacatgaccggtcctgcagaggccgtcttttatggatctgttgttccctaggtactggggaccaaggtagaagggttggctgccactcagagcttgtgagattggttacaatatccatgaaacagaatgttctggtaccagtacacttgttcagatattcttaattatggttgcttgatttgggtagcagtagaggcttgcttttaaagcattctagtgttgttcaccttttgtactcctttagtctgtcaggtttgaacactacattggtaccatttctttcccaccattttctgtttcttttctttgtaagtgaatgctaatgcagtttcagtatcgttttctatagatttatgcactgcagaatgattgttcttactaatttgctggaatgaatgctgcctatttcctgaaaatcgctatcatctaaagtgcttttgacaacagacaacatgggttgttagttatggctcactattaattttcaccggcaacaattaagacagtgtcacatgctgtgctt

SEQ ID NO: 33 - DNA, 914 bp, Solanum lycopersicum
ttggtacacggataacacacatgagttgtctactcgtttaagcctgttacaccataacgtgttgacttgtacaacaaccaaaaattgcaaaattataataatattaacacttttgttcgcttaaacaatttaatacctataaaaatcacctctttataaatatttacattagcgataccattgttcattcatcaataaccaacaaatttcctcatatatataatcaattcgttcgcacttcaattattttattaatcgaaagatactagttcattctatggatccaacacgagccaagagcacatccggatcgggtcattcatcgacccataagcccaacagccacccgaagccatctaaatctgagctgatgtccagcgccaagctagtagctgacgccgccaaagcaaaactccatcacgatccaaaacaatttgagaaatcggagctcgccggagctgccgctgacctcctcaacgccgcttcacagtacggtaaactagaagagacagggatcgggaaattcgtcggaaaagcagagacttatctccataaatacgaaacttctcatcattcaacaaccaccgctaccgccgcggcgactgcacatacgcagtcatcggggcatacaagtggaggaaaacatgaaaaatcaggaagtggatatggcgagtatattaaaatggcggaaggacttttgaagaaagattccgatgggagtcagtcgtcggaatctggtaaaaaaggagattatctgaagatggccggagattttttgaagaagcattgaactgtttaattttgcgctgaaaattctatttttatgttggataaatgtgatttgtattttgtgtggctaggcttcattgccacttgtgttaagccaattaatgaaaataaatttgttttagaga

SEQ ID NO: 34 - DNA, 755 bp, Triticum aestivum
ccactctgctggccggcgagaggctgcctgccatgtgggcctcgccagggaggctgccggcgatggaggaggaggaggagtgcgaggcgggcgcgggccaccgggcgccgatggcgtcctgctggggccgcttcggcctggcggcgctgtggcacaggctccggcaccttttcctggcgcggcggagggcgcggcacggccgctccatcctcggcgccggcgggctcaactacgacccgctgagctacgcgcagaacttcgacgacagcagcctcgagctccacgagccggacttcacggccaggttcgcgcccgcccgcaacgcctgctcgcccaggcgggcatgagcatgacgacgcgccacttctcggcgccccggtggcatacggaggatcccttttgccacttcctggcgcctttgtgcgcccctttgagtggtaaaaaggctttatttaatccacgtattttcggataaatgtacatgtacatgtcatgcggatgacgcaagtagttttcatttttcttcgcgggtgtaagtattcgtgtggtgttcttccaaaagaaagaaaacagcggggggttgtgatgaactgcataggagccagtcagagcatgtctgttgggttatcaaaaattcggaaaaagttcctcctgaatagatttctacgctccaaatgtgcatcaagttcggagcatttcatgtggtacttatctcagcttcgacttaatcgatagcggtttaagctaaatagcta

SEQ ID NO: 35 - DNA, 3358 bp, Solanum lycopersicum
agtttggtttttttcgggttcaaagcccaattctcttttcctctctctctcttctttctctctcctccagctacggccgaaaacctagatctgattcactaccggagcctgaaaaactcgtcggcttcgaaattcctatctgggttttgctcagaattgaatttcggtaattgggttcttctcaaaattcaaaatttccaacagccttgagcttctggatattgatggcaaccccagaaaccgcagctcctccagcaacccctactgagaataatgagatggtgccgaaaaatgagatgatacatgagcatggtgatgagatggtgccgcaaaatgagatgatacatgagcatggtgatgagatggtgccgcaaaatgagatgatacatgagcaaagccatgagattgtgccggaaaatgagatgcaaaatgagatgatacatgagattgtgccggaaaatgagatgcaaaatgagatgatacatgagcacagccatgacattgtgcctgaaaatgagatgcaaaatgagcacagccatgagattatgccggaaaatgagatgatacgtgagcacagccatgagattgtgcgggaaaatgagatgatacctgagcacaatcatgagatagtgccggaaaatgagatgatacatgagtgcagtcacgagacagtgccacaaaatgagatggtacatgagcatagtcatgaaatggtgccagataatgagatgacacatgagcacactcacgagatggtgccggaaaatgagatgacacatgatcataatcacgagatggtgcaggaaaatgagatgacacatgagcataatcacgagatggtgccggaaaatgagatgatgcatgaacatggtcatgagatggtgccggaacatgagatgatgcatgaacatagtcatgagatgatgccggaacatgagatgatgcatgaacatcatatggtgcttgggcatgagatagtccctagcaatgagatggtcccggatgatgagatgatcccactaaatgagatggtccttgctgaaccacaacccaactatatagaaacacctccaaacaatccagaaacacagcccagcaagcgtaggaagaagaagtcaatagtttgggaacacttcaccattgaaaatgtcggcggtggaactagaagggcacaatgtaagcagtgcaagcaatcatttgcatatagtacaggttcaaaagtagctggcactagtcacctgaaacgccatattgcaaaaggaacctgtccagttgtcctacgtaaccaacagaataatcaattgagcccatatagtacacctcctaagatgagtggatatggtggtagtactgatgcaccaaaacggcgttataggactgcatcttctccttaccttgcttttgatcctgaccggtgccgtcaagagatctctaagatgatcatcatgcacgactatccccttcacatggttgagcatccaggctttcttgcttttgtgcagaatcttcaacctcgttttgatatggtgagcttcaacactgtgcaaggagattgtgtggcaacttatcttagagagaagcaagccattcagaaggtcattgagggagtgcctgggcgtatctgcttaacgctagatatgtggtcctcctgctacactgtgggctatgtgttcataaccgggcagtatattgacagtgagtggaaaattcacaggaaaatactcaatatcattatggaaccatatccagattctgacacggctttcagccatgctgttgctgcttgcctttctgactggagtatggaaggtaagttgttttctgtcactattaatcaaccgttgggtgatgcttctgttgataatcttagagctttactatctgtgaagaaccctcttgtgctcaacggtcagttgttggtcggaagttgtcttgctcgaactttaagcagcattgcccaaggtgcatttaattttttgcatgaaactgttaagaaagtaagagatagcgtcaagtacgtgaaaacatcagaatttcacgaggaaaagtttattgagctcaaacagcagcttcaagtgccaagcacaaagactttggctcttgatgaccagactcaatggaacaccacatatgagatgttgttagctgcatcagagttaaaggaagtgttttcatgcttggatacatctgatcccgattacaaggatgccctgtcaatggatgattggaagcaagttgaggttctttgtacttacttgaagatcctctttgacactgccaatcttctgactgcaccaacaattccaacaaccaacacattcttccatgaagcatggaagattcaattggaactggctcgtgctgcagcaagtgaagatccatccataagcggtcttaccaaaacaatgcaagaggagtttgataaatactggaagagttgttgtctaatattagctattgccgttgtaatggatccacgcttcaaaatgaaacttgtagaattcagctttacaaaaatatatggtgaagaagctgccacctttgtgaagttcgttgaggagggaatccacgagctcttccttgaatacgtggcacttcctctgcctctgaccccagcttatgctgaagaggtagatgatggagctttgaagcaggagaatggtgggggcggacttacagattttgatgcctatattatggagacaacaagccagcagtcaaggtcagaacttgatcaatatttggatgagtccttgttgcctcgtgttcatgagtttgacgttgttgggtggtggaaactgaacagaatgaagtacccaactctgtcaaaaatggctcgtgacatcttgtctgttccagtttctactgtaacagctgattctgtgtttagcacggtaggcaaagagatggatcgctacaggtgttccttgcgacctgagaccgtggaggccctcatttgcgccaaggattggcttcaaaatgcatcagtaaataccttacatgcaccaataaaaatggaagtccccatttaggttttttctgtgatgttaaatacttgtctagaatagcctttgtagctgatttctgttttctttgagactgttataacatttgtctcctccgtgtcacccgagattcgactttcttgtatcataatttggtatcagtagagacttactggagagtttagttgcgattttcgatgtcttttttcgttgatgtctgaatgcatgaaagcagttttaatctggtgcatgatatgagtatatgtttatacagttgtattgcctatctatgttctatattgccttgcattatagagtttattttcttggtataaaattgttattttagctgc

SEQ ID NO: 36 - DNA, 1376 bp, Solanum lycopersicum
tttcagcttatattagtgtggatctactcattaacttgtttatttattaattcagtgtcatttaatagccgttccacctaacatctaatgaaatttggccggcaaaaattaaacaattaaagaaaagactattatatgaagtcactctactaaagttattataaaatcccatacaaacttgatcaatcttcttacaaataaagcaaaaaatggaagaaatagagcacaaatacattgaagtgaatggtctaaagctccatatagctgaaattggaagtgggttttctccagttgtggtgttcttacatggattccctgaaatttggtattcttggaggtaccagatgatagctgtagctaaagcgggttacagagctattgcacccgattacagaggatatgggttatcggatcaaccaacccaacccgagaaaaccacattcctcgatcttgtcagtgacctccttgcacttcttgatgctcttaatatctctaaggtttttctcgttggtaaagactttggatcttttgtcatttcgtatttttccattctccacaaggagagagtctctggatttattgttatgggggtgccatttttgcctccaaaacctcttgagtttaaaaaaggcctccctgaaggattctatatttcgagatttgggatacctgggagagctgaagctgattttggtcgtcttgacgccaaaacagtagtgaggaatgtatacattcttttctccagaagtgaattaccaatagccaatgaagatcaggaaatcatggacattgtgcaaccttcaactcctctgcccccttggttctccgaggaagacctggctgcgtatggagctttgtacgaaaaatctggattccgaactgcattgcaggttccctataggtcactgcatgaacaagtcaacataacagatccaaccgttcacgttcaagcactgtatattaagggagagaaagattatttcctcaaatttccaggcatcgaagattacatcagtagtggagtcctcaaaagtttagtccctaatctgcagatagttaacttgccagaaggaaaccattttgttcaagaacaactacctgacgtggttaatcaactcgtgctcgaattccttaccaaacatagtaaggttcagtaagtcctcattgttgttgttgctccgtctactaagaacagaagctccaataaggcgttgttattgttgttgttgctctatctactaagaatagaagttcaaataagttgttgtttcgattttcattcagtaagtcctagttgtgttctacatgtaatattttgctgcagtgaccctgcaattcctataaaaagcaaggcactgaaagatgaaattaccatg

SEQ ID NO: 37 - DNA, 1018 bp, Solanum lycopersicum
aatagatataatttacttatctatagacagacaggaatgttatagtccatttgcagagcaacaatggcgggactcactaatctcaagctatctctgtttcccaattcgtgttcactctcctctctttcatcaaacccatttcttgtttctacctccattttccgcagaacatcccactgcttcccaaagatattcgcgttttccagcaatgatattaaagtgggcagcaacattgaagtggatggatctccttgcaaggttatagagtttcttcatgtaaagcctgggaaaggggctgcattcgtgaggaccacgctgcgcaactatgtaacagggaatagcgttgagaaaactttccgagctggaagtaagatagaagaggcaaatatctacaaggagacgaagcaattcacctacaaggatggtgcccagtatgtcttcatggatctgacctcttatgaagaatatcgtctaaatgaaaaagaagttggagataaagcaaagtttctaaaagagggcatggactgcagtttgcttttctggaacgggaaggtgatcgactttgaattgcctataacagtaaagttgacagtggtggacgttgatccaggcgtcaaaggtgacactgcccaaggtggatcaaagccagcaaccctcgataccggtgcaattgtaagcgttccattattcataaatagaggagaggaaattatggttgatactagaaatggacaatacatgagccgcgcataggtttgcttcaggatacaattttgttacaactgaaactttttgtatctatatgtattagaacctagtatttgcaggagtaacattgaagacccccattgagaatactattggaaaccttctgttttagtgtacaaatgggaaagaaaagtaatccttgttttactgccaatttttaccttccaaaaacacaactctaaaaatattgtgagtagtgaaaaattgggtgaagttttaaaatgtgtttggttataatttttggcttgaa

SEQ ID NO: 38 - DNA, 1171 bp, Solanum lycopersicum
ggtactcaattgcctttttcatcggagttttactattgctgctactatcatacactccaattgcaatacggaaaagtagcggtaccggaaaatgtgttccactaaacaaaaacagaagcagaacctccacaatcagcgctccgtcgtgcctacctctacctccgcctcaggcggtgacggtggcggtggtggggactggagggaagaatccataaccggcggatcacttaagcatgtggatttggacaagggcaaaaacggttgggcatcaccaccgggagacctattcaatctgcgagggccacactacttgacgaaaaaggcgaaagtaccttctggcgcgtggcttctacagcctgccggagtggattggctccgatctaactccaagctcgaccacgtcctggctcgacacgacaaccgtgtgatgaacgcgctgaagaaatctcactctgaaggaaagtctctgaaaaccttcatagtcgccgtgaatctccaagtcccagggcgtgaccaacacagcgctgttttctacttcgctacaaacgacgatgagccgctcgaaccgggttctctcctctatcggttcgtcaacggcgatgatgcgtatcgtaacagcagatttaagatcgttaaccggatcgtgaaaggaccgtggatcgtgaaagccgcggtcgggaattactcagcttgtatactcggtaaagcgttgaattgctactatcatagaggccctaattacttagaaatcgacgtggatatcggtagctcagcgattgctagcgctattttgcacttggcgttaggttcggtaacgtcggtgacgatcgatatgggttttctggttgagtcacagacggaggaagagttgccggaaaagttatttggggcagttaggatttgtcaaatggagatgagctctgctacgtttattgatacgacgtcgtcaaggaaggtattaccgactgctaatttacataatccttgcaatagtagcaaagtccaagctgaggagaacggtgagaacaaagatgattaagaagaaattaaaacaaaattacttcatattattcttaggggaaaaaaattgttggtgcaatccatgtagatagatgtctaagcttaagctttcattgttcaataaaaagttcatctcttacttttcttaact

SEQ ID NO: 39 - DNA, 2739 bp, Zea mays
agcttgtcgacgaattcagattggacactgacatggactgaaggagtagaaactctccggctctctgaacagacaacagaggtctctctactctagtccacaggagccgctcctccgcctcccgttgtcccctccaccagtcctcttcgggcctcagccttctcccccttacccctctccacacggcgtcgccccctcccatttcgccggcatcgacgatgaacggcggcggcgggcggcggcggtactcctcggagcagctcctcttcgacgttccgtccaatgccggtgccggccggtgggcacagcagtccggtggagtgcggcgcggggacggagagatcttcgtgtcggtggagccagcaacgccggcgcggctgcgcggaggggacgccgcggctggggactcgccgggacagaggcagcagctcagtcccgggttgctcgatctccatgctttcgacacggagctaatcccggattttcaagtaccagggatgtatgatggtgcccaaaagtttggctatggaggaggtctagatgaatctgatatgagattcacagcaaacaagctgatgagcaagtctgctgtttttcctgatggtaactacctgaaggccttcacagagaaagagaaggcagcacctgtcgcgaaaatcaaagtggtggtgcgcaaaagaccacttaacaagaaggaagtatcaaagaaggaagaagatatcatagacattgaacaaagatcaaactctttgactgtacatgagactaaacttaaggttgatcttactgaatatgtcgaaaagcatgagtttgtattcgatgccgtcttagatgaagatgtttcaaatgatgaggtttatcgtgaaacagtggagcctgtggttccttcaatttttaatcgaacaaaggcaacttgttttgcttatgggcaaactggcagtggaaagacatataccatgcgtccccttcctcttaaggcttcccaagatatcttgaggttaatgcaccatgcatatcgaaatcaaggatttcaattgcatgttagcttctttgagatatatggtggcaaattatttgaccttctcaatgataggagcaaactttgcatgagagaggatgcaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgctattaaacgccgtgtggatggcaatgactccaaaccacccagacctgttggcaagctgtcatttattgaccttgctggcagcgagcgtggtgctgatacatctgacaatgataaacaaacaagaattgagggtgctgagatcaataaaagtttgcttgctttaaaggaatgcattagagcacttgataacgatcagactcacattcctttccgaggtagcaaattaactgaagtcctgcgtgactcattcattggagactcacgcactgtcatgatatcatgcatttctcctagttctggctcttgtgagcatactctgaacacattgagatatgcagacagagtgaagagtttgtcaaagggaagcaatgccaagaaagatgtgtctttggcagtgcctttaagagagtcgagcccttccccactgccttcagttgtaccctcattctctgcatctgaggtgatgaatgatatcaccgagagaaacaattttggttggcccaagcagcagtatgttaaagaacggcctgctccgacatttgttgaacgaatgcccaaagtgaaggatgccgtggagttcgcaacatcagacggtgcttatttgaagggacaaagaagccagggctgtatggcaccaaatatagctgaaataccggatacaatgtaccagcagagaaggcaaccagcaaggaaggctaaagataccgctttgcggaataatatgagaaattccgttgcttacccaactagaagtgttgagccagacgaagatgatcatctgaataatcttctccaggaagaggaaggcttggttagtgctcatagggagcaggttgaagcgactctggacatcctcaaagaggaaatgaacatattaggcgaagcggatcagcctggcttccaacttgacgactacaacattacgagactaagcagtatactctcgcagaaggcggctgggattgtggacctacaggctcggttggagcagttccagaggcttttggatgagaacaatgtgctgctatatgctcagagcccccggttgtagttccatctgttgccttcatggcaccgtaaaaggtgggcatcggtggcttctaccagcgcctcaggtggcatcatatgcggtatcggcatgtcgctgtggccatgacccatgatgctgcaatttgtttttaacccataggtgccggtgaaacgcaaactagatggctagttcacagcctgttgccatggttctttggcatggccggccccgcaacctattttgtactagagttgctccattcttgtctttccgcgctccatccttaatccaatgtgtatatcttgtatttgtccgtgtcacatgagtgctctgttatttgtagctcaacaaatacatttttttacctttctgatgtatgaagttttccagagtgtacggtatcatccagttacacacatacttttgccaagta

SEQ ID NO: 40 - DNA, 897 bp, Triticum aestivum
ttgaaaaacgcggcccagggaattgaaaaggataacaaaagggcggaaatgggccgaaggtccaaagctccgggcccccatgccccgggataacggccacccggggcagaggtggccttcctccgcataggataggccggaacccaaatccacagccatggcgctcctcctgtcccccaccgtctccttcctcgccccctccccctcctccgctcctcgtgcccgagctctctccagctccaccgccaccgccaccgccgccagcaataatgccttcccttacctcgcctcgagacttcagtgcaagactggcgcctcagtcagccatgtttctcttgccaagaagatgcccgtggttgtccacgcttctgcagaggctggtccaactgatgcggcagagcaaccagagaagccaaaaccagtggcttcgatcgaggacatgccgttcgagtccaagcagcggatgatcctggagcagagggcacggatgaaggtggccaagaagctgaggcagcggcgcaagcggctcgtccaaaagaggcggctgaggaagaagggcaggtggccaccgtccaagatgaagaagctcaagaacgtgtgaccggcacatgatgtcggacagctggtccgtaccattcctctgtaaacctacgtgttgcgttcctctaatgcattggtgtttgtttcgtttgtacaatttttctgttctgaaacacgcaatcggttataatgcaattaattttttaccataatgaaacctttttgcgtgtccatagcaccagcctgatgtgttgttatctgtggttagtctatgccgccccactgtctgtccaaattaagtttgggggagttttatttgccgttgaaaaaaaaacaaaggggcgagcgctttcgcat

SEQ ID NO: 41 - DNA, 688 bp, Triticum aestivum
gctccgctccaccacccgcagccaaatggcgaagctgctgccggccggcctcgcgttcctcctggccctcgccgcggcggcggcgctggccccgtccccggcctcggccttgaagggcgccggcgggctgggactcggaggcgcggcggccgtggtgatgcgccggggcgggcggacgtgccggggcacggttggcgagtgcatggagtacttcggcgtggacggcgagggcgagggcgaggtggcggcgatggctggcaagcggcgggtgctgcaggacgggtccgggtacatcggctacgacgcgctgcggcgggacaacgtgccgtgctcgcagcgcggcgcctcctactacaactgccagcccggcgccgaggccaacccctactcccgcggatgcagcgccatcacccagtgcaggggctgattctcttcattaaaccctgcttcattccttcttactacctgcatgcctcatcaattagtactgctatctatctgtaatgtaacgtaatgtaattacaagaagaagatcaaacacttcttgacgatgcttgatcaatcatcaccgggtggtgtggtgtgatcaatcgtgccgtacgtgtatcagtggaggaggcatggttaattattgtgtgatttgtgcctatttgggtgaaagtaattaagcttacgcattcatctggtt

SEQ ID NO: 42 - DNA, 2994 bp, Solanum lycopersicum
aaataaatattttttctgtatctcatccgctcttcgtcttcgtctctccttttatcgcactgaaaaataccttcagatttactttttactgtttgtgacggtgaaatgaatcagaaccgttaacctttttagatgcttttgaaagcccactgagtctttcatttcatcttcatcttctatttctctctttctgataccttctgggcactgtgaaactaatctgttcatcgaatcgttgatttatagagacggagagagagagaggtgtatcagctgattgattgtgctttggaggtgtggaaatttgttgtttgtggaagaagaggatattggatttaatcggagattgaagtagtgaaaaaacatgaatgcagttggaaggcaaagatctggaacgtcaacggcgcatcaccagaggcaatactctgataacttcctggagacgtcatctaatggaagatggcttcaatcagctggtcttcaacatcttcaaacttcaaataataatgttcctcaggctccacaggaatatggatactatggtggagctcaagggtcgagaatgcttagaggtgcacagaggacatatagtggaggaagcgatctctttgcggagcctttgacgccgccggggaattatcgacattcaagccagagaaggaatggtgacgaagaagtatgtcccaatgagttcagtcctggactcttagatctacactcattggatactgagcttctaccagagatgcctgttgctgggttgtatgatgctccttccatgcatcattttgctcgagcaaaaagctttgatgactcggagcaattccttgcaaacaacaagcaaactggtcgagttcggggcttgccagagagtaacgtctctaagagttttgctgttgataaagacaaggccagcaatgtcgcaaagatcaaagtggtggtgcgtaagcgaccactaaacaaaaaggaattaacgaagaatgaagaagacatcgttgaaacacgtttcaactctctagtagttcatgaaactaaactaaaggttgatctgactcaatatgttgagaagcatgagtttgtctttgatgctgtgctaaatgaggaggtttcgaatgatgaggtataccatgaaacggtggagcccattgtcccaataattttccaacgcacaaaagctacttgctttgcatatggacaaacaggaagtggcaaaacgtatactatgaaaccactacctctgagggcatctagggatcttttgaggctcattcatcatacataccggaaccagggctttcaattgtttttcagtttttttgagatatatgggggaaagctctatgacttgcttaatgaacggaagaaactttgcatgagagaggatggtaaacaacaagtatgtatagttggattgcaagaatacagggtctctgatgtggagatgattaaggagctcattgacagaggaaatgcaactagaagtactggcaccactggtgccaatgaggaatcatctaggtcacatgctattctacagctttctgttaagaggtcagctgacggtagcgaatctaaacctccccgtgttattgggaagctttccttcatagaccttgcaggaagtgaacgtggtgcagacacaactgataatgataagcaaaccagaattgaaggagcagagattaataaaagtttgctggcactaaaggaatgcattagagcccttgacaatgatcaaaaccatattccttttagaggcagtaaattaactgaagtgctgagggactcttttgttggaaatagtcgtactgttatgatatcttgcatttccccaaatgcaggatcttgtgagcataccttaaatacattaagatatgctgacagggtgaagagtctttcaaaagggaacaactcaaagaaggatgtctcatcctcaacactgaatcttaaggagtcgacaacattatctttttctgcagttgtaccttctacatcaacatttgaagatgataccggtgattcatggcctgaacaaactgacaaagatgaatatgatgaagatttctatgaacaagagaagccaatgtcgaagaagaatgagaagcttgatggttactctatctccaattcagaagataaaatgaagagagcaaatgctcagacaaagtggaaggagccacctagaacagaggcaaagtattcaaactcggatgatgatctgaatgctctcttaaaggatgaggaagatcttgtgaatgcgcatcggaaacaagtggaggaaacaatggacattgttcgagaggagatgaatctattagttgaggcagatcaaccagggaaccagctggacaattatatttctcgattaaatgcaatcctttcacaaaaagctgctggcatcctagagttgcagaaccagttagctcattttcaaagacgtctaaaggagcacaatgtacttgtatcttctggcaactgaagctctaattcagtatgcatacaaatttcagatgttgtgcacatttgctttggggacgaggtgttgttgtagatccactaatggacccataggtgttggtgtagaaaaaacacgtggcttgcaacattcacatgctggtttcttcagaagagtttttgaagccttctgttaagttacacaagaatcttgtcattgtttattcattttctcatttgaaaagaagaaaaatacgatagatgctttggcatggctttaaggctttgtgttgctaagattattaagtgttgattgatctgccgtgtggaagaggcatttgctatgctttgagggctcaaatttgtttaatctggtcatgcctacaaagtctatcatagatgactggtggaggctctggccaagcctgttgtaattgattgtacaatttgctatattttcattttagctgtgtgccatgagccacatgcatcaacatatcgctacgaaatgagcacttgaatctactcaattacttgaga

SEQ ID NO: 43 - DNA, 2854 bp, Vitis vinifera
agcccacttttacaaattgggaagtgggttctattccatcgaccattcttagcctttttttcttttttcttgtgtgtgcttccgttgggtaattggactgaattggttaaaaggatcttgtcatttgggggctctggggctactgatgagagcagaaaagcatgtttctgatacatgtctttgaatcaaacatggtggtgggggcaagctaataatgcaaatattttgttgtcttagagaagccagtggttgtttagcttccatactgagatgggtttgatgggtgtgggaaattggatctgttaaccaaggaggtgagtagaatttggtggcctaatgagtaaggaacagaagagagggaagcaggagaaatcctcggaggctgccgagaaggtggttgttgcggtgaaggcgtcgaaagaaatcccgaaaactgctctggtatgggccttaactcatgttgtgcagcctggggattgcattactctgcttgttgtcgtccctgcacaaagcccaggtagaaaattatggggtttcccaagatttgcaggggactgtgcgagcggtcaccggaaatctcattcaggagcaagttcagagcagcaatgtgagattacagattcttgttcacagatgatccttcagcttcatgatgtttatgatccaaacaagataaatgtcaagataaagattgtctctggatcaccatgtggggcagtttctggagaggccaaaagaacggaagctaattgggttgtattggataagcagctcaaacatgaggaaaaatgctgcatggaggagctgcaatgcaacattgtggttatgaagcgctcccaacctaaagttctccgcttgaatttggttggatcacctaagatggaatctgaaacagcctgtcaattgccttctgaaccaggtgaaacagctgaaaaacattctaaaaccaagaatgactcgatgaagtccattcgggggccagttgtgactccaagcagtagtccggagttggggacaccattcactgcaactgaagttggaacttcatcagtatcaagctcagatccaggaacctcaccattcttcaactccgaagtgaatggagacctaaagaaagaggaatcatcacatacaaaagaaaatttggatcttgatgaatctagttcagacactgacaatgaaaatttatctccatcttcaagtgttgggttccaaccttggatggcaggtgttctcacttctcatcatcaatcctcacaacatattgaacaaagttcaaagaaatccagggataagactcaacctcccacgtctaaagctttgctagataagttctctaaaattgatcgtgatgctagaattggcatgatgaactataggtcagaactggacttcagtgggaacgttagagaagcaatttcattatccagaaatgcgcctcctggtccacctccattgtgttcaatatgtcaacacaaggctcctgtatttggaaagcccccaaggtggttcagctatgccgagctggagctcgctactggtggattttcacaagctaatttcttggcagaaggcgggtttggatctgtccacagaggggtcctacctgatggccaagcagttgctgtgaagcaacacaaattggctagttctcagggtgatgttgaattttgctcagaagtggaagtcctgagctgtgctcagcaccgaaatgttgttatgctgattgggtactgtatagaagacagaagaaggttgctggtttatgaatatatatgcaatggctcactggattctcatctatatggacgccatcgagatccactagaatggtctgctcgacaaaaagttgctgttggagctgctcgaggtctgcgttatcttcatgaagaatgcagagtgggttgcattgtccaccgtgacatgcgacccaacaacatcctcatcacccatgattttgagccactggttggggattttggcttggctaggtggcagcctgatggagacacgggtgtggaaacaagagtaattggaacatttgggtatttggctccagaatatgctcaaagcggccaaatcacagaaaaggctgatgtatattcttttggggttgtcttggtggagcttgtcacaggacgaaaagctgtggaccttaaccggcccaagggtcagcaatgcctcactgaatgggcacgtcctttattggaagagtatgccattgatgaactagtagacccacggctgggaaactgttattcggagcaggaggtctattgcatgttgcatgcagcatccttgtgcatccggagggatcctcatgcaaggcctcggatgtcacaggtgttacgcattctggagggagacatggttatggactcaaattacatggcaaccccgggttatgatgtgggcagccagagtgggcggatttggtcagaccagcatcaacattacagtggtccaatattaaacgaggcatatgaagaattcagtggtaagctgtcccttgaagcgctaaggtcagccttctgggagaaggataagggcaggaggacttcaagcgaagacaaattgtaaggctaggagtgctacatgtatgggaatgctgaagatgcatttgcctattttctttttcacttagattttttttcttgtttttcttttcctgcccaatgtcatctagattttgcttctgtacagtagagggggaagttaggtgggatagcaaggttttgtaattcattgagagatggggagaaagagtagtaaaataccaaatggcaatatgaacaatggtggatgtcttttgtttgaatcaaggaagaagctctcaaaaaatatgttttgctca

SEQ ID NO: 44 - DNA, 2067 bp, Zea mays
ttgcgatggcaagtggagtgagtgattgcgaatgtgaccgacgacgggctcatcttcttctcttttacactagagcatgatgcatgggcaggagctgtcctatgactcctatccctcctccttcctagccatggacgacatgcaccgccaactccaagcaccaccagcctgccaaagccacagcagcagcagcagcatcttctttttctttttcttagcagcggtcatcatctactgcgtcgtgatcatcagacgattgatcaaattccaagggaggaggagggtgaagaatgatcatgcagcagcagcagcagcaccaccaccaccaccaccaccgagaaggggtagccgctggtggtggtccgtcgtggagacgctggccttcctgtccgccaacagcagcggcaggggcttctaccacttcgtggaggctcgccaccgcaggtacggtcccggcccctgcttccgcacctcgctcttgggcgccacccacgtgttcgtctcgtcggccgacgccgccaggtcgctcctgggcgccgagccagccggcttctcgaagcgctacgtgcgcaccgtggcggagctcctcggcgagcacagcctgctgtgcgcctcccacgccacccaccgcgccctgcggcgcgccgtggcgcccctcttcaacgcgcaggccacggcgtccctggccgccaccttcgacggcctcacgcggaggctcatgaagcgcgactggagcagcagcactggggccgtggtggtgctcgacgccgcgctggacctaacattcgaggccatctgcgacatgctcatcgggaggacgctgcggcccgatgcgaggaggcggctgcagagcgacgtgctggccgtgacgcgggccatgctggcgttcccgctcaggctgccggggaccaggttccacgcgggcctccgggccaggaaaaggatcatggacgtgctcaggcaagagataggatcaagacagagacagatcatggacatggaggaggaggaggaggagcagcagcacggcgacgactttctgcagagccttcttcttctcaggagtaggaggaggaggcggagccagcagcaacaacaccttttaccatcgtcgtcagctcatcataacgacgacgacgacctcttcctcactgacgaccagattctcgataacatcttgacgctcatcattgccgggcaggtgacgacagcgagcgcaattacatggatggtcaagtacctggctgacaacaaagtcttccaagaaaccttgaggtcagttcagctggagctgaagcagcagcagcagcaggaggaggcagatcatgatctcctccaacatctcaacagcatggagcttgcatacatgacggttaaagaatcattgaggatggcgagcatagtttcctggtttccaagggtagcactcgaggactgccaggtcgcagggttccacatccacaaggggtggattgtgaacattgatgcgagggccctacactacgatgcgacgctctaccacaaccccaccatgtttgatccttcaagattcaaaggcgggcatagcatgcacacgaagcagccgtacagcttcctggtgtttggagcaggcgggagaacctgcctggggatgaacctcgccaaaatcatgatgctcatttttctgcaccaccttgttacaacatggagatgggagatggccgacgacgaccccagccttgagaagtgggcaatgtttcccaggctcagaaacggatgccccattcacctcgcacgcatatgatgattaagcatgcactagctaccagaggaaactagtatatatcttctgtaaccctaaaccacaatgcaaccacaaagcaccgatgtgatgtgtactttattttcaccaccttatgtatgtaattgtctcgcatgttatatcaagagaagtactctattcctctctctctcttatggagctcttgtcggtttaggctattaaagagcttaagtgatagatttctctatttacaatgacttgacgaatcgtacattcatattgatttgagagattttcatataaac

SEQ ID NO: 45 - DNA, 967 bp, Triticum aestivum
cttccttatcaccatcactcaggctgagttagcggcgcgcccaaggaagaaacggagaacgaaaacaatggccgctctccgccacctcgccggcgccacccacaaccaccgcatcgcggccaactcctcctccctcttcgacctccagcggccgccttcctgcctcgccgcggcgcgacccctcagcctcgcgcccctccgctcccgcttcacccggctttacgcgctgtccagcaacgacatcaaggtggggttcaacctggaggtggacggcgcgccgtggaagattcttgagtttctccatgtcaaacctggaaaaggtgccgcttttgtgaggacaaaaatgcgcaattatatcactggcaacacagttgagaaaacctttcgagctggaagtacgatccaggaagcttctatttcaaaggaaaccaaacaattcacctacaaggatggctcccagtttgtgttcatggatttgacatcctttgaagaaagccgcttaaacgagtcagatgttggcgacaggcagaagtggttgaaagaaggaatggactgcactttgttatactggaatggacggatcattgattttgatcttcccatcactgttaggctgaccgtaaccgaggctgatccagggcaaggtgacagtgcacaaggaggaacaaagcctgcaactctggaaacaggagctgttgtcaatgtgccgtctttcgttgatgtaggcgatgatgtcctaattgactcgagaaccgggcagtatatgagccgggcatagagtggaagtggataccagatgagatgccaacagtgaagagctagttttcttgtcccccaatttttggtttaattatccgttcaaaagttcacaacattgtctctttttttcgcatttatcatactgggaccatctacaccgggcatgaaattctatggaaaattctgaactgggcccctttctccttca

SEQ ID NO: 46 - DNA, 1577 bp, Triticum aestivum
cggccatggccgggctgcggcttcttgtcggggcgctttggctgctggcggtgctgcgggagggcgcggcggcggaggcgggggccgtcgccgtggacgggcggcgcgccattgcggccacgggcgaggacttcgtctgcgccaccctcgactggtggccgccggacaagtgcgactacggcacctgcagctggggcaacgcatccctcctcaacctggatctctccaacaaaatcctgctcaatgccatcaaagccttctcgccgctggtgctccggctgggcggctcgctgcaggacaaggtggtgtacggcacggcggaccggccggggccgtgcgcgccgttcaacaagagcaagtcggagatgttcggcttcacccagggctgcctgcccatgccccgctgggacgacctcaacgccttcttcgagaaatctggggcgaagatcgtgtttggcctgaacgcgctcaacggccgggtgccactgcagggcggggccatgggaggcaactgggacaccacgaacgcggcgtccttcatccggtacaccgccggcaagggctacaaaatctatggctgggagctcgggaatgagctcagcggcaccggcgtcgggaccaagatcggcgtggctcagtacgtcaaggacgcgatcgccctgaagacgacggtggacgccatctaccggggcagcccggagaagccgctggtgctcgcgccgggcggcttcttcgacgcgcgctggtacggcgagttcatcgccaagaccaagcccgacatgctcaacgtggtgacccaccacatctacaacctaggggcgggggtggacagggacacacagctgatggacaggatactcaacccgaagacgctcgacggcatggcgggcccgttcagggatctccaggggctgctgaaagccgcagggacgtcggccgtcgcctgggtcggggagtctggaggagcttacaacagtgggcatcaccttgtcaccgacgcatttgtgttcagcttctggttcctggatcagctcggcatgtcggcgaaattcgacaccaagagctactgcaggcagagcttcatcggcggcaactacggcctgctgaacacaaccaccttccagccaaatcctgactactacagtgctctgctgtggcatcgcctgatgggaaccaaggtgctggaagccaagttcacgggcaccaacatggtccgcgcctacgcgcattgcgcaaagcatgctccggggataaccctgctgctcatcaacctgcacgtcaacgcgacgaaccacgtctcggtggcgggccgcggcgcacacgccggaaggaagcacggggggaggtttgctcagccgcccggggcggcgagggaggagtaccacctcacgcccgagggcggcaacatccagagccaggtgatgctgctgaacggcagggcgctggccgccggcgccgacgggagcatccccgggatggagcctgtcaaggtggacgcggcgcggcccatcgccgtggcgccccggtccatcgtgttcgtccacatgccggattaccatgcccctgcgtgtgcttag

SEQ ID NO: 47 - DNA, 1399 bp, Solanum lycopersicum
cgaccacgtgtcagcttcagaaggtaacagttgaaacttgcacacgatcttcatttcattcacatatattaagtgagtggaagtgaaaagttcaattcgcattgctactctctactcatcaatcactctttctctctttggctgtatacgattcactctcgtttttttcaatttccctcctctttttttgtatcaatggcggaggcgacggagatgccgtacattgagttgaataccggtttcagcattccggcggtcggtttgggaacgtggcagtccgatcccggtgtcgtcggcaaagccgtggagactgctatcaagatgggctaccggcatattgattgtgctcaaatttataaaaatgagaaggagattggtgaagtattgagcaggctgtttaaagatggtgttgtcaagaggcgagagctattcattacatccaaactctggaacactaatcacgcacctgaagatgtaccagtcgcactagacaaaactcttcaagacttgcagctggaatatgttgacctgtacctaatccattggcctgtcagtatgaaacctggctcggttgactttaaacctgaaaatcttatgccaaccaacatacccaggatatgggaagcaatggaaaaagtttatgattccgggaaggctagagttattggtgttagcaatttctctactaagaaactggaagatcttttgcaagtagcacgcactcctcctgctgtcaaccaggtggagtgccatccttcgtggcaacaagccaaattgcgggaattatgtaaatccaataacgtgcacctctctgcatattcgccgcttggttctccaggtacaacatggcttaaaagtgatgtgctaaagcagccagctgtaatctcagttgctgagaaattgggcaagactccggcacaggtttgtcttcgttggggcattcagatgggtcagagtgtacttcctaagagcacacatgaagcacggattaaagagaaccttgatgtactgaactggtctatacctgatgacttgcttgccaagttctctgaaattccacaggcaaggttgctgaaaggtgcttcatttgctcacgagacgcatggccagtacagaacacttgaagagctgtgggatggtgagatttagggtcacaatatgaattaactgttgaatccatttgtctcagagatttaagcttcttgtgcacttccttttcctttaaacttttggagataggtgaattgtcaaaccattagatgtacgtttccttgcacccctgtccctctattgactctatgctggaaaaccattcaagaaacctcgcagattctacgagacagtattcaaacaatttgatttgctgggataatactaccaaaccatccacttttgcagt

SEQ ID NO: 48 - DNA, 721 bp, Triticum aestivum
cttcactccaaaagtgcccatcagcgaccatccgttcgctcctgcacctcccttatcgcggtggattggcctcgtctcctctatcttgttggccgcccatctcgactctccaaactctcagctccctccctcgcacacgccgttctcgaatggcggccacctccggcctcacggccaccgttacctcccctccggccgcccttagaacctcgcctcctcccgttctcttcctccgccccatctctcgctgctccaggctccattccctcaaggccaaggcagcagcaaaggaccaggacgaaaagaagcccgaagctaccaaaaagaaggcatacagtcttgtttgcactgcctgcgaagggaacggcgcaatcgcatgcacccaatgcaagggaggtggggagaatttggaagaccatttcggtggccgattcaaagctggaggattatgctggctttgcagaggaaagcgtgaaattctatgtgggagctgcaatggcgctggcttcttgggtggatttatgagcactgccgatgacacttccgaatgaaatgcttatgttgttatttttttttgcttatgttgtgtttgacaaattttgggagatctgtaacatttttacttatatcccctccaaggaatgtgtcccttagaacatttattgcatttaataattgcatatttttttatttgtgacaaagtatgtcactaaaaaaaaaa

SEQ ID NO: 49 - DNA, 575 bp, Triticum aestivum
ctcctgccctgctcctgctctgctctgctccattgccttgctttctctgcctgcctcgaggagctagctagaaagcgagaaagaaacccgccggcgccggagaagaggaaggggagggagagggaggatgtcggactgggggtcggtggtgatcgcggtggtgctgttcgtgctgctgtcgccggggctgctgctgcagctgcccgggaagcaccacttcgtggagttcggcaacatgcacaccagcgccatggccatcctcgtccacgccatcatctacttcgccctcatcgcgctcttcgtcatcatcatcggcgtgcacatcaccactgactagacaccggctgagctccatcaccccggccggccagctccaattaagctgctcttcctttttctttttttcatccatctgactcccgcctctctgttttgttttgttctggtcttgctgcttgcaagtacttgtagtagtgtatgtgatcatgttcgtttgttgtccttggtaattaaactcgcgcgtatgtagctgccttattaataaagagatgtgtacttaattttcaaaaaaaaaa

SEQ ID NO: 50 - DNA, 1113 bp, Triticum aestivum
tccaccccacccccacccggagggagacaagacagccctcgcacagctagctcgcacctcattcccatctcttctcacttgttccagccagccagagctctcgcactcctctgccgctataaaatcgagagcctcccgggcgagccgctctgtatccagccagcagcaggcctcggcaactacttggtttttgttcctctctgagtcgcggcaaggcaatcaaccgaggccggctggtcggttgaggaaggaggccgggggcgcggcatggagtccggcggtgaggagcaggcgaggcagaacggccatggcggggacggcggcgacccggcggagtggaagaaggtggccgagctccgggccgtggtggaggcgcaggaccccgcagccaaggaggaggacgacttcatgctgcggcggttcctgcgagcccgggaccacaacatcagcaaggcgtcggcgatgttcctcaagtacctcgcctggaaacgagccgcccagccgcgcggctccatcactgaggccgatgtgcgcggcgagctcgtgcaggacaagctctacgtgcaaggcttcgacaagacgggccgccccatgatctacctcttcggcaaccggcacttcgccgccaagcgcgacctcgaggagttcaagcgctacgttgtctacattctcgacaacacctgcaccaagttgccggcggggcaggagaagtttgcgtccgtggtggacctgaaggggtgggggtatgccaactgtgacattcgggcgaagctggcggcgttggagatcatgcagaactactacccggagcggctgggtcgggtgttcctgatccacgtgccttacgtgttcatggcggcgtggaagatggtgtaccccttcatcgacgacaacaccaagaagaagtttgtctttgtagctgacaaagacctcgactccacgctccgggacgctatcgatgtatctcagctgcccgagcagtacggcggcaagctcagacttgaggggtacaagagctcgtcgacatgcaactgattcatgtattatggatgtccaattgtgcgcaagtatgtaacattgccacgcttgataagtataagtaatacttctcca

SEQ ID NO: 51 - DNA, 1781 bp, Sorghum bicolor
atcccctcctccgccatcccctcgctctccctctcccctcaacccagcgccccccctaccccgccgccgctagggtttctcctcccctccccgcccacccccaaatcatccccgaagcttccagtgcctcgcgccgcagccatgagcgacggcaaggacgccctcgacctctccgctatcggcgccgccctccccaactcggccgagctcagcgcggaggacaaggctcaccttgtggcgtcgatcaagaacacgctcgagggattggcgtcgcggcataccgacgtgctcgagaacctcgagcccaaggtcaggaagcgcgtcgagaagctcagggagatccagggccaacacgatgagcttgaggcaaagttttttgaggagagagcagctctagaagctaagtatcagaagttgtatgaaccactttactcaaagcgttacgaaattgtcaatggtgtggtcgaggttgagggtgtcacagaagaaagtgcagctgaaactcctgcagagcaaaagggtggagatgagacctctgctgagccaaaagaagaaaaaggtgtaccagctttctggcttaatgcaatgaagaatcatgaaattctagctgaggagatccaggagagggatgaggaagctctcaagtacctcaaggacatcaagtggtacaggatcagtgagccgaagggctttaagcttgaatttcactttgatacaaatccgttcttcaagaattcagtgcttacaaaaacatatcacatgattgatgaggatgaaccaattctggagaaagccattggtactgacattgaatggtaccctgggaagtgcttgacacaaaaggtgctaaaaaggaagccacggaaggggtcaaagaacactaaacctatcacaaaaactgaagattgtgagagcttcttcaacttcttcagtccacctcaggtccctgatgacgatgaggaaattgatgaggatacagctgaacagttgcagaaccaaatggagcaagattatgatattggatctaccatcagagacaagattatcccacatgctgtctcgtggttcactggagaggctgctcaagatgaggactttgaagttatggatggtgaggatgacgatgacgaagatggtgatgatgacgaagaagacgaagacgacgaggatgaagatgatgatgattatgacacaaagaagaccaagggaactgctggaggggaagggcagcagggcgaacgacctgccgagtgcaagcagcagtaaggtggtgcgcatcgaatattggcaggcattggttgtggagcacttagtttggttctgcttgatgcaatgtcattgagttggttttgtggagcccttgagggggcacttgttggttttatggaattggcggggggatttttctgggacatggtgttatatgtggtagttttgtcagttgctgtattgggtattcagatattatatatgtggtcttcttatgcttggagtgaagatggttaccaccctggtatgtcttactgtgcataccactggcatggtgtgctgtactttcatcaagcgtgacgtgccgctgagaaattttgctctaggggaaaggctagccttttgcccaaaaatgttttgcgaattgcatcttgcacatggtcttgtatttaccattttgtccgttgttacacaatgacctagtcgttccagactccatttcagcagttccgagttttgaaggaaattcagctcggcaacttatagaaagaaaataaagcgatttgtgaagt

SEQ ID NO: 52 - DNA, 959 bp, Sorghum bicolor
atggccgagagagactgagagagcgctagagcgagcaccagcaaaccaaaccaaatacgaaaagcatgcaggccacatgcgtgtgatgaggtaatagctgcaggctcacgcctcacctagcttctccggctggccttcgttgttccccagcaatttcgtcagccactcctccatatatccagccacaagtcaaacacaagacacacaattaattaagcgatcgatcatcatcaggattcaggaggccaggcggatcgacgacgacgagatgtcggactggggccccgtggtgatcgggctggtgctgttcgtgctcctctcgccggggctgctgatccagctccccggccgccaccacttcgtcgagttcggcaacctgcagaccagcgccgtctccatcctcgtccactccatcatctacttcgcgcttatcaccatcttcgtcatcgtcatcggagtgcacatcaccaccggcaactagctatctacctacctataatatcatatctcgattcaatcaccaccttgattgcttgttgtagattcaatcatataaatcgtcgatcctattcttcattcgcttctttctttctttctttctttcaaattcatgcatctgtattactacatcatatatacatgtcttcctacctacttctgactcctctctgtccttcatcagcatactagagtatactgtcgtgtatgtactatgtatagtacggtacggtggatatgtaaaggctttgtttgtttgttttgttttttgcccctccgatccccttgcaaataaaaggatatcggaccaactctttacttgccttctccaagcttctagcatttctcttgtaacaactagaatatgtaggagcatatgtatgttattagcttctatatatatgtattgtatgatccattctttgagtatgctaattacgtctctaactaagggtactttc

SEQ ID NO: 53 - DNA, 750 bp, Zea mays
caaacgcctctctctctctctctctctctctctctctctctctctctctctctctctctctctctctctctcggccgccggccctccgtcgcattcaacacgtacgccatggcgcgcctgctccgcgccgccgccgtcctggcgctcctggccgtctccaccgccgcgctgtcggcgccggcgtgggcgggcggcgtgtccgccggcgacctggcccatctgggcgccgccgtcgtgattcggcgcggcggcgggcgggcgtgccgcggcggtacgacggtgggcgagtgcatggagtacctggacgtggacgccgagggcgaggccgacgtcgccggcatggccacgggcggcagcaagcgccgggtgctgcagggcggctccggctacatcggctacgacgcgctgcgccgggacaacgtgccctgctcgcagcgcggcgcgtcctactacaactgccagcccggcgccgaggccaacccctactcccgcggctgcagcgccatcacccagtgcaggggctgatcgatgcatgcatggtttcgcattccattctccggcagcagggtaaatcggttgctgctagcttcattcatgcatgtgtgtggtgcttgattttcttttttggggtctttaattgtcgtccgtcgattattgtggtgcagtggagatgtgtctgtgctgttgctagcatccttttcaggatgaatctaaaagtaataataataattatatatgatgatcctgtaa

SEQ ID NO: 54 - DNA, 1138 bp, Glycine max
ggagccttatcgttttactacgctctcttggactcagttcagtttcacgaccgatcctacaatggcgacagtcacgttttccttttccgctaaaaccctaactctaccttatcaccccaaaaccccaatctccaactttaccccggtaacgaatcttcgcctccctccttctatcgtgacccgaacccgcaattgtaaccggattcgggcggcgctggatggggatttctcggcgaaaaggagcagcagcagcaacaacaacgaccagagggagacgataatgttacctggttgtgactacaaccattggctgattgtgatggagtttccaaaggaccctgcacccacccgtgaacagatgattgacacgtacctcgacactcttgccactgtcttgggaagcatggaggaagctaaaaagaacatgtatgcctttagcaccaccacttacactggatttcagtgcactgttgatgaagcaacctccgagaaattcaagggtttgcctggggttctttgggtactgccagactcctatatagatgttaagaataaagactacggaggtgacaagtacataaatggggagattattccttgtaagtaccctacctaccaaccgaaacgtagcgcaccaaagaatgagagtagaaggtatgagagacggagagatggccctccccctgaccgcagaaggccaagacaagaggccgctgcctccgattcatcctctacatgagccttgcaggtgagtttcagttttgctgatagtaactaatgccaagtgaaagctgctccttatcacagctctatcatgctcatggtcattttatcaaatagaagattgaacttgggttgaattctcatcagatgcatacaatgtttcttgcaagctcaaactggtattttcacaattcatcttgaggaatatgtgcttttggactatgagtatgacatgtgggacaattgttaggtttatttgtctgtgtaatttggagagctacttatcgtgcaaccagtttgttttcgtgataactttttctgcaagtttcatggcagctacaatattaacacataaagtgactgatatgaactgtacaagtttagataatatgcatatatagccttttgtcattat

SEQ ID NO: 55 - DNA, 1234 bp, Triticum aestivum
ccacgcgtccgccggactactgtcgttgttaccaaccagccggcaatctccatccacaagctctaaagaaagaaacgggcaatcagaaagccttctcttccaagaagtgacgcgggagaggggcagagcggcgcaagccatggccgagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaaggatttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcacaccatctacattctcttctctagaagcgaaatcccgacagcgaaggaagatcaagaaatcacggatctcgcggacctgtcgactccccttccagagtggttcaccgaggaggatcttgcagtctacacgtccctctatgagaaatcaggtttcgtgtatccactgcagatgccatacaggtctctccataagaggcaaccaatcgaagacccaaaattcgaagtcccggtgttcgtcgtcatgggggagaaagactacgtgatcaagttccccggggtcgaggccgtgttgaaaaatggcaccatggagaagtttgcgccggatctgaagatcacttacatccctgaaggaagccatttcgttcaggagcagttcccggacaaggtcaacgagctcctccttggcttcctcaaggaccatcctgtggcttgacacacggggtctataagtctattatgcttggcctgcacttggttgagcaccctactccgtgcacattctgcagtgttatgaacatatgatgcgtgcttcctgtgaagtgaaggatatgctagtttcatcaacaacctttaataa

SEQ ID NO: 56 - DNA, 1148 bp, Triticum aestivum
ggcgtcgtctcatccttcgccgcttctctcgtgacacatcggcacttggctgcgtcgaggcgctctgcagttcgcggccagctagcctgcagtaccgcgccaccaccctccggccatggccgcgccccgccccaccgtcctcgtcaccggcgccggcggccgcacaggccaaatcgtgttcagcaagctcagggagagatccgaccagttcgcggcgaggggcctggtgaggtcggaggagagcaagcagaagatcgggggagccgacgacgtctacgtggccgacatcagggaggcggagcacctggcgcccgccgtgcagggcgccgacgcgctcgtcatcctcaccagcgcctcccccaagatgaagccggggttcgaccccaccaagggcggccggcccgagttctactacgaggacggagcctaccctgagcaggtggactggattgggcagaagaatcagattgatgctgccaaagcagctggtgtgaagcacatagtcttggtgggatccatggggggaacaaatcccaaccatccattgaacagccttggcaatggcaatatactggtctggaagcgcaagtctgaacagtatctggcagacagtggagttccttatacaatcataaggcctggtggtctgcaagacaaagatgggggagtgagggagctgattgtcgggaaggatgatgagcttctccagactgacactaaggcaattcctagggctgatgtggctgaagtttgtgttcaggccctgcagtatgaagaggtgaagttcaaggcattcgatttggcttcgaagcctgaaggtgagggcaccccgacgaaagatttcaaagcgctgttctcccaggtcacagcccggttttgaggcatcagttaaggagcataagtgcatttctaagcttataaggatcttaatgtctttgagtgtgtatccttgtgcattatgaagttgctgactgatgtaattgcacaatcggtttatcaataatgctgaaaatagcctcctatcgatgcatggagattggagaagcaatttatgcattttcctgagatttttctctgaggagaaggagtcagcaaacaattgagaatacattgatacagtttaacggatatgactatcttcttttcac

SEQ ID NO: 57 - DNA, 1665 bp, Triticum aestivum
agattggatgtacgccccttccctcccctgccccggtcacaaagctcattactttttctcgtgtccgccttccttcctcccctgcaatcctttctctgttccgctgtaaaggcggagcagcctggaacagggttgttggatctgaccggctatctctgagccgaggagactcgccgccagatgctgcccaccggcaggagcaggcctcagcccaggcccgcgcccagatcttggtccttctcagacatggacttctctgatccgaagcgcaactccaggtacctcagcaagatcatcatggtcgcgctcctcacggccatgtgcgtcgtcatgctcacccagccgccctgccataggaaggctcccagcgtgttctccatccatgaactcggagtaacacatgtgttggtgacgggtggcgctggctacataggatcgcatgcggctcttcgattgctcaaagactccttcagagtcaccattgtggataatctctcaagaggaaatatcggggcggtcaaggttcttcagaacttgtttcctgatcctgggcgattgcaattcatacatgctgatttaggcgatccaaaagctgtcaacagaatattcgcagagaatgcatttgatgccgtcatgcacttcgctgctgtcgcgtatgtgggagagagcacgcttgagcctctgaggtactatcataacatcactgcaaacactttggttgtgctagaagccatggcgacgcacaatgttaaaaccctgatctactctagcacatgtgccacctacggggaacccgagaagatgcctatcactgaagaaactccccagtttcctataaacccatatggcaaggccaagaaaatggcagaggatatcattttggacttctccaagtcgaggaaatcagacatgtcggtgatgatcctgagatacttcaacgtcatcggttctgacccagaaggaaggctgggtgaggctccaccacccgaattgcgtgagcatggccgtatatccggtgcgtgcttcgacgcggcactaggaataatcccaggcttgaaggtcaaaggtaccgactacgaaacggccgacgggacttgcgtaagagattacatcgatgtcaccgacctggtggatgcccacgtgaaagcgctcaacaaggcagagagaggcaaagttggcatatacaatgttggcaccggaagaggtaggtcggtgaaggagtttgtggaggcttgcaagaaggcgaccggagtcgacatcaaggtcgactacttccctcgccgccccggtgactatgccgaagtgtacagcaaccccgcaaggatcaaccgcgagctaaactggacagcccagcacaccgaactccaggagagcctcagggtcgcgtggacatggcagaagaagcaccggagtggctatgcagactcgggtcgatatattttttgactcaactcacagagatagcagttacacataatttatatagcgtgtatggtcatttgttcaattcctgggattttatttatatatgggaagttcaccagttcgttataaatatcgacatgttctttcactgaacagtaatggtcgccagctattaagttcatgaactcaggccagatttttgctgaactctacagcaaatgcagacgaggtccatctgca

SEQ ID NO: 58 - DNA, 1810 bp, Triticum aestivum
aaaggatccttctccgatcctcacgaaaccgccgcgcccttctcccacccgcgcccttccccgctgggccatgcccctgccgccgccgcagcagcagccgcgatggcgcgttgcggcgtggaggtgatcgccagcaggggctgctccaggctgatcctccccgggatgcagccctcctcggcttccgccgcctcctcctccgtctcggcctcccgctccgccgcggccgcccggcgcccgcccgacggccccttcgccggcctggtcgtctgcgtcacggggctgtccaaagaggcgaggagtcaggtgaaggaggccgctgagaggctgggaggcgagtacagcggcagcttgcaccccaaatgcactcacctcgtggtgcagagcttcgccggccgcaagtttgagcacgctctcaagcatggtcccaggaatggcctttttgttgtcacgctgggctggtttgtcgattgtgttcgaaggaacatgaggctggatgaatccttgtacagtatcaagaacattggggagaacggtctgctgctcggggaatccaaccggcttgttggactgcctgtcaatgagaagtcatgccttccaccaatgatttttcaagacaaagcatgctcagacacaacacataagcgccagcttcaggctcatagagaagaacctgaagatgatgtgttcgtttttacgaatgacacaatctacattgaccctgggatatctggtgagatgaagaagaagatatcggatgctgctacgagtgaagatgcaaaattattggaccactggtttattggttgtcatgccacatatgttgtgtgtgaggatgcttctgtcaagagatatgttggtcactcagataacattgtaacaccgttttggatcttgaaaacagtgaaggaaaagaacttgcagcgcctggtccatttgtcttcagacctagctagacatgtcgcagtggttctcgaaaatttccacacatctcgagagaatacgaaacttgggagtgttccttctcttaactccagcgagctgccaacccaaggggagatagatgagactcatcaggaaaggcaaaaatttgtcgaggcagcgaaaaaggatattcgagaccgtcgtgttcgccgtatgcagtcatgtgaagtaccaatccatccgctcacacctgtcacacttctggattcaatctgctggacaatatctgagccggtttcatctgcaagtatttatatggattcttcatggtctgaagatgccgatgagcagcaaagcactacttattttgatgcagatggggatggaaaggatcgagaccagtcagctgataatttgtctcgcccgctaagagaaagtgagagaagcgaggtgatttttaagaaccatttctttaccatactcttccctctcgatcgttttggcgagcttggaccttcttcgaggacattcttcagcaatggtggcttcacacgcgaacaagtgttggatcacatctataatttctaccaggagaatatgtcaaccgacgagataaatgtagccctgcacacggattcacggcatgccgatcgacttcgttccctgtacgcaagcgctgaatgcgcagaacgaggctttgtagtagcattcaaaagaatagattttttgggaagccggagaagtttcgaggcactaaagcgccttagcagagagaacaatagcaatgtatatgagcttgtgattagggcatgaaccgcacccctactcggtgccatttagtaaaatttgtttgttgcttacaggatgtactgtgccggtaccttta

SEQ ID NO: 59 - DNA, 535 bp, Triticum aestivum
caccagagtgtcaccactcacagctgagctgaaagcaatagcaccaagcacctagctcagcagcttggatttcacagcaccagctcccatggccagcttcgccacccagctgctggacgtgttctacgacctcgtccagcgcgtcaccggctacagcgcccgcgccgaggacgacaaggatctacagaaacatagcaacttggcaactacggaggctttccggacggaggaagttatcgagatcaggtccagaaatcacccggatgtaccaggagggtcaggcgctcaggtgaattaacatggatggtatgtagagctagctagcctctacgtacggcagagacatccgtgtggtttctgataggtcatagcctcaaaatggtgtgcgcaatgtttcagtttgttacaatgttctatcgtgtcttgctatgttaattaacttcctgatcggggtttatgtgtgttgttctcgtgtgcttgtaacttgatgaacttgcttgttaatttctaccgatcaagtgtttgttttctctca

SEQ ID NO: 60 - DNA, 1335 bp, Triticum aestivum
ctctcgtctccgcgcgcatcttccactcggttcccacttgcaagtgcgaacacactctgcgcacgctagctacgtacgagcgctgaaggcatggccagccacttcgtcctcagcaccggcgccaagatcccgtcggtcgggctcggcacctggcagtccgagcccggcgttgtcggcgacgccgtctacgccgccgtcaaggctggttaccggcacatcgactgtgctcaggtctacggcaacgagaaagagatcggattcgccctcaagaaggtgttcgacgagggcataaccagccggcaagatctcttcatcacctccaagctatggtgcactaaccacgcgccggaggacgtgccggtggcgctggacggcacgctccaggacctgcagaccgactacgtggacctttacctcgtacactggccgatccggatgaagaagggcgccggcttcagcccggagaacgtgatcccggccgacataccggcgacgtgggcggcgatggagggcgtctacgactccggcaaggcccgcgccatcggggtcagcaacttctcgtgcaagaagctggaggatctgctcgccgtcgcgcgcgtgccgccggcggccaaccaggtggagtgccaccccgtctggcagcaggccaagctccgggacctctgcgcgtccaaagggatacacttctccgcctactcgccgctgggctcgccggggacgttcaaagcattcaccgtgctggagcacccggtggtggtgtcgacggcggagaagctggggaagacgccggcgcaggtggcgctgcggtgggggatccagtcggggcacagcgtgctgcccaagagcacccacgaggagaggatcaaggccaacttcgacgtcttcgactggtccattccgagcgacctgttcgccggcttctctgagatcgaacaaacaaggctgatccgcgggaaattctggactcacccggaaggcctgttcaaatccgaagaagagatctgggatggtgaaatatagtctgaacagaacagtcactgttccttgagcggaggctgccaagtgctgccatggcaacagaataatgcggtagtaataatcagcagtcgaaggagctcgagcttcgctgctgctggtatgtagagcaatttgcatgagtgatttgagttcagaatcctccctggaagttgtaaaatacaaatagctttgtcctgctctgtcatttttgttttgatgcattagtcaatccaaagtcattgtgaaaaaaaagcagatagaacagttcattgcagtgtcaccaccaacaaggccttctaatttactgcaaaaaaaaaa

SEQ ID NO: 61 - DNA, 1806 bp, Solanum lycopersicum
ttagaactaaaacccaatgcatatcaacttctccctttgagctcatttattatcacaatttatttaaccattttttttgttcaaacaaaattattatcaatggcaaatttgatttcaaaatcaacaaaatttaaccattttcttcaaaacacaagagtttgtttcttacgatcgtttacaacttctgccgccggcgccggtgctggtggttatattaagccggcggggagtttttccggcgagtctgccgccatttttcggccggaacgttaccagtccggtaaagctggagagcaactagatacaattgactatgaagaagatgaaaatcaggtgatggattttcctggtggaaaagttccaattactcctcaaatgaaatttatttcggagtcgtctgagaagagattaccttgttatagagttcttgatgatgatggttatccacttccagggacaatctttgaggaggtgagcaaagaattggcaataaagatgtatagttcaatggtgacacttcaaactatggataccattttttatgaagcgcaaaggcaggggaggttgtcgttctatctcacaactgctggagaagaagctatcaacgtagcatctgctgctgctctttccttagacgacttcgtgttacctcagtacagggaagtaggggttatattatggcgtggttaccccttggaacaggttgccaatcaattgttcggaaacaagtttgattatggaaaaggaaggcaaatgccctgccactatggttctaatgagctcaattacttaactgtttcttcgccaatagcaacacagattcctcaggccgtgggcgttgcttattccctcaaaatggaaaaaaaggaggcttgcgcggtcacttattttggagatggtagcaccagtgagggagattttcatgcagcattaaactttgcagcagtattggatgctcctgttgtctttatatgccgcaacaacggatgggccattagcactcctataaaccaacaatttcgaagtgacggaatcgcctctagaggacaagcgtatggtgttagaagcattcgtgtagatggcaacgatgccttggcaacttatagtgctattcgtgcagctcgccaaatggcaattaaggaacaaaggccaatattagtagaggccatgacatatagagtagctcaccattcaacatctgatgattcaaccaagtatcgacccgttgaggaaatcgaacactggaaaacagcaaaaagtcctatatcaaaattcagaaaatacattcaaagaaatggctggtggaatgatgaaaatgaatctgaacttcgcggagacatcagaaaacaggtgttgcaagctattcaagcagcagagaaggtggataaaccttcattgaaagatttgtttacagatgtttatgacaaaatgccattaaatcttcaagatcaagagaaatttgttaaggatgctgtaaaaagatctccaaaagaatatccttctgatgttcctatataagcttatagtgtgttatgataaggggcagagctacagcttcgcaattaattcattcgtgttgcgtaatatgtataattaattaattagtaaactctgaatcaaaaactcataaactcaaaatctcaactcggtttctgaatagctagctagaaagcaactctgaaattgtcaggttctatgaagttatatatataaatagctacattataaacaaaagttctgaaacaaattcttgagtatatgttaatggcattaactttctctctgtttaatctcatgattttacgt

SEQ ID NO: 62 - DNA, 1181 bp, Solanum lycopersicum
acccactttattttgattcttcttcatttctccattacaaaaaaaatcctcttctcagttctgctgagtaaaaaaatcacacaaaaatgggcgatcagatagctaaaggtgaagaattcgtgaagaaagctgagaaaaaactaagcggttggggactgttcggctccaaatacgacgatgctgcagatttgttcgataaagctgcgaattgcttcaaactcgctaaatcatgggatcgagctggagcagtatatgtcaaactagcgagttgtcatttgaaattggatagcaaacatgaggctgctggtgcttacgctaatgctgctcattgctacaagaagacaaatatgagagaggcaatatcatgtctagagcaggcagtacacatgtttctggacattggaaggctaaatatgtctgcaagatattacaaggaaattgctgagttatatgaacaagagcaaaatttggagcaggctatcacttactatgagaaagcagctgatcttttccagagtgaggatgtaacaacaactgcaaatcagtgcaagcagaaaattgcagaattctctgctaaattagaaaaatatcaaagagcaattgagatctttgaggagatagcacaacactccatcaagaacaacttgttgaagtatggagttagaggtcatcttctgaatgctggtatttgccaactttgtagaggtgatgttgttgcaattaacaatgcattggagcgatatcaggaactggatccaacattttcagggacacgcgagtgcaagttgctagtggatttggaagctgcaattgacgaggaagatgttgcaaagtttactggttgtctcaaggaatatgatagcatgacaaagctggatgaatggaggacaacacttcttttgagagtgaaggaagcgttgaaggcgaaggagctagaggaagatgatcttacttaaattattcttatatgaaactggtttgtaaattgcattatttgtgattcctattattttctacttggtgattgttttctcatctcatgctacttaatttttaacaatttcattttgtactggttgagtttgagttccatattgagttaagactaccaacaaggttttagcctggcagctaatattattagtttcacacaatattaatattagttgattgagtttgtt

SEQ ID NO: 63 - DNA, 3273 bp, Zea mays
cggtatcccctggacatgccactcaatgcattcagagggcgtagctgctcagctgccactgctcactccccgccattaattcgtagtattcaataccacagcagtacctctctctctctctctctcaccttctatctaggcatctcctcgtgacctcgtcactgtcttgcatttcatatacagttcacagttcacgctgcagggcagtggccatagagtagctcgtgagcgagggagcaaaaaccagtgaagaaaaagaaaaaaaaaacaacggggcaaaacgaaatgctgtctttttctcgttcggccatcctctcctacctactgtggtgtcttctatttctcacattggcaagcagcaatggcgcggtcgccacagcaaagccgaaggctgggtgcgggtacaagctggtctcccttgttcagctgcccaacgggggaggccttgtgggttacctgcaggtgaagcagcgcacctccacttatggtcctgacatccctcgcctcaggctctttgtcaagcacgagaccagggagagggtgcgcgtgcagattacagatgcagataagcagaggtgggaggtcccctacaacctgctcccaagggagccagccccacccgtgaccggcggcaaggtcacgggcgcccccttcacgggcgccgagtaccccggcgaggagctggtgttcacctatgggcgcgacccgttctggttcgcggtgcaccgccggtccactcggcagccgctgttcaacaccagcgccggcgcgctggtgttcaaggaccagtacctggaggtgtccacggcgctgcccaagaacgccgccctgtacgggctcggcgagaacacgcagccggggggcatccggctgcggcccaacgacccctacaccatctacaccacggacatttccgccatcaacctcaacaccgacctctacggctcgcacccggtgtacatggacctccgcagcctgggcggccgcggcgtcgcgcacgccgtgctgctgctcaacagcaatggcatggatgtgttctacaggggcacgtcgctgacctacaaggtcatcggaggtcttctcgacttctacttcttctcgggcccgacgccgttggccatagtggatcagtacacgtcgatgatcggccgtcccgcgcccatgccttactgggcattcgggttccaccaatgtaggtgggggtacaagaacctttcagtggtagagggcgttgtggaaggttaccgtaatgcccagataccgctggacgtgatctggaacgatgacgaccacatggatgccgctaaggacttcacactcgatccggtcaactacccacgccccaaactgctggcgttccttgacaagatccatgcgcaaggcatgaagtacatcgtcctcatcgaccctggcattgccgtgaacagctcctatggcgtctaccagcgtggcatggaacgtgacatctttatcaagctggacgggcagccatacctcgcccaggtgtggcctggccccgtctacttcccggacttcctcaacccgaacggtgtgtcgtggtggatcgatgaggtgcggaggtttcatgatctggtcccggtggatggcctctggattgacatgaacgaggcctccaacttctgcacgggcaagtgcacgattccgaagacgcaccagtgccctattcctgacaccaagacaccatggctctgttgcttggattgcaagaaccttacaaacacgaggtgggatgagccgccgtacaagatcaacgcctccgggcagactgcccgtctcggcttcaacaccatcgcaaccagcgctacacactacaacggcatcctggagtacaatgcgcacagtctgtatggcttctcgcaggccattgccacgcatacggcgctgcaagggctgcaggggaagaggccgttcatcctgacccgctccacgttcgtcgggtcgggggcgtatgccgcgcactggaccggagacaacaagggcacgtgggaaaatctccgttactcgatctcaaccatgctcaactttggcatcttcggcatgcccatggttggctctgacatctgcggtttctacccgtcgccgactgaggagctctgcaacaggtggattgagctcggggccttctaccccttctccagggaccatgccaacttcgcgtcaccgaggcaggagctgtatgtctgggactccgtggcgaagtctgctcggaacgcgctcggcatgcggtacaagctgctcccctacctgtacacgctcaactaccaggcgcacctgaccggggcccccgtggcgcggccggtgttcttctccttccccgacttcacgccgtgctacgggctgagcacgcagttcctgctcggtcccggcgtcatggtgtccccggtcctcgagcagggcgccacttcggtgagcgccatgttcccgccgggcacctggtacaacctgttcgacatgagtaaggtggtggtgtccaggagcggggccccagtgaagctggacgcgccgctgaacgagatcaacgtgcacgtgtaccagaacacgatcctgccgatgcagcgcggcgggttcgtctccaaggacgcccgggcgacgccgttcacgctcgtggtcgcgttcccgttcggggcgacgcaggccgacgcggagggcgcggtgtacgtggacgacgacgagcgcccggagatggtgctcgcggaaggccaggcgtcgtacgtgcgtttccacgcgagcgtgcgcggaaaggccgtgacggtgcggtcggaggtgctgatgggaagctacagcctgcacaaggggctggtcgtcgagaagctctcggtgctgggtctggagggtaccggcaaggaccttgccatccaggtggacggcacggacgccactgccgtcgcgacgtcgagcccttactttgcagcaggtggcaacgcgaagctgcagggggaagaaggcgtcgaggatagtaagaacggcgtcatggtggagatcggcgggctggcattgccgctcgggaagagcttcaccatgacatggaacatgcggatcgaagcataggtcgagtgatgctgtgcttccgtctccatgaatttgcttaaagtcgtgttccgtttctgatttagatgggtagatcctgccatgctgatgtgcagtcagaatccatattctgaaaaatctgtcatcagggggtgctctgtgcaaggagcagagtacaacattgctgcaacaataaaagattgaatctttgacgtttgactagta

SEQ ID NO: 64 - DNA, 1044 bp, Zea mays
atcgcaagatgtttgtttccattccatcggtggcacgagacaggagacgccaaggccatagctagagcctagagcagcagcagaggcttgacctgaagctccacccgccatggcattcacgcccgctacggcctgctgcaaggcttccctggcgctggcaccgcgggcgtcgccccgcggcccggcggcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtcgccaagggcagcgtgccgccgaacttcaccctcaaggaccagaacggcaagcccgtgtcgctgaacaagttcaagggcaagcccgtcgtggtttacttctaccccgccgacgagacgcccggatgcacaaagcaggcgtgcgcgttcagggactcgtacgagaagttcaagaaggccggggcggaggtgatcggcatcagcggcgacgacgcggcgtcgcacaaggcgttcgcgcagaagtaccggctgccgttcacgctgctgagcgacgaggggaaccgcgtgcgcaaggagtggggcgtcccctcggacctgttcgggacgctgccggggcgccagacgtacgtgctggacaagcagggcgtcgtgcagtacgtctacaacaaccagttccagcccgagaagcacatcggcgagacgctcaagatcctgcagaccctctgatccgatcaacctcctcactgttctgggccatgctctgcattcgtcgctgtaaaagtaccggactatgtagtagtgtagtgtatgtaaccaagagctgatgacctgatgttttgttccatccttcagtgagtctatctatcacacgattctggctcgtttgatcgaccagcatcttcctgtttgtcatggtcagtttcacttgtattacaactgtacttttggtcgacagtctcagatgttgtagctcgttcaacccaaaccggtcaggattgtgatcg

SEQ ID NO: 65 - DNA, 2602 bp, Zea mays
cataacgacatggcacctttgcaccacgctactgccctgcctactactagtactgtctctttgaaccactttggtggcctaatcccgggcccctctgatgatggcttatgagccccagctttgcgcttgcaggcactgcacggtctggttcttgttcctgagcagttgagctgcgcacaccgacttcttttgcacaaggtacagcagcgcaggcgcggcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcggcccggaaccgcgcgtccgtcgcccgcagcctgctgctggagtgcgagtgcaggaaccaccgccccggcgccggggagaacacgctgctccgggccgggtacggcggctgggtgctctacgcggcggcgtcggccggggacgccgcgttcgtgcgggagctgctggagagggacccgctgctcgtgttcggcgagggcgagtacggcgtcacggacatgttctacgcggcggccaggggcgggagcgcggacgtgttcaggctgctgctcgaccacgccatgtcgccgaggtgctcgacgagttgccggaacggcgaagccagcgccaggcgcagctccgtgttccggcttgagatgatgagccgggccgtccacgccgcggcgaggggcgggagcgtggagatgctcagggagctgctcgacgagtccagcgtgtcgacgtatctcgacatccgtggatccaccgtgctgcatgccgccgctgggagagggcagctgcaggttgtcaagtaccttgtggcctctttcgacataatcaattcgactgataatcacgggaacacagcgctgcatgtagcggcctaccgagggcaccaacctgtcgtggaagccttggttgctgcgtctccatcaaccttgtcagttgtcaacaacgccggtgacacgtttctccactcggcagttacaggattcaggaccccaggattccgacggctcgaccgccagttggagctgatgaggtacctcatacgcgagagaaccgcggatatccagaagatcatcaacctgagaaacgacgcgggccttacagctcttcacctggctgtggttggctgcgcacacccggatctcgtcgagctactgatggccaccccgtccatcgacctgaacgctgaagacgctaatggcatgaccgcgctggcgctgctgaagcagcagctgcgctcagcgacgtccgaccggctcatcaagcagatcgtctctgccggaggggtcttgaactccagcatcctgagaacccggtcagccatcgcttctcagatcaagatgcagggcgggatcgcgagcagccccggcaccactttcaaggtatcggatgcggagatattcctgttctccggcatgggagcggcggagtctctgaggccaagctcctgctccagcaacgggaaggatgatgaccctactcacgcagacgcagactgcgccgagaaccgtggatcgtcggagaagaggctgagctccgcgagccgggccaaagaccgcctcaagatgatgctgagatggcctcgccacaaggacaagacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtccccgacggacactttcctgaggtcctcggtatcgtccacgccgcagccgctggcgaagctgaaggacatctgcctcgacgacgagatctccatggtgacgccgcccgccggcaggctgaaggatagtgacgacgccatggaggacccctcgtgctccaacaactcgtccatggacgacggctgtggcgccgggacggcagagagcgcggcccggaagcacgggtgcggcaacgggaggctcatcaacatctgctttggcgcgcagggcctcaccgtggaggactcggcgagcgggcagcagacgagcaagatgttcaagcagcagtgcctcagggtgtcctgattgacggcgtggtgtctcgactacaacagcgtggtgtgattggtttggtgtctcgcgtgcagctatgtgtgcttgtttgctttgctccttgcacagccagcggtgaactggtgatccaatgaacttgtgcttgtgttaactgtgacgttgacgaatccacagctctttaacttcctcagtgtcaggtcgtgcattcttcaaacaaatcaccgttgatcaatcacttcctcg

SEQ ID NO: 66 - DNA, 811 bp, Oryza sativa
tcgcgctataaaacgccacgccgtggaggtcagctagcgcaactgagcagctagctcgatccagtgttcaaggttcagccgagttcgatcgaaaaaccaccgtgcgtgtttgttcgatcgatcgatggcggctcggggaagaggcagtgcatgcaacggggcagccgttcttggcgcggcggcggcggtggtgatcgtcgggttcctcgtgatgagcgccgcgccgctcgccgaggcggccaggtacaccgttggcgacagcagcgggtggaggttctacgccgagggctgggccaagggcaagaccttccgcgccggtgacgtgctcgagttcaagtacaacgcggtggtgcacgacgtggcggccgtggacctggcggcgtaccggagctgcacggtgccgaagggcgtcaggaagatgcggagcgggcgcgacaaggtgacgctccgcaagggcacgcactacttcatctgcaccgagccggggcactgcaaggccggcatgaagctcgccgtcagggccatctagctagcctattctgttggctcgcaaaagaaaatggtcagtctgagctagtccgccctgttcgattgctcgttagtcttttctcaatgcgtagccatgtgtgtgactgtatcggttagtactcctactacgtttcatggtcagtttgccggcgttgtcgtggtcatgtttaattagttagtttggtctggttgtgatcttttcgtgctctgcaaaccgtgataagtatccatcttaatcgcaaaggtcatgataccaaattctcctggttaatccagatttaga

SEQ ID NO: 67 - DNA, 1114 bp, Oryza sativa
gggagaacgtacgcacgctagaattttttctggtatctacagaaatggaactgattccgtatagtagtagaaatgtagcatgagaattctaaccgggcgcgtacaaaatcgcagtcgtgctcgtctcatcccgctgtatataagcaggcgactcctgtgtacccgcgcacacgcaaaccatttgcatttgagccttttgcttgccttctctcctgtcctgactgcagcgagagatcagtagggagagggcaatggcattgacggtgcggctgcacacggcggtggcggcggtggccgtggccgtggtggtggcgatggggatggcggcggcgcagatgtcgccggcgggggcgccggcgccggcgggcgggatcagcccggcgtgcatggacgcggtgctcaacatgtcggactgcctgacgtacgtgatgaacgggagcacggcgcggaagcccgacgagccgtgctgcccggagctggcggggctgctcgagtccaagcccgtctgcctctgccagctgctcgccggcggcgccagctcgtacgacatcagcgtcgactacaagcgcgccatggcgctcccgggcatctgcggcctcgccgcgccgcccgtcaccgcatgcgcgcttcttggagtacctgtgcctatggcgccttctgcatcgccgatggcaggcctcgggccatctactgaaccacaaatgcctgagaaatcgccgtcggcctcgccgtccgagtcgagtaaccatgctcccggccgcttcaccgccctcgccgcggtggtcctcgccgttgcagccgccgggatggtttagaaaatgcctggattttcggccgatcgatctcaagatttagcccgacgattcttgtttattcttgccacacatttggctgtgtattaatttacaacacgttacagtacgtatgcgcaatgaacgatatttttctgctttgctttaaattcttataattaactagtaactcttccttgtcgtaagttgctagagcatatggtgagactatatgtacacacgtagtgatatctggccatccgcagtagctacttggggccttctgttaattattttcagtgtttaaatgcttggtttttgga

SEQ ID NO: 68 - DNA, 1298 bp, Oryza sativa
gcaaaaatctcagctcccacccgccgcgccgcgccgcgccgcgctgctcccccaaccaaatcccttctccatggcatccgccgtttcgctcctcctcctctcgtccccgcgcccgctccgccgcgcggcgccggtgccagcgctacgctcccaggcgcgccaccccttgctcctcggccacgcgggcgagaccgcgctcggggtatgggccacgcgcgcccgcctgcccgcgccgccgccgcgcgcctccaacccgaacaacgacaacgacaacagcggcgccgtggaggcgcccgaccgcctggtggccgccgtcgcctacctctacccgttcctcgacggcgtgcaccacggccgcttcctcctcgcgcagttcccgctcttcagcaccctgctcagcccgctcgcgccggccgcgcgcctcttccgctcctccccgctcacgcccttcctcctcttcctcaccctctacttcgccgtcgtgcgcaaccagcaggccttctcccgcttcgtccgcttcaacgccatgcaggccgtcgcgctcgacgtgctgctcatcttccccgacctcctcgtgcagtccttcgcgccctccaccggtggcgggatcggcttcgagctcttccagagtatggagagcaccgtgttcctcttcctgctcgtctgcctagtctacggcgggggcgcgtgcctgctagggaagacgccgcggctgccaatcgtcgcagatgcagccgagcgccaggtgatgtgatgagcttttgtcaaatcttgctggtgaaaaggaacaaaggaaaatgatatacacatccatctcgatgcctcattgatgttagtagatcgcaaattcacaagttcagtttagtacagtgattatttacagctgtagtaaccaatttaatgaatggagttacggaaggttggtacaatggcattacaaaatttacaatcaagtgtatgaacgaatgagttgaattgggaatttttagagatagcaatacatatactcgctatagaatatggaattctggactacatttacagatgatgaatgagaaattggggagtgtcctcaagacctcccctgaaggagcttcaatggtatatgaatggatgcttaggttagttaattgttgttgcaatataaataaaataattgcatcaattggggattgtggttgctgctaccaagttattgtctgaacttgatgatgtctgaattttctagtttggagaaaaagttctagcttttattgcaccgcctcttggttatttggatgggctcttcatcttcattg

SEQ ID NO: 69 - DNA, 1715 bp, Oryza sativa
acttgccctcctcactgaaaacagtaaacaggacacggttcagtgaccacacgaggttcacgagtacagtgacgcatacagagacatgggctccatcgcggccgacggcgacaagccgcacgccgtgtgcatgccgttcccggcgcaggggcacgtcacgcccatgctgaagctcgccaagatcctccaccaccgtggcttccacatcaccttcgtcaacaccgagttcaaccaccgccgcctcctccgctcccgcggcgccgccgcgctggacggcctcccggggttccgcttcgccgccatcccggacggcctcccgccgtccgacgccgacgcgacgcaggacgtgcccccgctctgccgctccaccagggagacgtgcctccctcacttcagccgcctcctcgccgacctcaacgccaacgcctcccccgagtccccgcccgtcacgtgcgtcgtcgccgacgacgtcatgagcttcgccgtcgacgccgccagggagttccgcgtgccgtgcgcgctcttctggacggccagcgtctgcggctacatgggctaccgctactaccgttccttcctcgacaagggcatcttcccgctcaaagaggagcagctgacgaacgggttcttggacgcgccggtggactggacgccggggatgagcaagcacctgcggctcaaggacttcccgtcgttcttccgcgcgacggaccccgacgagtacatgttccacttcgcgctccacgtgacggagcggctggcggaggcggacgccgccgtgctcaacaccttcgacgagctcgagccggaggcgctcgacgcgatgcgcgcgatgctgccgccgtcggtgtccatccacaccatcggcccgctcgggttcctcgccgagcaggtcgttcccaaggggagccccctcgacgcgctgggctccaacctgtggaaggaggacgactcctgcttcggctggctcgacggcaagccgccccggtcggtggtgttcgttaactacggcagcgtcacggtgatgacgaacgaggagctggttgagttcgcgtgggggctcgccaacagcggccacgacttcctgtggatcgtccgccccgacctcatccacggcgatgccgccgtgctgccgccggagttcatggagtccgtcggggggcgcggcctgctggcgagctggtgcccgcaggaggcggtgctgcggcacgaggcggtgggcgtgttcctgacgcactccggctggaactcgacggtggagagcctctgcggcggggtgccgatgctgtgctggccgttcttcgcggagcagcagaccaaccgccggtacagctgcaccgagtggggcgtcgccatggagatcgacgacgacgtgcggcgcgacgcggtggaggccaagatacgggaggcgatgggaggagacaagggccgggagatgcgccgccgggcgggcgagtggaaggagaccggcctccgcgcgacgcgccccggcggccgcgcgcacgccagcctcgacgcgctggtcgccgacgtcctcctctccggtggcaaggctcggtaggacaacgtgcactagtgccgcctgttgcatgctactccctccctcccataatacaagagattttgagtttttgcttgtaacgttttaccattcgtcttattcaaaattttttaaaattattatttattttaggaaaaagtacaaattaccccct

SEQ ID NO: 70 - DNA, 1311 bp, Oryza sativa
gcgactctccacggcgctgaagagctaagccgccttctcttcccctcacgtccacccaagaggccatccatctctctctctctctctcttgaccctatctcctcttcgccgctttatcctgcccatttaaatacccatactgtgcttcttggggagagagaaggggagagagagagagagagagaatggcattgcagcaacgaccggggatgctcggcattggctgcagcaacgtcttggcacgagcaagggtgcagcaatgtctagcagcggcgtcccactccaatatgccatgtctacccgtcctcctgcatgtcaatggcagcaagaagcagggtagcagcttcctttcttctcagaggatcggcttaagtaggaggaggaggaggagggacctgagcggcgtcgttgtcgcggaagtgagcgccgccgccggtgtcacgccggcgtcgtcgtcgtcgtcgcctggcggcatcagcgtcagcgatgttctttggccctccgccggtgcattcctagcaatggccgtgctgggaaggatggatcagatgatggcgtacaagggagtatcattgacaattgcccctctcggagcagtctgcgatgtgcttttcaccgctccaggctcacctgctgccaagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccagctgcaagcttgcctctcttgtttattgatggtccaaagtttcaccacttgcaactctggtatgccctttttcctggagctgcaggctgcataattctttgcttgattcaagaggtggtgatttacctgaagaagaatttcaagttttgattcaagcggtgcattacttctcgtagcaatgacatgactaaaattcaagattgtaccacaatttgctagaactgcattggggagaaatggaggaaatgcagatttagtttccttggtcttatttactaaacaggaagaggagaaaaagcagattgatcgatacctgattgtgaatttgtgatcacagtgcagaacatgcaaatatgaagtacataccaatatctcatttaatgaaatctgataagtgtacaaataaaattccttcttttgtgattcataattgctttcttcatgtaatatacaattttgcacaaaaagaaaaaagggaggaaggaagttcacctctgttaatctgagggagattgaactattt

SEQ ID NO: 71 - DNA, 3021 bp, Oryza sativa
gctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgcttgcttctttctttcacaagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactccactggcattgctgaaacagcagctgcgctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacaacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttc

SEQ ID NO: 72 - DNA, 1312 bp, Triticum aestivum
cgctccacttcactcccactgaagcagctcccactgaagcagcggcggaagaagaagaagaagctagaggacatgggggcgcagagagctctcctcgcgagcttcctgctcgccgcgttggccacccaggccttcgtctccgtctcggccaggaccggcccgacggacaaggcaggccaagatgacgtgaagaagccggactgcgtgccgtcgctcgacccgcacaatttccccggccacgggggcaccaccgtgccgcttccctcgcacggaggctcctccggcacgcccccctaccacggaggctccggcacgacgccgtcgcacggcggctccggctcgactccgtcgcacagcggctctggttcgttgcctgacccgtcgcacggctggtacgggacgccgccttcgcacgggggctctggttcgttgcctgacccgtcgcacagcggaggttacgggtccactccggatgcgccgtcacacggcgaaggcgcgtacgggagctccccgacgccttccactggcggtgcctacggcagctcacccacgccgtcccacgacggaggcgcctacgggagctccccgacgccggcccacgacggaggctcctacagcggaactccggctgcaccgtcgcacagcagccacgggtctgtgacaccgacgccgctcatcccagtcgaccccaacagcctcgggacatgcgactactggaggacgcaccccatgcagatctggtcggcgctggggagctggccgagctcagtgagccacttcttcggcgccgccggtggcgcggtcgccggcgggccgagcatgagcatccaggacgcgctggcgaacacgaggaccgacggcgccggtgcgctgctgcgcgagggcaccgccgcgctgctcaactccatgacccgtccggggttcgcctacaccacccagcaggtgagggacgcgttcgcggcggccgcggccggcggcgtagacagcgccgcggcggcgcaggcggcctcgttcaagaaagccaacgaggggaggaaggcgtagatcgaccggatcgccatggagagggctttagctagctggctacctatatttgtggcatgtctgcatgcatgcgtttaggccggacggacgtgtgcgttgtgtgcgatttggttgtttcgtttgagttatggtttggttgtgtacgttggtgtcttcgtgggctagcttcgatctatcgtactgtgttgtaatgaatctcgtttaagttttttgcagttccgtaccctgtcgcattgaatggaatatattgaagcgaactattcctagc

SEQ ID NO: 73 - DNA, 1751 bp, Triticum aestivum
ggtgtgtcaggtgtctctctctgggctcccggcatcggcggcgggcgggcattgggagggagctcacggccccggcggcgggcggcggagtgggcgggcgcgggagcaagggagggagctctccggcggccatgccgcgatccggggcgtgatcccgccggggattgctggcccgggagcgccgcggcgatgaacgggccgagcgccggcgccggctccggcggcgaggggccgctggtgtaccaggcctggaaagggaacaatgtatttttcctccaggggaggtttatatttggacctgatgcgagatccttgtttgtcaccatgttcctcattatcgctccagtaacagtcttctgtgtgttcgtcgcgaaagaattgatgaatagcttctcttatggcctggggttaccggtgatggttgtggcagttgtattcacggcatatgatttgagtcttctatttctcacttctgggagggatccaggaatcatacctcgaaatgcacatcctccagaacctgaaggttttgaaggcaatgctgaagttggagctaaccagactccaccattgcgtttgccccgagtgaaggatgttgttgtgaatggaatcactgtgaagacaaagtactgtgacacctgtatgctgtaccggcctcctcgatgctcccattgctctatctgcaacaactgtgtcgagcgatttgaccatcactgcccatgggttgggcagtgcataggacttcggaattacaggttcttttatatgttcgtcttctcgacgactcttctctgcctctatgtctttggattctcctgggtgtacattattaagatcagagatgcggagcagataacaatatggaaggcaatggcaaagacccctgcgtctattgctctggttgtctatacgtttatcgcggtttggtttgttggtggcctctcagtgtttcacttgtatctcatgagcactaaccagacaacatatgagaacttcaggtatcgctatgaccaacgggccaacccatacaacagaggagtcgtggagaacatcaaggagatcttcttcacgccgatccctgcttccaggaacaacttcggcgccagagttccacaggagcagggcctgaggcctcgctcgacgaacggtttcatgagcccaaacatggggagagctgttggcgacatcgagatgggcagaaagccggtggcatgggatgagcccaggatggcagcagagataggcgacctgggcggtctgggcaacttgctggaggacaaggatggcaggttccgcaacgcatcaccagatctaagccgtgacgccctcgtggtcggaggcttggatgagcaaggctcctcggtgatgaacccaccacggacgagctggggagtcgaagcgggcaggtgatggtaactggccaatgtggccatgtaagcagctatagtggaggactaaggggtgtatgttagtgccagcttgttcgtagtttggtgtccggttgagactcggggtcgctgatgttgttattaggcctatgacctgttgttgttttgctttgcattcatgtatcagtggtttttaagcagattgttggtgtgtgaggtctccagttcagtagaatcttaattgtgtctgtatatagtttggagtggtgaacccggaaatggattggtttgctttggcttccgttgtcaaagattgtgaaacggcattgtacctttcaatttatgctgccactccaaagcttg

SEQ ID NO: 74 - DNA, 856 bp, Solanum lycopersicum
attctttctcccccccaaaacaaatatctttggccatcctcaacaatggccatcaccaatcttttatccaccaccattacactcaaacactcgccatttcttctactgaaaccctcaacaaaactcagaaaccctaaaaggccaacaattcgagctcaatctaagaacgacgactcagtagatggtccagatcgtttaatctccgccataacttacttctaccctttctttgatggtgttcagtacggtaaatatgtaatcacacagtttgctccaatacaaacacttattcaacctttagtaccagctataagggtttttaagagctttccgcttaacgggttgttggttttctttacactctactttattgttgtaagaaatcctaattttagtagatatgtcaggttcaacactatgcaagctattgttcttgatgtgcttctcatttttcctgatttgttggagaggagtttcaatccaagtgatgggtttgggttggatttgatgatgagctttgatagtactgtgtttttgtttcttttggtatctttggtttatggtacttcgtcttgcttgttgggtcagctacctagattgcctattgttgctgaagctgctgataggcaagtgctatgaactcgtaattttacttgtttatgaggtttcatcctctttgtacacttaattatgttttgctttagctgacaattaatatctatttcgttccgaaagtaaatgtttatgctctttagagccttgttcatgcatatcattttgctgtttcttaatgtggatatgtatattcttgtaatggcatttcggtttctttaatcaagtaactactttttttcta

SEQ ID NO: 75 - DNA, 1654 bp, Zea mays
ctccccacatttcgttgtgtaccgcaaacagcagagagaaaacggaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgcctcgacgccttcttcctcctttccccacggctcgccgtccacccgctgtcccgccgcgtccgcactatgcccgcgttcgccgcgctctctcctccttcctacccgctcgtctcctccccgtccccatcactccttatcacctgcgcctcactccagttcctcccgccgatccccgacggagcctacctcctatccgctatcgtcccatcgcgcggctcctccacctcctgcacccttgtcgccgtcatcaccggcgcagccgcgcgttcttacaccctggacaccggcgatccctccccgcagtgggcgtctagaggcgatctcccgctgtctctcacgctcctggaaaacgccgcggtctccggtgaccgcagcaaactcttcgtcctcggccgtggccccgaggcgctcttggtttttcatctcgtgacggggacatgggaggtgctgcatgttgtgatgccacaaggtctcactacggcgcacctgtttctttttgatgggagcctattcttagtaggtggtattgagagctttggagtagtggatcgggtggtggtctggcggttggacgacgataaggtggaggaggtgtggtggagggaggtgagcgtgatgccgacggaggttttcgatgagttgctagctggtaggtttggcagattctggcattttcaggctgcagacagattggggattgtttgcttgtacaatgctgtggatcggaggctggtcatgtttgatgcggctgatggcatgtggacagtgctgccacgattgtccgcgttggatgcatgcgagagcttcaggtggtttggacatgtcttggagccaggagttgaaatcttgatgggactacgttgacatcccgatgaagatttcatgctaacatcattaaattcataaagctagagttactagaagagctgtatgcaaatccctgaaaaagaaggaaaaaaaactggtggagcaaggaagtctcataatccgaaagataacaagtgatatctacaacaaagctcatggatggaagccggtcgatagacgcattcagtgatattttggctgttgttctgtctttttgggttcatctgttttgttagatgtaatctggctggctctttagtttggtaaaatcttagctaagttcgtcgctgaagttgtcagaaccaggctgcctttggttgggttgttttggtcccttcggttgaacatcagttttcaggcggtctgaaaacatttcctgctatggaaatgttcctctattttagctgatagttgcgtatgtcttgtcggcttgtagttgatgttggcttgtatggttgtgtaagaactttgtccttgtctatttcctaatgaaataggggtgctctcctgtgtcaaaaaaaacagatttt

SEQ ID NO: 76 - DNA, 1552 bp, Triticum aestivum
agtccgcacagaatcaaacaatggccacgtccgcaacggcggctcggcacatggtcgctttgccgtacccgggccgcggccacatcaaccccatgctcgccgtgtgccgcctgctcgtcgccgcggacggcgccctcaccgtcaccgtcgtcgtcacagaggagtggcacgggctgctggcctccgccggggtgacccccacgctgccggaccgcgtccgcctcgccaccatccccaacgtcatcccctccgagcacggccgcggggccgaccacggcggcttcatcgagaccgtaaactgcaagatgggggagcccgtcgagcggctgctcgaccggctggcgttggagctggggcggatgccagatgctatcgtggccgacacgtacctgcagtgggcggtggcggccggcgcgcagctcggcgtgccggtgtgctcgccttggacccagccggccacgttcttgttggcgctctgccatttggacctgtggcgaccagcggttgaaggtttcagcgaagaagaactaagccgcaagtcgttggagcaatatgtaccgggcctctcatcagtgaggttgtctgatgtcaagatcttcctcgcttgggaggggccaatcaaaatatcagcggaggtgttcgtcaaagtacgcaaagcgcagtgcgtcctatttacctccttccacgagctcgagcccagttccatgagcaaaatagcagagttacttccctgccccatctatccaatcggccctgcaatcctgcgtgcgccggacaacgaagagaaggcccgtgacgaggagcaccggcgctggctggatgcgcagccggagaactcggtgctgtacgtctcgttcggcagcttcgtcgccatgccgcccaagcagttcgaggagatcgccgtggggctgcgcgacagcgcggtcaggttcttctgggtggcccgggacagggccaccgacggcctcagggagatgtgcggcgacagggggctgccggtgccgtggtgcgaccagcaggaggtgctgcgccacccgtccgtcggcggcttcctcagccactgcgggtggaactcggtgctcgaggccgtgtgcgccggagtgccggtgcttggcttccccgtcgcgtgggatcagctggtgaacgcccggatggtcgccgacgaatggaaggccggcatcgacctgagggagcagagggggaaggatgggatcgtgagcagggccgcggtctctgctgccgccaggaagctgatggatttggacagtggtgccggccaagagatgaggacaagggctgcgcagctgcgcgaggcttcccgtggtgcggtcatcgaaggcggctcgtcccatcgttctttgaccggtttcctcgaggatctcggcaagggaaaactggacgtccctgaaagttctgcgtgatttccttcgtttactccagtcagtgatagaaaaatcgctgtttgtggttcaaaatggtgcatcatagtaaggccatgtgtcctacagatatttcatttattttgctgcacttgagagcattctgaccgatc

SEQ ID NO: 77 - DNA, 2707 bp, Oryza sativa
cacacatacacacacatatctcatcttgttgtttctgagctgctccaagaagcagagctctgtccatggaggaggagcagagcccgaggctcgccgccggcgagccggagcgcaagctcgaggacggagtcaccgacgccgaggaccccgggtgcacgggcaatgcggccatgagctcgctggagcagccgcttctgaagcggagcaacacgctaacggccagccacctcgccatggttggcgccaaggtctcccacatcgagagcctcgactacgaaattatcgagaatgatctgttcaagcacgactggaggaggcgatcgaacgtggaggtgctgcagtacatcttcctcaagtgggccatggcgttcctcgtcggcctcctcaccggcgtcatcgcgtcgctcatcaacctcgccatcgagaacatctccggcctcaagatgctccacatggtgcagctcgtccgcaagaaaagatactgggccggtttcttgtatttcgccggcgtcaacttcggcctgacgttcatcgccgccatgctctgcgtcgtcttcgccccgaccgccgccggccccggcatcccggagatcaaggcctacctcaacggcgtcgacacgcccaacatgttcggcgcgccgcagctcattgtcaagatcatcggtagcatctgcgcggtgtcgtcggggctggatctcgggaaggaagggccactggtgcacatcggcgcgtgcctggcgaacttgctgagccagggcggctccggccggcaccgcctccggttgcggtggctgcgctacttcgacaacgaccgcgaccggcgcgacctgatcacctgcggcgcgtcgtcgggcgtgtgcgcggcgttccgggcgcccgtcggcggcgtgctgttcgcgctggaggaggtggcgacgtggtggcggagcgcgctgctgtggcgcaccttcttcagcacggccaccgtcgtcgtcgtcctccgcgggttcatcgaggtgtgcaggaacgggcggtgcggtctgttcggcgagggcgggctcatcctgttcgacgtcggcgacgtcgccgtccggtaccacgccggcgacctcctcccggtgaccatcgtcggcgtgcttggcggcgtcctcggcgcgctgtacaaccacgtcctccacaaggtgctccgcgtgtacaacctcatcaacgagaagggccgcgccgcgaagctcgccctggcgctcgccgtgtgcgcgctcacgtcggcgctgctgtacgtgacgccgttcgccgtgccgtgcacgccgtgcgacccggcgttcggcggcgcgtgcccgacgctggggaagagcggcaacttcaagcggttcaactgccccgagggccactacaacgacctcgccaccctcctccacgccaccaacgtcgacgcgacgcggaacatcttctccacgggcaccgccggcgagttcaggctcgactcgctgctcatcttcttcgccgtctactgcgtcctgggcctcttcaccttcggcatcgccgtcccctcggggctcttcctccccatcatcctcatgggctccgcctacggccgcgtcacggcgctcgtgctgtcgcggttcgcccgcatcgaccacggcctatacgccgtgctcggcgcggcggcgctcatgtcggggtccatgcggatgaccgtgtcgctcgtcgtcatcttcctcgagctcaccaacaacctcctcctcctcccaatcaccatgttcgtcctcctcatcgccaagaccgtcggcgacgcgttcaaccccagcatctacgagatcatcctcgacctcaagggcctcccgttcctggaggcgaagccggagccgtggatgaaggacctcaccgtcggcgagctcgccgccgccaagccccgcgccgtggcgctccaggtggtggagcgcgtgtccacggtggtggaggcgctccgggcgacgcggcacaacgggttcccggtgctggaccggccgcggcccggggtatcggagctgcacgggctggtgctccggtcgcacctcgtcgccgcgctgaggaagcggtggttcctgccggagaggaggaggacggaggagtgggaggcccgcgagatgttcagctcggcggagctcgcggacaagtgcggcggcgtggacgagctggagatctcgccggaggagatggggatgtacgtggacctccacccgctgacgaacacgacgccgtacaccgtggtggagaccatgtcggtggcgaaggccgtcgtgctgttccgctccgtcgcgctccgccacatgctcatcatgcccaagttccaaggacccgagatatctccaattgtggggatcttgacaaggcaggacctgatagcacacaacatcctcggtgcatttccacaccttgcaagcaagaggaaaacacattgagaggaaccatttttgagagttaatccatctttattgtcttgaagccaaatatcagagtcacctgcatatacagcttttatgaggctttgagttttttttcttttttttttcagttatcctcttctctgtaagtagattcaggattattatttgctgctcttctgagagtgcttgaataattgctgccaatgtaaaatcacacatgtaactatgccagatgtaatcaaaagggacacaaccatgatgcaatagagcaattcttttttaaagagatatttcaaatccttgtt

SEQ ID NO: 78 - DNA, 876 bp, Oryza sativa
aaccaaccaaccaaagaaagaaaagctcgactcgagctcgccgcgattgaatcgcgcatgggcacggcggcgggcgacgcggcggagcagccaccggcggcgccggaggcgaagagggcggcggctccacggacgctggtgttcacgtacggcacgctgaagaggggcttctccaaccacggcctcctccaggacctggcccgggacggcgacgcctccttcgtgggcgccgccaccaccgcgccgcgcctcccgctcgtctgcgggccctaccgcgtccccttcctcctcaacctccccggcgccggacaccgcgtctccggcgagctctacgccgtcacgccgcgcgggctcgaccgcctcgacgagctggagggcgtctcccgcgcgcactacgagcgcctccccatctccgtcctcctcgccgagggcgcccaggtcgacgccgtcgcctactacgcgcaccgcggctacgccgacgacctgtgggcgcgcagcggcaagaaggggtacccggagtactcgccggccgtcgccgacggctacatccgccgcaaggatcggccgcagcagctcaccttcctggagcagattcgggtgttcgtctcatcgcagtcatcgtagaacccatcaattaatctcttttcttttcttaatctatttttcttctctttgcaatcactcctcctatttgtgcgatagcgtgcatgggccatgtgacaatctcttgtgatgaatggatgatcacgcgtgctacctaacctaccagatcgccatatcaggctatcgctgatcgcgtgatctgtagtatcacatccgtttgtgtgggggtaaaatcagccatcttcctgtaataaaatagaatgattttccatt

SEQ ID NO: 79 - DNA, 1562 bp, Solanum lycopersicum
atagaacatgtagtattttccagattaggttctctgactcatctttttctgtctcatacacactctccctcgtgtactgtcctctttctgcattgcggctagggtttcacctaaaaaatccctatttttgttgttgtttgtgtactgattttacaactgatttgatggatattcgaatgaactagcggttgacgcggtgggtttcacacatacgaaggtaaaaagggtttttgtagctcttgaaaatggcggatttgaacccctttgatttgcttggtgatgatgataacgatgatccatcgaagctgattgctattcaccagcaaaaagttgatccggcgaagaaagcctcagctccggcgccggcggcggctaagaaacagccggcgaagctccccactaagcctcctccccctactcaagctgtcagggaggcaaaaacagaatctggacgtggtggaggtagaggtggtggacgtggctacagctgtggtcgtggtggaggtgggttcaatagggaaggatccaacaatgagaactttgctcgcaacagagaattttcaggtggtattgctgcgcctgaatacgtggaaggaggaagaccctctgaaagacgcggtggttatggtggaccccgtgctttccgtggtggtagacaaggtggttttggtaatggagaaatgcctgagggggaccggcctcgtaggacatttgaacgccgtagtggtactggacgcggaagtgagataaagcgtgaaggtgctggccgaggaaactggggaactgaagcagatgaagttactctgatgactggtgaagttgctgatgaaggtgagaaaaatctgaatgtggagaaaccctccaccgaagaagaagcaggagttgataagaaggaaaatccagctgctgaagctgcggacaaggagcctgaagataaggagatgacccttgaagagtatgagaagttgctagaagaaaaacggaaggctttgcaggcgcttaagactgaggaaaggaaggtcgacaccaaagtatttgaatccatgcaacagatttcaaagaaatccagtgatgaaatctttgtcaaattgggctccaaggataagagaaaagagtctgctgagaaggaagaaaaggcaaagaaggcggtcagcattaatgagtttttgaagcctgctgagggtgagaggtattatgcacctggtggtcgaggtcgagggcgtggccgcggttctagaggttacagtgaagccaacacgatgagcaatgtggaagctgctcctcccattgaagacccaggtcacttccctacattgggtggcaagtgatgtgcttttttagtgcttttctaccacgtccaagaggcaaatctgactataataatggagtggaagtttcaatgtaaatttcttccgtttatgtgataccctctgtagttttattttatctgatgttttactcttctgatcctactgggttatatgaagcacattaacttattttgctgttttattctagtaatatattctgtgcatcatttaatgacaattctcattgactaa

SEQ ID NO: 80 - DNA, 2023 bp, Zea mays
ataatcgctccagtcaaatctcctctatgtacaggaggtgatagtcttcagcccagctcgctctgcagtcttcgcgtagcaaaaacaatggccacagcggcggcagctcggcacgtggtcgcagtgccgtaccccggccgaggtcacgtcaaccccatgctcgtcgtgtgccgcctgctcgccgccgcggacgctgccttgagcgtgaccgtcgtcgtcacagaggagtggcacgcgctgctggccgcagcgggggtgcccggcacgctccccgaccgcgtccgcctcgccaccatccccaacgtcatcccctccgagagggtccgcggcgccgacttcgcaggcttcgtcgaggccgtgcatatcaagatggtggcgcccgtcgagcggctgctggaccggctgtccctggagcggaagccggacgccatcgtggccgacaccttcctggcttggggcgttggggttggatctgcgcgggggataccggtgtgctcgctgtggacgcaaccggccacgttcttcttggcgctctggcacctggaccgttggccgccggtggatggtcatcaaggggaagaaggcctaagctgcaggtccctggatcaatatctcccgttcccagccctcgcgccggtaaaatgttctgatatgaagaccctccgctccatggtgctgccaatgaaacggctagcgcaggtgttctccaacctgcgcaaggcacagtgtgtcctcttcacctccttctacgagctcgaaaccggcgccatcgatggaacatcgcaagtggttccatgccctatatatgcagttggcccttcaattccatatatgccactggaaggtgattcgggcgagtttcaccatgaagaagactacttcggttggctggatgcccagccaagaagctcggtactgtacgtctcatttggcacccatgtctcgatgccttcgtctcagctggaagaggtcgccctggggttgcatgaaagcacggttaggttcttctgggtggcccgggacagagctagcaccgccacccttgagcagatctctgctggtggcaagggcttggtggtgccgtggtgtgaccaactgaaggtcctgtgccacccctccgtcggtggcttcctgagccattgtgggtggaactcgaccctggaggccgtgttcgctggagtgccgatgcttgcctttcccgttgcttgggatcagctggtgattggccatctcgtggctgatgagtggaagatcggcgtcgacttgagggaacggagaagggaggatggtgttgtcggaagggccgcgatctgcgatactgtaacgaagcttatggatttgactgacgatgatagcctagagatgagaagaagggctgcggagctgagagaggcttcacgccgcgcagttcaggaaggtggatcttctcggtgttctttgaacagtttcgttagagatgtcatcgaaggaagactgaatgttgcagaaacttcacggtaggtttttgcttgaatttgtagtttcagggggacagaactgttgctcgtaggcagaaacgttgtgctcctgcaagtaaaggtacgtggctcctatcatgttcacgcatattcaccgccaccccactcgcaacaattattactggcttgaaatcacgattgccacagtacaggagtatagctgcacattttctgaagctgaaaacagaagacttgatgctgtctgtagcaaagatgggggacagcgatagtgatggcacaaaaaattctgtgctcctggacttgtgtaggttatgcacgtgatgagcaagcgtgtatatagccataaaaaatattgttttacatcgtatattatttatatagtaaagtttggataagaagtgtgatggggaaggataagaaagacttctagagcagcctaaaaatattaatatcgtggaataatcaagagctttgtatcgtaacagagtttatatgtacttcttaaaaaagtggtgttgtattttatataccaaagtttataggtt

SEQ ID NO: 81 - DNA, 765 bp, Sorghum bicolor
gtcgtcatcagatcagatattcatcagatcgatccgcaccgccaccggccgcaggcaatcatctatgggcgcggccggcgaccccgctcccctggtgttcacgtacgggacgctgaagcgcggcttctccaaccaccgcctcctggaggagctgtccgcgagcggggacgccacgctggtgggtcccgcggtgacgtcggcgcggctgccgctggtgtgcggtccctaccgggtgccgttcctgctcaacctcccggtcccggctgtcgccgccgcgcaccgcgtgcgcggggaggcgtacgcggtgacgccacgcgggctggcgcggctggacgagctggaaggcgtcgcgacgggccactacgagcggctgcccgtgcaagtcgaggtcgaggtcgagggcgagggcgagggcgggacgagggtggtggaggcgatcgcctacttcgcgcaccggagctacgcgggcgacctgtggcggcggagcggggaggagggcgtacccgagtacacccacggcgtggcggcggggtatgtccggcgcaaggaccggccccaagggcagacgttcctggaccagatccgggtcttcgtatcctcctaagcttgcggatcattgatttgtgttttggttttggatggatccatcgatgtgtgatcacatcaatcaggatctactatcgatcatctccctcccttcccttgatcttgatgtatgcaaagctcacctcacctcgatcgcctccctcgctccacccacctgtg

SEQ ID NO: 82 - DNA, 1454 bp, Triticum aestivum
acctgttttgacagacttgcccttccaaacaccccagtatgctacatataaacccatgagatccagaaacaggagtcaccaaggctagacacaagcaactgaaatgagctccctttccatgaagtgcctgctcttcacctcggcagtcgccgttgtccttgctcttttccccgttgccgctgtcggcgccggcctgaaagtcggattctatagcaagagctgcccatcggcagagaacctggtgcagcaggcggtggctgctgccttcaagaacaacaccggtgtcgccgctggcctcatccggctgcacttccacgactgttttgtcaagggttgcgacggatcagtcctgatcgactcgacagcaaacaacactgccgagaaagacgcgccccccaacaagcccagcctccgcgggttcgaggtgatcgacgcggcaaagaaggccatcgaggccaaatgccccaagacggtctcatgcgcggacatcctcgccttcgccgcccgtgacagcatcgcgctagcaggaaacgttacctacaaggtgcccgccgggcgccgcgacggcaggatttccaccaacgcgagcgccctcagcaacctaccctcgccgctctcaacggcggccgagctggtcggcaacttcaccctcaagaacctcacggccgaggacatggtcgtcctctccggcgcgcacaccataggcgtctcccgctgctcgtccttcacaaacaggctatatgccttcagcaacaccagtcaggttgaccctacgatgagctctgcctacgcgttcctgctgaaaagcatatgccctgccaacagcagccagttcttcccaaccacgacgactgatatggacatcatcaccccgacggtgctcgacaacaagtattacgtgggtctgacgaacaacctgggcatgttcacgtcggaccaggcgttgctcacgaactcgactctgaaggcatcggtcgacgagtttgtcaagagcgagaagagatggaagagcaagtttgtcaagtccatggtgaagatgggggacattgaggtgctgacaggaacgcaaggagagataaggctcagctgcagggtcataaacaaagggagcgctggtcttgagatcaataatggacccgactatggtgaattcgctgaaatcgcgacgagctagtggctttttaggcccttgatttgacaaagaaaacaagcatgccgaacaactgaagatcgatcgtcctgctttttttgtgttgttccgtctgtttcttagtttttattgtaacgatgcaagataaaagttaatgttgcgcatgggaatggtgtgttgtgaattttaccaagatgacaatgggatgtttttgttcttgtatttacgcattctaaattcaggaaatggaagagatgatggagaaaaactactttcaaaaaatatggacaacattatactccat

SEQ ID NO: 83 - DNA, 1451 bp, Sorghum bicolor
gcactctgcacggcaccgcaccaccgtccaccgcggcaccgccaccgatcggtagcaaaggcaacgcgcgcaacgcaaccgtgtcctcgtacggcagcagccggagagagagaaatgggcgaccacgagggtcgcggggacgattttgagaagaaggccgatcagaagctctccggatggggcctcttcggcaacaagtacgaggaagccgccgacctcctcgacagggccggcaacttcttcaaactcgcgaagaactggagcagagcagcttcggtatacaaaaagattgcagattgtcatttgcagggagatagcaagcatgaggctgcctctgcttatgttgaggcagcaaactgctacaaaaagttctcaccacaagatgctgcacaagcacttaacaatgccgttaatcttttcctggaaatcggtagactgaacatggctgcaagatacagcaaggatatcggtgatatctatcagcaagaacaagatttagagaatgctgcagtctacctgaatcgagctgctgatctttttgatagtgagggacagtcctctcaggcaaacagcatgacacagaaaattgcagaaatatatgctcagctggaaaagtaccagaaagcaaccgagctctttgaagaaattgctcgtaaatcaataaacaataaccttctcaagtatggtgtcagaggcattttacttaatgcgggcctttgccaactatgtagaggcgatactgttgctataaataattcattggagcgctatcaggacattgacccaaccttctcggggacacgtgaatacaagcttttggcggaccttgcagcctctatggatgaaggagacgttgacaagtttactgatgctgtaaaggaatttgacagcatgacacgcctggatccttggaaaacaagtctccttctaaaggcaaagaatgagttgaagaaaaaggatgaggatgaggatgatctaacctaggctttgttctacaaaaggttccatgatttcattgaggatgccgtgaagtctttacacaagattgtttgacatatgtatggatatacaaaacctccttgataaatgctttccctatggacacctgtttggactttggagtactctggttaccgcttaattcaccgccgcatttggaatctagtagctactatttgtgtcatcctatatgttgcatttgttccattagtgttcatgactatatatgctgcgcatatgactccaggctttctagtataaataggtttaaataatagggagtagtgtggattttgttttagatgtgtttgagagtatgtaatcagagagggagggagggagagttgaactatgattgttttcattgattgatatacacgatgaactgtcgccaagcaatcagtctgcgtccattcagaggcatcactcgtgaatgaacccctgtggctgcc

SEQ ID NO: 84 - DNA, 3219 bp, Triticum aestivum
tccggcgaacgtgcgtgcttccgggcgaggctccggcaagtgatcgagtcaggcgcccaccgttgttgctgctccgtccgtcgtggactggcccgtggatagagaatggacgcagcgacgcggcgggcgtggctgctcctgctgctcgtggcggccaccgtgccggcggggctctgccagaccaacccggacgatgccgcggcgctccggtcggtgatgggcgcgtggaccaactacccgtcgagctggaactccggcgacccctgcggcgcgccgtgggacgggatcatgtgcagcggcaacgggagggtgacatcgctgcggctatccagcgccaacatgcagggcacgctcagcgacagcatcgggcagctcggccagctcatgttccttgacctttcgttcaacggcggtctcagtggtacgatccccgcttcgattgggaaccttgggaagcttacgacactaatcttggctggttgcagcttcagcggagacattcctaaagagctaggcaacctcctgcagatgacattcctggcgctgaattcaaacaagttgacgggcacaataccgcctcaacttggcctactctcaaaactcttctggctagacctggcagataatgccatcacaggaagtgtccctatctcaacaggaacgacaccgggccttgaccttcttaccaacacgaagcacttccatttcaacaagaaccagctatccggaacgcttacaggcctcctcaagtctaatatgaccctcatacacatattgtttgatagcaatcagttcacaggctcaattccgcgtgagcttggaagcattacctcgctccaagtactccgactggataggaaccaatttgcgggagcagttcctaacatcaccaacttggtcaacctaaatgagctgaacttggcaaccaacaagctaactggatcagtgccaaatctcagcagcatgaacgtgttaaatgttgtggatttaagcagcaacagctttaccgcgtcagcaatcccagcctggtccacaaatctaacaaatatttcttcaatatcgatgtcttctgcgagcctcactggcgaggtcccccaggaactcttcaatttgccccagctgcatgatgttctactgagcaaaaaccagctgagcggaacacttaagatggcggccggcatcagcacacaactgcaaaccgtggatctcgaagaaaacagcatagttgatatcgctggcacttcaaactacaaaaagacactgctgcttgcccagaatccagtgtgcgccgataaacccatacagttctgcagcgcccagaaacagaacgtgatagcatacagcactagcatggccaaatgtaacacggcacgtgggtgccaaagtggtcaggaccagaaccccgcaaactgcggctgcgcctattcgtacaatggcaagatagtcttcagagcgccgtccttcaaggatgtgtcgagcaccgctaactttcagcaactggaggaaaccctctggaggctactgagtctgcgtgaaggcgcagttgtcctgaaccgtatccacttcaacgaggacaactacctccaagttcaagtgagtctgttcccgtcaacggggacgctcttcaacgtgtctgaagtgagccgcattgggtttcttctcagcaaccagacctacaagccaccgccaatattcgggccttacttcttcattgcagatccatatgtccccttcatagttgctggtggcaaaaaatcgaagttcagtacaggtgctgttgctggaatcgcagtggccggtggggttcttgtgatcgccctcattttggtgggactattcgctttgcgacagaagagaaggaacaaggaactaaaagaacgaagcaccgacccttttgcttcgtggggggcgacgcagaaagacagcggaggagctccacagctgaaaggagcgaggttcttctccttcgaggagctgaaaagctgcacggacaactttgcagatagccatgagataggcgcaggaggctatggaaaggtgtacaagggaacacttgtggacggaatacgggtggcgataaagcgggcgcagtccgggtcgatgcagggcgcgccggagttcaagaacgagatcgagctgctgtcccgggttcaccacaggaacctggtgagcctgatcggcttctgcttccagcaaggggagcagatgctggtttacgagttcgtcgccggtgggacactgagggagaaccttgttgttagagggacgtacttgggctggaagaagaggctgaggatcgcgctcgggtcggcgagggggctggcgtaccttcacgagctcgccgacccgccgatcatccaccgcgacatcaagtccaccaacatcctcctcgacgagaacctcaaggccaaggtcgccgacttcgggctctccaagctcgtcgccgacaccgagaagggccacgtctccacccaagtcaaaggaacactgggatatttggacccggagtactacatgacgcagcagctgtcggagaagagcgacgtgtacagcttcggggtggtgatgctggagctggtgagcgggaggcagccgatcgagaaggggaaatacgtggtgcgggaggtgaggcaggccatcgacccggccgaccgcgactactacggcctgcgcgccatcgtcgacccggcgatccgggacgccgcgcggacgcccgggttccggcggttcgtgcagctggcgatgcagtgcgtggacgagtccgcggcggcgcggcccaccatgggcaccgtcgtcaaggaggtggaggccatgctgctgaacgagcccgacggggaggggtccaactcggccgggtcgtcggccaccgagttcgacggcgccggcaggggcgcgccctcgcacccgtacagcgacgtggagatcacccggtcgtcctacggcggcgccggggaggcgtccgattacatgccctacttcgaggtcaagccaaaataatagacacattgtacattcatttttggggtatagaaagtgtacattttgttccttctcgtgtcagcttgtgagttgtgacgatgaattgtacattgatttttttttgtacgtgttgcgagtgatgtgacttgtgatgcatcgtatagtagtattagattcttctttgttcattgtatgcgagtttcactctcttgacattcattggatgcaagttcattgttt

SEQ ID NO: 85 - DNA, 848 bp, Sorghum bicolor
acctgatctcccctgcatctcaccgatcgcatccgcctctccacacgcatctccctctccaccttgccagcatccgcgcgcgcgcgcatctctccacgccatggacgggtcggcgttcctgtcgctgtcgccggagctccgcgacgcgctcgccaaggtggccgtgttcgtgctcgtccaggggctggtctacctcatcctccgcagctcctccgacgtcttctccaaggacggcggcgggctcaggtccctcagcttccgccccatgcgctccatgagcgtcaggcgcgtgctggctccgctctctgacgtccccgtcggcaccgacgagccctcgccttcgccgtcgtggtccatgtcgcccgccgcgtcgtcgtcgcgccgcagggctgcccgcgaggattgaaatggccgcaacttctgggtctgggcaccttggaatcggaggtagtttatttggtcgttctggattgtaattggtttgttattgtggatggaaatggtatttgagttcctatatgtaagtaaggccttgtttagttcccaaaaaattttgcaaaatttttcagattccccgtcacatcgaatctttagacacatgcatgaagtactaaatatagacaaaaataaaaactaattgcacagtttggtcggaattgacgagacaaatcttttgagcctagttagtccatgattggacaatatttgtcaaatacaaacgaaagagctacagtgtccattttgcaaaatattttggaactaaacaaggccttaggtgaaggcgagggcgatggaactaaacaagctgtagagtggatggactcttgtacatatatcgattgaacaga

SEQ ID NO: 86 - DNA, 2657 bp, Arabidopsis thaliana
accacaggcatgaacacttattccccactccaactcataccgacgcctattcatctcaaatcctcacgcgccgcctcaccgtcatcattacgcgtcgcttctccgttaattatacgcgccgcctcctcagacgactcacagtcagtcgaaaaccaaactctagaagtcctcgaatggcgtgccctctgcaatcagctctctccgttcgcttccacaaccatgggcctttccgccaccaaaaacgccgaaattccggtgggaaactcgccggaagaaagcaggaatctccttaacgagacctcagctgcattagctgctatggagatgatgaaatcgcgaggattaggtctttctgaaatccaagacttgtctgatatcgttgagcgtgctgtgtccggtcaattgcttaccgttagagaactctgtaccgttcgaagcacgttaacggctgctacatcaacgtttcagaaactccgaaaagcagccattagtgataacagggttactccacttgtagatatactacagggttgtgatttcaaggatacattacagcagaagattagtttttgtatagactgcaacatgactatgattcttgatagagctagtgaagatttagagattataagatctgaacggaggagaaacatggagaatttggattctcttttgaagaaaatatcaactaagatttttctagctggggggattaacaagcctttgataacgcagaggagatcaaggatgtgtgtagctattagagctacacacaaaagtttacttccaggtggtgttgttttaagtgttagtagctctagggcaacatgctttatagaaccgaaagaggcagtggagcttaataatatggaagtgagacatgcgaactccgagaaagctgaggaaatggcgattttgagcattttgacatctgaggtggtgatggcgcagagagagatattgcatttgttggatagaatattagaacttgacattgcttttgcaagagcatcacatgcaaattggattaatggtgtctatcccaacgtaacttcagaacacacaaaaacaccgggcttagctgtagacattgattctgcgcagcacccgctacttcttggttcagtattaggcagcccaaatggtggagacattttccctgtgccagtagacattaaagttgaaagcagtgccaaagtagtcgtcatctcgggtccaaacacaggaggaaagaccgctttgttaaagacattgggattattgtctcttatgtccaagtccgggatgtatttgcctgctaagaactgcccaaggttgccttggtttgatcttattctggctgacattggagatcctcagtctttggagcaaagtctttcaacctttagtggccacatctcacggatacgacagatacttgacattgcttcagaaaattcacttgtcttactagacgaaatatgtagtggaactgatccttcagaaggggttgcacttgctactagcatcctacagtatattaaaaaccgtgttaatgtggcagttgtatcaacacattacggtgacttaagtcgcttgaaggataatgaacctcgattccaaaatgctgcaatggagttctccatggaaactttgcagcctacatttcgagtactctggggaagtactggtctatcaaatgcattgagagtagctaagtccattggtttcaataaaagaatattagagaatgcgcataagtggacggagaaattgaatcccgagcaggatgtagagcggaaaggctcactctttcagtcccttatggaagaaagaaataaactaaagcttcaggcaactaagactgcagcttttcatagagacttaatgaacctttaccacgagcttgagcatgagtcgcatgatcttgataaacgtgagagggctcttctgaaaaaagaaacgcaaaaggtgcaagaagatctaaactctgctaagtcaaagatggagagactggtggctgaatttgaaagtcaactagaaatcactcaagctgatcaatacaattccttaatcctgaaaaccgaagaggcagttgcagagattattgaagcttgctgtcctatggatcctgattccttagaagaagaatacagtgactactcaccacaagctggtgaaaaagttcttgtaactggactgggagataagttaggtactgtggttgaagaacctggagatgatgatgatacagttctagtccagcatggtaagataagagtacgcataaagaaaaaggacataaagccccttcctcgtagcacaagtagccaaacatccaatcgttctctacgttcgaagagacagataaacatgaaagagctaggcagtgtgttgcaaatgcaaagcgaaccagtgcggattcaaacgtcaaagaacacattggatctaagaggaatgcgggcggaagaagcggttcaccagctagacatggccatctcgggaagagactcgggctcgatcctatttattattcatggaatgggggcaggcattataaaggagctagtgcttgagaggttaagaaagaacactcgtgtctcaaggtatgaacaggcaaatcctatgaaccatggatgtacagttgcttacattaaatgatatatctctcaaacaca

SEQ ID NO: 87 - DNA, 2053 bp, Solanum lycopersicum
aaaaaaaaacccctaaaaaaaccaaccattgaattccaagaatgtagatatacataacaccacaaaacacacacaaaaaaaaaaaaaacactagtaaattttttttctttcatttttcactaatggcaagtgctactacatcatcatcaacaaataaaattcaagaatatgatgaggttacaagttacaaaaacaagaattgtgaagtttttgttaatagacaagaaattaaagatgcaattgctaaagcaattgaattaagagctttacatgctgcccttttacaacaacaacaagggaatagtcctatgaagaagttcccttcttctgcttctccaactctttcacttcattctcaccatttttcttctcaagattatcctattttcacaccaagctatgaagatgaaccattgccaggatacaaacaactacacttagatcacaatccaaactatgctgaagtttgggatgaatatggagtagtaaatggtaacaatgaatccgttttatcggattacagaaaggcgaattcgaccttcaaaaatggatttactaacagtctgatcaacttagaaccccacatgtgtccagctgatgatcagagatcggtcacgagctcgtgtactgatcatgtcactacgcgtaaagcctctcccatcgctcgttacatcaagtctcggagaaactcattaggggacttgaactctatctcatcttgcaacaagtgtaagcctgcaacaattagtactgaggttgatggtggtggtagtagtactagcaagagtggtaagaactcgaatgtcatcgtgccattgacggactcacatgtttctgttcaatcgcagccaaagagtaaaggcgggatgaacttgtcgtggctgttccctaagctaaagaagaaaaacaaggttgagatttcaccaaaccgaacagatcaatccgatgaggttttaaaggatcaccatatagggatggtttcaatcgagacgttgaagaaagagctaatggaagcaaacgagagcagagatgcagcgttgattgaagtctcgggaatgaagtcgtctttaggtgagctaaagcaaaagttagagtacttagaaacttactgtgaagagctgaaaaaggccttaaggcaagcaattcaagctacagagtcccctgtatcctccaacaagctaagaacttttcctaatggaaaatccatcgatggggacggagaaaatgtgatcccggttaatgatgaggtaatgctagaagggttcttacagatggtatcggagtcaagattatcggtgaaacagttcagcaagactctaataggacagattgaagcaacagacaatttgttaaccgataacttgaaccttttgcttcaaccttacaagctatctctcaactcgaagtactcgaaagcagtactataccacattgaatccatcataaaccaatcactttttcaagacttcgaaaactgtgtgttccaaaagaatggctcagcaaaacacttagaccctcaacaagatcgccacgctcagttctcatcatttgtcgcgctgaggaacctaagttggaacgaggtgttgaggaaaggtacaaagtactatagtgaagagttcagtaagttctgtgatcagaaaatgagttgcattatcgcaacgcttaattggacaagaccatggcctgaacaactcctccaagcgttcttcgttgctgctaagtgcatctggttgctgcatttgttagccttttcgttcaatccttccctcgggattctacgagtggaagagaatagaactttcgatatgcattacatggaggacgtcttcgcggataggcaaagatcacaaggtcctagcaaggttaaggtcatggttatgcctggtttttatgtgcatgatagagtacttaggtgtaaggttatatgcaggtacaaaaatgtatcatagttagggtttctcttttctcatttttcttgtttagtaatctaacttgtaatagtgttctcttgttgattatttgatttgagtgagttctataaactagttgccat

SEQ ID NO: 88 - DNA, 881 bp, Solanum lycopersicum
accaaagatttttttctctctctctgttttcgatttctagagctttttctgtgttaagggttgttatcaagatttggaaaaaaatggctggtggtggagcatcgactaaggcttcaaatggtggtcctactagggtgaggaagagggttgaagttgaatctgctgcttctgctgctagtcttaagcgtgctaaggatggaagtgcttttgctcgttgtgaagaatgcagcaaggatgtgcctatagcattgattagcttccacaattgcagtcttgatgcaaaaatcaagatgaatttggaggctcaagttgtggaaaatcagactgaagtgaagaaaccagcagcaaagagcaaggagaaatcaacagagccaaaggctaagagggaaaagaaacccaagaatcctaatgctccgaaacgccctcctagtgctttcttcgtgttcatgaatgattttcgacaggaatttaaggctgcaaatcctgattgcaagagtgtctccatggttgctaaggagggtggtgagaaatggaagtccatgactgatgaggagaaaaaaccatatcaggaaaaggctgcagagctcaaagcagcatatgagaaatcctttaagtctaacactgatgctgataattccaatgatgacgatgaggagcctgagaaggaagtaaaggaagagatagcggtagatgaagaagcgaaggaagagatagaagtagatgaggaatagagctgttagtttttgaactggtgtagcaaccatcttcaatattcttgaattgactagttttgaaggcttgtgtaaatttttgatcaattgtcaacttagttgttctacttgaagtagttatatatggaaactttagttcttgcttacaaa

SEQ ID NO: 89 - DNA, 1720 bp, Oryza sativa
acaaatactagtttggataacgagaaaaacgaccacctcacctcacgaaaccggcaatggcggccgccggagcatcggctctccggccacacctcgcccttctccccgccggcggcggtggaggcggaggcggcggaacccgtagctatgccctccaagcgctatccttcgtctcgcccctcctccctcattgcggccgacgacgccgctgcgtgctccgctccaaggcctcttcgtctccgtctcccccgccatcgccggggaaggaggcggtggctgtcccgacggcggagtcgtgcgtcaacctgggactcgagctcttctccaagggcagggtgaaggatgctcttgaacaatttgagaatgccctagagctgaatccaaatcctgttgaagcccaagcagcactatacaataaagcatgctgccatgcatttagggaagaaagcaacaaagctgcagattgcttaaggacagctctgcgagattataatctcaagtttggtactatacttaatgatcctgacttggcaccgttcagggcatcaccggaattcaaggaacttcaagaagaggcattgcgtggtggagaagatattggttctgggttccgaagagacctgaaactcattagtgaagtacaagcaccatttcgtggtgtccgaaggttcttttatgtggcgttaactgcagcagctggaatttcaacattctttaccattcctagacttatacttgcagttcaaggtggcgatggtgcccctgatctgctggaaactgttgggaatgctgccatcaatattggaggtattgttgtgctcgtggctttgtatttctgggaaaacaagaaagaagagcagcagatcacacaaatttctcgcaatgaaaccctttcaaggttacctgtccgcctgtcaaccaatcgcattattgagcttgtgcaactccgggacattactaggccagttatactggcaggttcaaaagcatccattactcgagcaatgcaaagagctgagagatatcggactgaactgctgaaacgaggtgttcttctaattcctgtgatctttggtgcttctcagaaagcccaaagtaagccaagaggctttggaagttcaagatctgctgcatcagctccttcagttggggatgactttgagaagcgtactgaatctattgcagcgaaatcacggttaaaagctgaagagcgatttaaggctgatattgtctctcctgaacaatgggaaagttggatacgtgaccagcaagagtctgaaggtgtcactcccggtgaagatgtctatataatcctccgattggatggtcgtgtcagaagatctggaagaggcatgccaaattggaacgacatattgcaggaacttccacgacttgaagaactgctgagcaaacttgaacgttgatgaaggtgtgtatacaactgcagtttgatcatccatatgtttctccattgtattattaattccctaatctatgtatagaccataccaatgtaattttgagggaaaattttgtttatgccactaatatatgaattcccaacttctgacgtactccactagttactgtgtgacttctcgtttatgtcactactatcaagccacataccattttttttcctgttttgctcccattctgtcaatttggactgtaagagaaaacattgcaaaatgacagatatatcttccctgtgtcatca

SEQ ID NO: 90 - DNA, 2430 bp, Oryza sativa
atctattaaaccatcgtctcatctcatgattctcatcggtagcagcagcgtagcactattccattcccttcatgctggttagcttctcccccttgttcgatgcctccggatccctaacgcttgcttctcccatgccactccactcccacctcctccttctcctgctggctctctccacgtcggtggttgctggctctgtctcctcctccccctcggtttgtgccggcggcggtggcggtggcggcgacgcggccatcgtcgcggcggcgttccggggcgtgcgcaacttccagctgcctccatgcggggctgtgcgggagctgcggctcccgtcgcggaacctcacgggcgccgtggcgtgggcggcgctcgccaacctgtcgggcctcgccgtgctcgacctgtccgggaacgcgctccagggcgccatccccggggggttctggcgcgcgccgtcgctccggcacgtcgatgtctccgggaaccagctgggtggggctctccgggtggtggaggctagcccgcggctcgagtcgctcaacgtgtccggcaaccggttcaccggcgtcgctggggcggaggcgctcgccgggctccgcgtcctcgacgtgtcggcgaacaggatccgggcggtgccgcaggggctgaggcggctggcgcgggtgaaccggctcgacctgtcgcggaacgcgatgcaggggaggttccccggcgacctcccgccgctcgccgggctccgtttcttgaacgtctcgtacaacaacttctccggcgtggtggacggcggcgccgtcaagaagttcgggcattctgctttcgtccactccggaaacacttcgctggtgttctccgagaactcgacggcgcggcggcctccaccgccgccttcgccgccgccatcgcatccacatagaagtggcggaaagaatgataccgcgacgccggcgaggaggacgcggacgaggagcaggaggaagcatttgagcgtcgtcacggttgcggtggtgtgcggggtggtgtccgtggccatgctgctctgtctcgtcgggtgcgtggcgtgcggggtgctgcgttgccgcaagaacagggggaaggaggcggaggaggagaagaggaaggcgcattggggcgggaaggacgaggaggaggtggtggccgtggcggcggcggcggcgaaggggggttctgctgcgccggtggtgctgttcgagcggccgctgatggagctcacgctggccgacctggccgaggccacgtccgggttcgggcgcgagtcgcagctcgcggagcgcggcggccgcagcggcgccgcgtaccgcgccgtgctcccgggcgacatgcacgtcgtcgtccgcgtcgtggacggcgccatggccgtcggcgaggacgacgaccccgcgaccgcggcgaccgcgttccgcgacctcgcacgtctccggcaccccaatattctcccgctccttggctactgcattgcagggaaggagaagctcctgctgtacgagtacatggagaaaggcgacctccaccggtggctgcacgagcttccagcagggcggcccgacatggaggacgacaccggcggtgacatctgggaggtggcggaggacaagcggtccatctccgactggccgacccggcaccgcatcgcgctagggatcgcccgagggctcgcgttcctgcaccaagggtgggcagggtcgggtcggccggtcgtgcacggtcatctggtcccaaccaacatcctcctcggcgaagacctagagcctcggatatccgacttcggccaccctagcgacacgacgccagagggggatgtgtacagcttcggcgtgctggtgctcgagctcataaccggccaagccggctgggacgaagcgtcagttagctgggcgcgggggatcatccgcgaccagaagggtctagacatcgtggacccgagagtgcgggacgaggcgggcggcgggccggagacgtcgacggtggagcgggagatggtggagtgcctgcgggtggggtacctctgcaccgcgcagtcgccggagaagaggccgacgatgcagcaggtggtgggggtgctcaaggacatccgggtggcacctgccagcagctcatccacttgacggtggtggagcagcgccatcgtgtgtgtccgtcgcaattgggacccgccgtcgcctgagaagagatcccagtgtggcagcctttcctgatctggtagacaagccttggtggtcggtagtagaaacacatgtgcatgtaacaattttttctcgccggtaaaacagttggtttcagagccccttgtctctcttgtttttactttggtggatttattgcgttgggcaggaacatcaacagttttggtactgtatttaattgcaagccgccatgaggcatacagtatatatacatggttcccttccctcc

SEQ ID NO: 91 - DNA, 2070 bp, Sorghum bicolor
ccctgccgctagcccgctactacccagaaagatggcggcggcgatggccaggcgtgccgctggccttctccctctcctcctcctctcttcgcggtccggtgctcgcatagccctccaccgggcggtatcccagatccctccgcctcgctcctatcgcctactctcgcagcaagccaatccctccccatcctcatcattctccgcctccgcatccgcatcgaatggcacggctgcagagagaacccgggagctgcatctgtacaacacaaagtcgcggaaaaaggagcagtttcggccgcgtgatccaggcggggaggtcggcatgtacgtctgcggcgtcactccctacgacgacagtcacatcggccatgcccgcgcatacgtagcctttgacgtcctctacaggtacttgcgctatttggactatgaagttcgctatgttcggaacttcaccgacattgatgacaagataattgcaagagcaaatcagctgggggaagatccttttagcttaagcaaaaggttctctgatgacttcctgtcagacatggccaatcttcaatgtttaccaccatctgtggagccccgtgtttcagatcatattcatgagattataaatatgattaaacagatccttgataatagttgcgcatatgtagtgggtggggatgtttatttctctgtagaaaattttcctgagtacggagaattgtctggtcggaaactagatgataatagagctggtgaaagggttgctgttgatgagaggaagagaaatccagctgattttgctctatggaaggccgcaaaagatggggagccatggtgggatagcccgtggggcccaggaaggccaggatggcacatcgaatgcagtgccatgagtgcgcattatttgggtcattcttttgacatacatggtggtggggaggatctcatctttccacaccatgagaatgagattgctcagagccgtgcagcatgttgtgacagtaccataaattactggatacacaacggttttgtcaatgtaaatagccaaaagatgtctaaatcacttggtaattttgtcaccatacggaaggttatagagatgtaccatccgctggctttgagaatgttcttacttggcacacactacaggtccccaattaactacacaatagaacaactcaatgttgcatcagacagattgtactacacatatcagaccttgcgtgattgtgaagagagttgtcagcagcaaggaagcaacactggaaattcattgcctcctaataccttaaattacatccaaaaacttcatgatgaatttgagacctcaatgtcagatgatcttcacacttcagtggcattggctgctatttctgagccattgaaagttatgaatgatctgttgcacactcgtaagggaaagaagcaggacaaaaggttggaagctctttctgccttagacgagaaaataagagtagtgctctctgttctaggattgctaccttcaagttatcatgaggctttgcaacagctgcgggataaagcactaagacgagcttccatcactgaggagcttgtgctgcagaagattgaagagaggactgcagcaaggaaggcgaagcagtatgaaaaatccgatgagatccggaaagaattggctgctgttggaattgccctcatggatggccccaacggaacaacttggagaccatctttgcctctttcagaggaagctgtggttgcgaaaacatgatctgcgcacaaaattccagtgcgacccgtggacaccagttctagtcggtaaatcatgggtttgctacatcgtgctactttttgtgacgaagaaaccaacggagttcctgagaaatcatattgtttgcacaattctctgctcccattagagctacaatagttatatgatcatattcggtaaaaaaaagatgtccgattttggttttcactttgcaccgagtccttgcctaacgattgaaatttaacatgacagcctttactacaagttctgtgaatgatattgccgaatattttaactaatacaataccattttcctttgagtc

SEQ ID NO: 92 - DNA, 3362 bp, Oryza sativa
gtaagaagaatacgtcaagtccacacgaaagcggtattcgatggggacaaaccaggataaggcgaactttccggcgggaagccaagccgagctctcccgcctctcccacggccacagccatggcggccgccgccgccgccgccgccgcgaaacccaaccttcttcttccagtctccgtggctatcccctcttctagggtttctcttcccaccggcctcgtatgcagcgcacggtccccgccgccacgcctcagggccgccgccgccgccgccgccgcctcccaggccctaacgtcgcctgtcgcggcggagactccggaggcgaagcagatgcgggtagagacggaggccgccctggaatggggcggcgtgtgcgcgcggctggccgggttcgcctccaccgccgcggggcgcgccgcctgcggagaggggcgggtgcccgtcgggcggagccgggaggagagcgagcggctgctcgaacagacggcggcggccgcgctgctgcctgctccgctggatttcggcggcgtggaggacgtgtccgccgccatcgccgcggcggctggggcccggctgcttgcggtgagggagatatgtggagtcgggcgcagcatccgtgccgcacgcagggtgttcgaccaattgaagacgctctcagaggagacaccagatggaaggagctacactcctcttctggatataatgcaagactgtgacttcttgacagaacttgtgcaacggatagagttttgccttgattatactctttctgtggtccttgatcgggccagcgataaactagcaacaatccgcaaggagaggaggaagaacattgatatgttagaatctctgttgagagatacatccacaaagatcttccagggtggtgggattgatagccctgttgtcactaagcgccgttctaggatgtgtgtcggtgttaaagcttcacacaagcatctggttcctggtggaattgttttgagttccagtggctctggcgcaacatattttatggagccaagggacgccatcaggctgaacaacatggaagtaaagctctcaggtgatgaaagagctgaagaattagcaatattgggtctacttacttcaagcatagctgactccgaaatgaagatcaggcatttgatggggaaaatattggaacttgacctggcttgtgccagaggttcatacgctttatggataaatgctgtgaggccagcctttactgacagggatagtgatactcaactgaatccaaatagtgaatgctcagtttttatcgagggcattcagcatcctttacttcttgaacagtctcttagtatggtaaaagaatcaaccagagtagggaaaggacagctttctgatgaacatcttgtctctccaatgcctattcctctggacatgcaggtgagaaacgatactaggataattgtgatctctggacccaacactggaggcaaaactgccaccatgaagacgttggggttggcctctctgatgtcaaaggctggaatgttcttcccagccaaaggaacccctaggcttccatggttcgatcaagttcttgcagatatcggagatcaccagtcgctggagcatagcctctctaccttcagtgggcacatatcacgtcttcgcaagattgtacaagttgtgtcaaaagattctctggttcttattgatgagatcggcagtggtacggatccgtcagacggtgtagccctttcaacaagcatcttgaagtatcttgctagtaggcttaatctggccattgtgacaactcattatgctgatctaagtcgtctgaaagctgttgacgatcgatttgagaatgctgcaatggaattttgtttggaaactctgcaaccaacatatcagatcttatggggcagtactggtaattcaaatgcattgagtattgccaagtccattggttttgatcagaaagtgcttgctcgtgcacaagaatgggttgagaaacttttgcctgacaaacagaaggaacgccaaggtttactctatggttctttgctagatgaaagaaaactactggagtctcaggcaaatgaagcagcatctgttctttcagacgttgagagactgtacaatgagattcgctctgaagctgatgacctggatagtcgagtagcagctttaagggcaacagagtctgaaaaggtgcaacaagagttaaagtttgtgaagtctcagatggaccaaataatcaagaactttgaatctcaactcaagaattcagaacttgaacagtacaattcactaatgagaaaagcagaagctgccactgcttcattggctgctactcaccagccaactgattttaccttcggtgatgaagaaaatgagagctcatatgttcctgaaatcggagataaagtgtacgttgaggggctgggaggaggaagtatggctagtgttgtcgagacacttggggaggatggtagctgtatggttcagtatggaaaaataaaggtccgtgtcaaaggaaacaagataaagctggtccaaagaggcacgaaggacacgtcagcctcctctcctgtaaaaggaaagggacgaacaccgaagagatcagcagcagaagccaaccaagatggcaatgtctcctttggcccggttgtgcaaacatccaagaacacagtggatcttcggggaatgagagtcgctgaggcatctcatgagcttcagatggcaattgacgggtgcagaagttaccaggtcctgtttgttgtccatggcatgggcactggagctgtcaaggagtgtgcccttggtatactccgaaaccatcctcgagtagccaagttcgaagacgagagccctctcaactacggctgcaccgtcgcctacatcgaataagcacattatacggcttcatcgaaaacttatggcaaagatcgtcttatgcacacttgcacgatactagctggattatacaggattgtatgccacgtgagatgaaattttgaagccgtatggttgccatgtgacaactgatttggacaaggtggcccaggaactaatggagcttggagctgatctgtgcgctgatacaatgcacaatggtggcattcaagattagcctgtgagtacgaattcttgcatgtgttacctttgacttcttaatccatggcagatatatgcatagttttgtacaggtgaaagtcacacggtacttgagacagatctccgtacatataaactacacatgcgtgcagttcgttctgcagttgaaaaagattgtccggtttgttcagatcacgcatatcatattacaacttccatcctaaaatataataatttttagcatttaaaatttatactaacatatgacaa

SEQ ID NO: 93 - DNA, 1773 bp, Solanum lycopersicum
gatatttagtgacacatatgtatcttgtatcctttattattattatcatttatcttgtcagctttcaaagttgaagcaagagagagaggcctatggattactatacacttgtgtttgtgtcaattttagtgttggctaatatcatagcaaaaatatgtagcaaaggaagcaaaaaacttccaccaggtccatcaccatggccaattattggaaaccttcagttgttaggtgcaaaacctcatatatcactagccaatcttgcaaaaaattatggtccaattatgagtttaaagttaggtcaaataacaacaatagtcatttcctcatcaaccattgcaaaacaagtccttaaaactcaagatcaagccttttcatctagatttgctcctaatgctcttcaagcgcacaaccattacaaattttctgtggcatggcttcctgtttgtcctcaatggcgaacgcttcgaagaatattgaacactaacctcttatcttccaataagcttgatgcaaatcaacatctaaggtctcaaaaggtgaaacaattgattgattattgtgacaaatgtagtcaacaaggtgaagctttggatataggtcaagttgttttcaagactagtcttaatttgttgtcaaacacacttttctccaaggatttggctgatcctttttcagattcaaaggtagagttgaaggaagttatatggggtatcatggctgaggtagggaagcctaatttagtagattttttccccatacttgaaaaaattgatcttcaaggaataagacgtcgcgctatcattcattttggtaagttgtttaaactttttgatgatttgatcaacgaacgattggaggaaaagaaaagaccaggattcatggaaaagagcgatgttcttgaaatatttctcaatattactgaaaaaaatcctcaagagattgatcataatcacatcaagtccatgttcatggacctatttggtgcgggtactgatacaaccacaagcacattggaatgggcaatggcagaattgcttaaacaacctgagataataaaaaaagctcaagttgaacttgctgaaatcattgggaaaggaaaattaatagaagaagctgatgtttttcgactcccttacttgcaatgcattatcaaagaaacattaagattgcatccaccggttccgctcttagttccgcgcaaagtagaccaagatgttgaattgtgtgactacatcatcccaaagggctcacaggtactagttaatgtgtgggcgattggtcgagattttactttttggaaggatcctttagagtttaaacctgagagatttttgaatttggatctggacatgcgaggacaagattttgagttgattccatttggtgctggacgaagaatatgccctgggttgccactagcattgaggatgattccagtaatgttgggctcactgttgaattcattcaattggaaacttgatgcaggtattgagccacaagaattagacatggaggagaagtttggtattaccttagccaaagctcatcctttgcgagctatcccctctcctctttgatcgatgttgcattgcctagtcgataaatatttatatgtatttgatatttacgctgaagcaagtattttaatctaaataatcatatatatgtatattgcctatatatgtttctcatgaatgttatttgctttaggcaaaaagagaataaatataaaagattatgaagatcaaaagaggagattcatgttgtgcaata

SEQ ID NO: 94 - DNA, 1583 bp, Hordeum vulgare
gcccggtttgcccatcgccgagaccagaaccctaatctgagatcgcgaaccatcctcttccgatgtcagacgtcaccgccgagtccacgccgcgccttcgcctgcctacgccgtcgccatcactatcccagcagcagtctcgcggtcgtcagccgccacctcctggctccgaccccctcgctctcggcgtcgtcatcttcatcgccgtctgcttcctcctggtttcaatctcagctccatcaagcattttacatcaagttcccgaaggacatgttggggtatactggagaggaggtgctcttttgaaaaccattactactccaggttatcacctgaagctgcctttcatcacccagtttgagccaatacaggttacactccaaacagaccaggtcaaaggtattccttgtggaacgaaaggtggtgtcatgatcagctttgacaagatagaggttgtcaatcgtcttaataaagactttgtttatgacaccctactcaattatggtgtgcattatgataagacatggatatatgacaaaattcatcatgagataaaccagttctgcagtgctcatagtttgcagcaagtttacattgacatgttcgatcagattgatgagaccatgaaagaagctatccaaagggactgcacgcgctatgctcctggaattgagattatcagtgttcgtgttacaaagccaaacatacctgttagtattaggagaaattttgaacttatggaggaggagcgtacaaaggcgctaattgccatcgaaaggcaaaaggtggcagaaaaggaggcagaaactcagaagaagatcgccctatctgaagcagaaaagaatgcactagtgagcaagatcctcatgcaacagatgctaacggagaaggacagttccaaaaggcagcagcagattgataatgaaatgtttcttgcccgagagagagccctcgcggatgcaaactattacaggattacgaaggaagcagaggctaacaaactaaaacttactcccgagtatcttgagctgaggttcattgaatcaattgccaataacacaaagattttctttggagaaaagattccaaccatgattatggatcaaagattgattcggaatcaccttgattctgctctgagcaaggaccggttagaaatatagtagcatctcttgaaaatttgaaggaacgttggttgttttgtaatcctgtctggaggtttggatttcgttgaagcccttcggagcatgtgaataaaaaaggatgagatactaggactctttaagatttgaagtagctagcctttggaattgccttaatggctttcaagcaaggaccgtttagccttgtggaatacttgtagttgaacgataaggaaaagaaatgcggagctcacagctgcaatgtgttgcaactggtagtgatttgttaggacttccttagcatgctagtactataacactgcaatgtgttgcaactggtagtgatttgttaggacttccttagcatgctagtactataacactgcaatgtgttgcaactggtagtgaatttgttaggactttccgtagcatgcctagtac

SEQ ID NO: 95 - DNA, 2076 bp, Oryza sativa
aagcgaaaaattggttattagtgggagcgtgcatgcctccatttctgccgctataaatactcatctcatctcatcatccaccatcagtccgtgcagtttggagcccacacaccacgatctcccgtaccttctctctgcgagatggggaggataaagagtagtagtgggcgatgcagcacggcgaggctggaggcggtcgccgtcctcgtcgtcgtcttcggcgtcgcgtcgtcgtcgctgcgaggatgcattgcgcagcagagcggaggagggctaaccaggggcagcttccccgaggggttcgtcttcggcaccgcctccgccgcgtaccagtacgagggagctgtgaaggaggacgggagagggcagaccatctgggacacgttcgcgcacacctttggaaagatcaccgacttcagcaatgctgatgttgcagttgatcagtaccaccgtttcgaggaggatatacagctcatggcagacatggggatggatgcgtatcggttctcgatagcatggtcaagaatctacccaaatggtgttggtcaagtcaatcaagctggtatcgaccactacaacaagctgatcgatgcacttctagcaaaaggaattcagccatatgtgacactctaccactgggacctcccccaggcccttgaagacaagtacaagggctggcttgacaggcagatagtggacgatttcgcggcgtacgcggagacgtgcttcagggagttcggggacagggtgaagcactggatcacgctcaacgagccgcacacggtggccatccagggctacgacgcagggctccaggcccccggccgctgctccgtgctgctccacctctactgcaaggccggcaactccggcaccgagccctacgtcgtcgcccaccacttcatcctcgcccacgccgccgccgccagcatctacaggacaaaatacaaggcgacgcagaacgggcagcttgggatagcgttcgacgtgatgtggttcgagccgatgtccaacaccacgatcgacatcgaggcggccaagagagcgcaggagtttcagctaggatggtttgctgatccgttcttcttcggcgactacccggcgacgatgagggcgagggtgggggagaggctgccgaggttcacggcggatgaggccgccgtcgtcaagggggcgctggatttcgtcggcataaaccactacaccacctactacacgaggcacaacaacaccaacatcatcgggacattgctcaacaacaccttggcagacaccggcaccgtcagcctcccattcaagaatgggaagccaattggagatagggcaaattcgatatggctgtacattgtgccccgagggatgaggagcctgatgaactatgtcaaggaaaggtacaacagcccaccagtgtacatcactgaaaacgggatggatgacagcaacaacccgttcatttccatcaaggacgccctcaaggacagcaagaggatcaaataccacaatgactacctcaccaatctggctgcttccatcaaggaggacgggtgcgacgtacgtgggtacttcgcgtggtctctgctggacaactgggagtgggcggccggatactcctcgagattcgggctctacttcgtggactacaaggataacctcaagagataccccaagaactcggtgcagtggttcaaggccctcctgaagacctgaactccagctgagaagtagtgctacaatagtttgggcgccatttccatacatccgatagatttattggtctgcacatatacgaatatacgataccctgcatatctcggaaatgttttgtggtttttgttttgtttgtgatacgatagaatgtatcactgaatcgtctggtctgttagcacacgagtgaaaaggggtagtactgcactctgcaccttgtcagcttcaaattggaagtccggattcggctaatgcagagggtggcattagctccaatcctatccatctatctctattcaacggctgtgattagttaaacatctttcttatttttgctgttcgtatattttgacagggaggagatggttgcaa

SEQ ID NO: 96 - DNA, 1038 bp, Sorghum bicolor
gaactgactggcctgacctgaggaagaggataaagaacaccccgaaatgccactcctgctgctcccaccagcggcgtgcaccacggcagcgaccgcgccggcgtctctcgcgttctcgcggcctcggtcgtcacgggcgcgttggtccagcctctctttcgcgttcccccgcctgaggaaatacgggcgccgccaacgcgagcccgtggccgcccccagcctcgatgacgacgaggacgaggaggagacgggggcaggggagtgggagtccgacgaaggtgaggaagagatggaggtagacgaggaggagtttctggcgacgcggcccaagccggcgggatttggtgaggggaaaacgtattccactgacattgaggagcagcttctccgggagatgggcttcggcggtggcagcgagcggcgtcgaggagaggcggccccggccagtcgccgcgccggggatagttccaccaaagtaatggccgcagatgccagtgacgatggtgttcaagttcgtgtctggaaccttccaaaaaagaaaaacatacacaaggatctgaagcaagcttttaaagggttccgtggccttttatctatagaaccagcagtttccgcaaataagaaaactcgtgatcctatctgtaagggtttcgcatatctcaaactagagtctgcggaagctgcaacaaggttcgttgagatatactctcatcaaactgtgtcatttgggaaggttcagaagccaatcagttgctgtatcgtcgataaaggcagctctgttgagccttcaaaagcatccagtagtcaggcaacccctcaaccaatgttgaagcaccaaaaattggtagcggcgagttaagtaacacatgtatctgtcatctagcacaagtggtcacgcacacttctagaggtcgcaagttttctgaaaaagctttgataaacagattagattagatagtcctctgtattccaaacaattgctttgtacgtatcaagcaatttggtcttgttacccatctatataggcaatagtattgg

SEQ ID NO: 97 - DNA, 833 bp, Sorghum bicolor
cagctacctacacacacatcactcattcagttgccagtcagtttgccaaggccagttgcgcgcgcagagggaggagaggaccggaggagctgcgctgcgctgcgccgcgcagatgtgggcgccggggtcgccggggaggctgccggcgctggaggagtgcgtcgagggcgaggacggggaggcgtaccacggggccatggcctcctgctggggccgcttcggcgccgccgcgctgtggcgcaggctccggcagcgtctcagccttgtgcggcgcatgcggcggcgcggccgctcctccctcctcggcgccggcgggctcaactacgacccgctcagctacgcgcagaacttcgacgacggatgcctggagctggaggagcacgagccggacttcagcgccaggttcgcgcccgcgcgccacgccgccggcttcccgcggcccacggccgcggcgcgcgacgtcgtcgcgaccgcttgacggcgtaccacacgtcctccggcttttacctcccgtaacgctcggtgctcgccgctcgcccgcgcgcctatggaagggctagcggcaaattcctggtaatattgctccacacgtcttttagttgataaatgtacatacatggcacacgccgtcgatcgactcatatgcatcatggatggatgtaattaagtaggttcgttattatagcgtaatcgagctcgctcagacgaaaataaaatttttcttgccgatttgctgtgcattcagccagcggcagcgttcttgaattttttatgtgttcatgtacgcttgtgattcgggcttcggcacagtaattgctgttctgaattaggcc

SEQ ID NO: 98 - DNA, 886 bp, Sorghum bicolor
cccccagatccagtcaccactgcccgtccacaagccacaccaacccgcctcaccccattcatcgacgggacgacctcgccggcgagagagagagagagagagtgacagatggaggcggcggcagcggcggccggcgtggagctcggctcctcgaagccccagatcgcgacgcaggcggagatggcggaggcccgggtgcccctcgcctaccgcgaccagtgcgcgcacctcctcatcccgctcaacaagtgccgcgtcgccgagttctacctcccctggaagtgcgaacccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctctcctgatccggccccggcccgatccgcttgatttaggtctgccggctatcgtgcagaggcattgtgctgtgcaaggatcctgaatgtttgttgtgtgaacaaacatgtgtttgaatttggcataaagttaactgttgtcttcttcccttccccctctctccctgatgggcatcttcaagtttcaatttgatgatggaataaggaaacattcttgtcctataaccgaagactgaatagcgccttcaagttttgaatacaatccttggtgtagactgactcacctctgtttggttgtttggttgggttactgcgtagtaaaaccaactactgtggcatggtaattgcagcagtttgtgcctggcatgccgtcgttgtgcggtactgttgtgttagtgcatcgatatgcatgcgtctggacctgagtccccttgttaattatggtcgcgttttaccaatc

SEQ ID NO: 99 - DNA, 1795 bp, Sorghum bicolor
atgaagacaaggttagctcaacccaagaaagctccactagagcagtgcgtgcacggtgcaggtgcacacacatggatcccttttgactgttcgttctagatctagcgattagcgacacttgctcgcaggagattctcgcaagaacagctcaccggcagtagcaacatgccaatatcataagcacaatcgcaagcagcatccaggtcgcagctgcccacccggacaccagcacgtacccacaactcccaagctagcagcggtggttggcacgtcgcagttgatacggaggcgtagccgcgtagctgtactggttctcgcgtgtcggcgtcgacggccgtctccctccctcggcgaagatggccatggggcgcgcgtccgccgccacgctgctcgtcgcgctcgccgtcctcgctctggcggtgatggcgcaggcgacctgcgacgacgagctgccggctcagcttgccggcaacttctcggggctcgcctgcgcccccgtctggaacaacttcgtgctccggtacgcgcagggcaaggacaacgtgctgcgggtggtgctgtcgaccatgtacagcacagggtgggtggggatggggttctccaagaacggcctcatggtgggctcgagcgccatggtggggtggatgggcaagacaggcgtcccgcacatcaagcccttctcgctggagggcaagaccccctccaaggtggtggcggaccagggcttcctcgcctccagcgaccaccacaagcccaccgtgctcgtgcagcaggccaagatctacctcgccttccagctcagcttcaccgagccgctcaagagccagaacgtgctcttcgccattggctccgccatccccgtcaacgaccacctctccgagcaccaggacaagaccgccatcgtgtttgatttcaccacaggcagcgcttcaagctcatcatccttcccggacggtctgaaaaggacccatggggcgctcaacttgttcgcgtggggtgtgctcctgccaattggtgccattgttgcaaggtactgcaggagatgggaccccctctggttctacctccatgccggtatccagttcgtgggattcatcctgggtctggccggcgttgtggctggagtatcattgtacaacaagatccaagccgacgtcccggcccataggggccttggcatatttgtgcttgtgctaggcattttgcagatcctggcaattttcctgaggcccaataaggactccaagtaccgcaagttctggaactggtaccaccactgggtcggcaggctcgccctcttctttgcagccatcaacattgtgctcgggatcaaggtcggcggcgcaggcaactcttggaagatcggctacggtttcaacctggccatccttctgatcaccatcatcacgctggaagtcctgctctggacaaggtggaaaaacaacagcggttccacgggggcatattagcagcgacttaccgatttatttaggtgttcgtgatggtcactgaaggagatccatattcttctttcaatgttttcaagtgtaatgttcgcgtgtgctgcaggatctgttttatagcggcaaagatctgcaagcaagacgagtatgcgtgatgcgttttggtgtttgttagaactggtcagaaaagcttgataggatgtgcgacgggcttgccgttccggtgccttttgtactgcacggagtggagttggaatgatgatttccgcatttcccttggtgtgtactatggtggtagatctgggccttgtttacttcccaacaaattttgc

SEQ ID NO: 100 - DNA, 1163 bp, Triticum aestivum
ctgccgacgagttactagttgttctatctgatctcgcggtatcagatctcccagagaaggtgcagaatcatgactcttctcgccacggttggtcagcctcatcctccgtcgaaggtgatctcccgccgcgagcactccaaccgggggcacaagctgacccgggagccgacgggccaggccaagttcaagtgcaacggctgcctcgaggagatcacggggtgcgacagggacacgtgcaagccttgtgacttcgacctccaccaggcctgcaactacaaagaagggaccacgctggagcaccagctgctgcccaagagcaagttcgtgctccgcctcgaggcccccccttccaagcagcgatgcagcgcctgcggcacccgcacgcagggcacccactaccactgcgcacggacgggccattacctccacccgtgctgcgcgatgctgcctatggagatcaagctgagtgatgagctcagcttcgagctccgcgagaaggggtctcgccgctgcgccaagtgcagggaaggaggcggcgtcagggactactggttctactgctccaactccaactccaagaaagtgcacctgcatgtcgcctgcgcgagagaggattttcttctgccgagctcaagcagtaccgagtctcactctgacgtcggcggtaatggcagggcgagcaaggagactgcgttgcggaagtacgggtcggggaagtccgggatgaacctgggcaccataggcgacatcgttaaggccctggcgggcatcgtcctcgcggtgctcactggaaacccgctgccgttgatttctgcaggggtcgatctgctctccagcgtcgccaagttgaaaaagtagctagcagctccatccttgctcatcctacgcacgtacgtacaacttgttggtgacgggctgcatggtgatatatgtaacatcctactatttgtacgatatagtccccgcctgcattgtgtatttgtgatcgctacagtccatttctcatttcttcttccatgtcgaataatgtcaacacgttattatatgtaagtgtgtagatgtgtgatatgtaatcttgcagaatatatcttgtgaatttgagatatgtaatcttgcagctaaaaaaaagggggccggtaccaatcgccatatgatctataccg

SEQ ID NO: 101 - DNA, 1103 bp, Sorghum bicolor
actgctctgctcttgctctccgtctctccccacactgccactgccagcctccctcccctccccttcgctcgccatggccatggcgacctccaccttctccccgcgccccgccaccctcaacaagcccctgcgacctggcgccaagcccgccagcctcctacccttcccgtgccgccgtgccggcagactcgtctgcgccaccgctgccggggaggcgccgcccgtcgaggtcgagcagcgggacgaggcggagccggcccccgccgcggcctccaacggggccgccgtcaaggccgaggcgcccgccccaaaggccgtgcaggctgaggccccgccggcgcccgcgccggtcccggccttccgggacgccaggtgggtcaacggcacctgggacctcacccagttcgacaagggcggcgtcgtcgactgggacgccgtcatcgacgccgaggccaggagaaggaaatggcttgaagattatccagaggccactagcacagacgaggctgtcgtcttcgacacttcaattatcccatggtgggcatggatgaagcgattccaccttcctgaagccgagaagctaaatggtcgcgctgccatggttggcttcttcatggcatactttgtggatagcttgacaggcgtgggccttgttgaccaaatgggcaacttcttctgcaaaacgctgctgtttgttgctgtcgctggcgtactgctaatcaggaaaaatgaggacattgaatcactgaagaagcttatcgacgagtctacgttctatgacaagcaatggctggcaacctggcaagatgattccactgggggaccaaagaattagttcagcattgggatacagatgcagaatcgttcttgtgatgtactttacctctttcttcggcctttttgtttcgccgtctcgtgaggcttggaggaacattttgacaaaccgtaataatctacgtgatcctgtaaaatagtatggactcactttgtgtgctagagataattacgtgcagtttcaatgctttatatggtttgccatctcaaagcatttctcatccaagcagtaagggcaaccatgccatggtattttcatcagtagtatg

SEQ ID NO: 102 - DNA, 1131 bp, Triticum aestivum
accattgttgtttcttcctccttccgccaatcgatcgtccctctatatcatataatcgtccaagtcaggtctccgcgccgccgcgctgggtggggacgtatcgaaacgatggaggacttcgtgctgagctacgtggtgaccgggctggccttctggtcgacggcgttcctggtgatgcgggcgctgatgccgaagcgctcctacgagttctgcaaccgcgccgtctccaccatgcacgccgtcgccgccgtctgcatggcctgcctctccgtccaggagtggtcgtgccccgtctgccccctcaacgccccctcctcgccgcgccagatgaagtccctggcggtgacgctgtcgtacatgatctacgacgcggcgtgctgccacctcaacggcgacgtgcggctcgacaacaccgtgcaccacctggtgagcatcgtcggcatcggcgccggcctggcctaccagaggtgcggcacggagatgatggcctgcatgttcatcacggagatctccagcccgctgctgcacctcagggagatgctcaaggagctcggcgtcaaggacacggacctcaacctcctcgtcgatattctgtttgcggcgaccttttcggtgggacggatggttggtggaccgtacctcacctacgtgaccttgacaacagactaccccatcctcatcaaggcgatggctgcgggtttgcaactggtgagcgcctactggttcttgaggatcctcaggatggtcaggtacaagctcgggaagaagaggccggcggcggcggcggcgaccaagctcaatgccaagtgatccatccatgtacatacatatcttgcttgcaaccttgagcaaattacttgctttctggcgggatgagatcgatcgatcgatcatttgtatgtacaaacccacagtgtgtgcccgattttggctaagaaaaaaggattattcatgtagcatattaattgttccacaggcaagcatcttcccaacaaaggatgcatatatacatactgtagcaattcaactcttgtgcagaaacactttccgatcactaccgcttgcctcctaactatttttagaggattttaggcttctcttcttgctgcttatacagttgttagattggat

SEQ ID NO: 103 - DNA, 1355 bp, Sorghum bicolor
ctcggcgctgctctgctccccacggaccacggggcgccaccacaaaccaaacgcgacgcacgcgcgcaaaatcctgcgaagcgagcgcgacgacatcataatggggcagagccagggcagaggaagaaccaaaccagagacgcggcacgcgacgcgggagggcgaggaggaagaggagcagcatcagcagcgcggcgacatcgcgaggccagacgcaacagccgaagagaaggggcagagtcgaccgccgggagtcccggccaccaccatggacaccttcttcctatcgcacggctcgcccacgctctccatcgacgacaagatcccggcgcggcacttcttcaagtcgtgggtgccggcgaaggtcgcgggcgaccaggcaccgcgcgccatcctcgtcgtgtcggggcactgggagacggccacgccggcggtcaacgtcatccgaggcagcaacgacaccatctacgacttctatggctttcccaagcccatgtaccagctcaagtacccggctcctggcgccccggacttggccctgcggaccaaggagctcctggagcaagccgggttcggccccgtgaaggaggaccacagccgcgggctggaccacggcgcgtgggtgccgctgatgctcatgtacccggacgccaacatccccgtgtgccagctatcggtacagagcgaccgcgacggcacgtaccactacaacctcggcaaggcgctggcgccgctgcgggaggaaggcatcctcatcgtcggctccggcagcgccacccacaacctgcgcaagatgggcccgttcgacgcgcccgtgccgcggtgggtcgccgagttcgacacctggctcaaggactcgctcctgggcggacggtacgaggacgtgaaccggtacgaggagaaggcgccgcacgggagggcggcgcacccgtggccggaccacttctacccgctgcacgtcgcgctcggcgccgccggggacgccgccaaggcggagcagatccaccactgctggaccaacgccacgctctcctacgcgtcctacaggttcaccaccaacagctgacgcgctcctgctctgctgtcggtggaactagatgaacgccggccaccgccccgccacctgctgaatttcgtgggaagcatccgtcgtcggcgtgcgtggcagcatatagcccatatacaagcacgcttgtaattgtaaaaactgtatccctaataaagccccgtgtgccgttccgttcgcagtagatatgtgtttgtcgatgctttgcattgttcagcgcagcagcttattccatcgtcatttttttcaagagttcctaatccccagtatcatttcatcagcattgtcg

SEQ ID NO: 104 - DNA, 747 bp, Solanum lycopersicum
tcctcatccttcttcactctaaattatcacaacctaaatatagtaagttatttataccaagtaaggtaaaaaatggggttaaaggcttttatacttctaacccttgttttggctatttttgcaattgtaacctcacatgttgcagctagagaattggctgagagctccactactactatggaaaatacaaaggaaaatgaggtaaatgatgctaaatatcctggaggaggttatggagggtaccctggtggtggtcgtggaggttatggagggtatcctggtggtggtcgtggacgtggaggttatggagggtaccctggtggtggtcgtggacgtggaggttatggagggtaccctggtggtggtcgtggacgtggacgtggaggttatggaggtggatattgctcctatggttgttgtgaaaggaattactatggtaatggttgcaataggtgttgttactccaaaagtgaagctatgaataaagtcacccaagctaagcctcacaactaaaatttaaaagttatagtaatatttatgtagtgtgtgttttagtaataatagtttttaatttgttgttgggagtttgaataaatgtagcttccattcacttcatgtggatggatggtcaaatattatcttttcattttgtacgtacctactcttttcatatatatgtttgaatgtaattgatatatcataaattcacattaataattaggtaggtagatctgtttacttatatat

SEQ ID NO: 105 - DNA, 2587 bp, Hordeum vulgare
gctcagtcgcgggcgcgcagcgagatcgccacgccacgctctcctccccctccaccaggccggaggcgaactccaaggcgggcggcggtccggcgctcctgctccccgcaatgccggccgcttccggcgcagatcgggccgacgactcctcctaccctcctcctcctcccggccaccgctctcgatcggcgcgtgactctgggtgggcggccggaggacggctggatcttgcggcggtcggcgcgggaacggaaggacgcatcgctcgatttcccgcctggcaagagaagagtgaagagctgatgagaaagcttggactacagagttgaaatctattggcttccagcaagtccgaacaatgcagcatcttacacttgcagcatctctgtctgctgctgttctctttgcatgcatcctgtatgctgaaagtgccgatctgaactctgacaagcaggctcttcttgcatttgctgcatccctgccccatggcaggaagctcaactggagctccacgacacctgtctgcacttcttgggtgggagtgacatgcacaccggacaatagccgtgtacacacactacgcctacctgcagtaggactctttggcccgataccctcggatacacttggcaagcttgatgccttggaggtgttgagcctacggtctaatcgcctcactgttgacctccctcctgatgtaggatctattccatcccttcattccctctacctgcagcataatactctgtctggaatcataccaactacactttcacccagcttaacattcctagatctgtcctacaacacttttgatggggaaatcccattgagagtacaaaatctcactggacttactgcaatccttctccagaacaactctctttctggacccatccctcacctacgtctccccaaattgaggcatttgaatatgagcaacaacaacctcagtggtccaataccaccttccttgcagaaattcccagctagttcattcttagggaatgcttttctgtgtgggttaccattggaaccatgtcctggaactgcgccttctccttcaccgacaccatcagtgcccagcaaacccaagaagagcttctggaaaaggatcaggacaggtgttctaattgcaattgctgctgcaggaggggtattgttgcttctcttgattcttgtactcttgatatgtattttcaagagaaagaaacacacagaaccaaccacagcttcgtcatccaaaggaaaagctgttgcaggtggaaggacagacacccctaaggaagactacagcagtagtgttcaggaagcagagagaaacaaactggttttcttcgagggttcttcatataactttgacctggaagatttgcttagagcttcagctgaagtacttggaaagggaagctttggaactacctacaaggctgttcttgaggacagcaccacagttgtggtcaagagattaaaggagatggtggtggggaagaaagacttcgaacagcagatggagatagttggcaggattggccagcatcagaatattgttccgttgcgtgcttattattactccaaagatgaaaagctactggtgtatgactatgtccctgctggtagccttgctgctgttttgcatgggaacaaagctactggaagagctgcactggactgggaaacgagagtgaagatatccctcggcgtggcgcgagggctcgcccatcttcacgccgagggaagcgggaagttcatccacggcaacctgaagtcgtcgaacatccttctgtcgcagaacctcgacggctgcgtctccgagttcggcctggcgcagctcatgaccaccctgcctgcccccgcccggctcatcggataccgagcgccggaggtcctggagaccaagaagccgacccagaagtcggacgtctacagctttggcgtcctgctcctggaaatgctgactggaaaggcacccctgaggtcccccgggcgtgaggattccatcgagcacctgccgcggtgggtgcagtccgttgtccgggaggagttgaccgcggaggtgttcgacgtggacctgctccggcaccccaacatcgaggacgagatggtgcagctgctccaggtggccatggcgtgcgtggccgtcgcgccggaccagcggccgaggatggacgaggtgatcaggcgaatcgccgagatccgaaactcggactccgggccagcgacgccgccggaggaggccgcagcccaggcgccgtgagggcgggtcgcggagatgaaggagtcccgttgtgtttagcagaggtagctagctagctaagctaggttgctgcatagttacttggttggttatatagatagctttgagcgaaagttgatagccgcttgcttggttgattagtggggtgaggtttctgttgatctctgatttattctttttgttttgagaaattctgctgtgccgttttcggagtagtgaggctactgatcctgaatgagtatctgatgggctctgctggtgttcagagcggtgtttgtgttgttgtcctgtaatttggcatgcttttatcttagtgtgtgattaattctt

SEQ ID NO: 106 - DNA, 620 bp, Hordeum vulgare
ccgcaatcgcatcgcgctagggtttaagcagcagcctcgccgcctccagatccccaaccctcgaatccggagaggagctcgccgccggcggcagccaggatgtttctaggcgcggtgccgcggaagccgagcaaggaggcggcgtacaaggagctgcgctcgcacctctacatcatggccggttgcatcgccgccatccgcgccgccccctacatcctccacttcctcaaccgcgagcccggcatgacggagctcaagctcgagctctagctcagccccccgcccccctgaggtatgactgggatggtgaagttactctcaggatcaggctttgaagtaccttgtgaaacatgaaattagttttccttgatagtattttgtctttctgtagcatgataattcaatgacagtgttcgcataaactcttgttggttatggttaccactgccccggcaactttgtgggtttttaacaatcagcgatgcgcgccttacatatttataatattgctgggatgtgattcatcgttgctacactgaatgtgcaactttgtgggtttttaacaatcagcgatgcgcgccttacatatttataatattgctgggaagggattcatcgtt

SEQ ID NO: 107 - DNA, 1614 bp, Hordeum vulgare
tcacgctcaacattgcaactctgcaagcaaagagatactgatcactgatcagggatcgccatatcggccagtgatggtgaaggcgcctctccactcctcatcctcggccgcagccgccgcggccaccttctcgttggtcgccaagaaggcgcggctctcgccgttcatcctgctctcgctgctcttcatgctcctcttctccttcctctacggagaggagctcgcggcgctcatcggccagcgagctggtcgacgttcagcagacctcgacgttgacgtcaaccgtgagcatcagcaaccggccggggtggaggatgggtggaagaggaagaagaagaggtggcaggggaggttggcgttcgcggtgaacgacgaggacgaggacgaggagtgcgacgtgttctcggggagctgggtgcgggacgaggaggcgcacccgctgtaccgggaggaggagtgcccctacatccagccgcagctcacctgccaggcgcagggccgccccgacaggggctaccagtcctggcgatggcagccgcacgactgcaccctccccttcaacccgacgcagatgctggagacgctgcggggcaagcggatgatgttcgtgggcgactcgctgaaccgcgggcagttcacgtccatggtgtgcctcctccagtcggccatcccgtccccggaggccaagtccttcgaggtgtctcccgaccagcagcacaccgtgttcaccgccagggagtacaacgccacggtggagttctactgggcgcccttcctgccgcagtccaacgcggacgacgccgtggtgcacaagatctccgaccggatggtgcgcaacggctccatcgcccaccacggccgccactgggagggcgtcgacgtcctggtcttcaacacctacctctggtggtgcaccggcctgcgcttcagggtcatgaacgggccgatcggggacgccagggaggaggacgcggcgtgggtgtccacggaggaggcctacggcatggcgttccgggacatgctgcagtgggtcagggacaacatggacttcaacagcaccagggtcttcttcaccagcatgtcgcctacccacggcaagagccaggactggggggacgcgcaggggggcaactgctacaacgagacggcgatgatcgaggacgccgagtactggggcacggacgcgcggcggagcgtgatgcgagtgatcagggagatcctagacggcgatggcgccgacgtgccgctcacgttcctcaacgtcacgcagctgtccatgtaccgcaaggacgcgcacacctccatctacaagaagcagtggaacccgctgacgccggagcaggtggccgaccccaggacgtacgccgactgcgtccactggtgcctaccgggactccaggacacgtggaacgaactcctctattccaagctcttctacccttgatcacgcacgtttattttcacttactacaagtactcgtaggttgtagtgaggccacctaacggatctctaatagccggttagaatagtaaaaggaaaaggtttaaaatctatgggatgataacagaaaaagataaaccatgtgcattgattgacaaaaaaaaaaaaaaaaa

SEQ ID NO: 108 - DNA, 1067 bp, Triticum aestivum
cccgcctgcttatcccctcccgagttcatcgcctcctcggcattccgtcgaacaccatgacgagcgttgcggcggcggtcgccctcctccgcctccctctcgcccacctctcctcccacctccggtcgctcccttcccgtcccgtcccgtccgctcgcctccgcctctccgccccccaccgccctctctgctccctcctcaccagcggccacggcctcgccgtagcggccgtgtccgaggcggtggtcgcggcggatgaagaggagttcgaagcgacggaggagcagcaggaggaggcgcccccttccttcgtgctcccgcggctgccgcggccgaagctcgacgtgaaggagcggaaggagctcgcctcgtacgcgcacggcctcggcaagaagctcaagtcgcagcaggtggggaagggcggcgtcacgcccaacctcgtcaccgccttcacggacaacctcgagtccaacgagctcctcaagctaaaaattcatggaaactgccctggagaactacctgatgtgatacgacaacttgaggagtcaaccggatccattgctgtcgaccaaatcggccgctcagttattctatataggcctagctccagcaagatgaaaaagagggaagaagtcgctagaaacagagaagagtatgcaagaaacaatccgaggtttggaaaatctgaaaatgcatttgaagaacgtcctaggaacaacagcgcaggcaggagattcgtaaaatctgggtcgacatttaggactcaacagaagagaagaccggtagcatccaaggggtcgtcatacagcagagggtagcagcatcaaaaataatagattgtttttcttattgtatggaggaatcatgtaaattgagacccactagttgtataatggacattagtgtttagtttgtgctagtaaccatggtttcaagtctcatcaaccacaaagacaggctaacaccacttcaaattgtcgtgattcccttttattcggttggaagttcgtaggatctacttgagaatttcaaatccgagacaaccaatgagtgcctcgtccgaatcg

SEQ ID NO: 109 - DNA, 1078 bp, Solanum lycopersicum
ttttttttgtttcacttcaaatgagaacaataatgtctaagaaccaacatgagtccttctcattttcaagaaggtacttcaatttcaagaaaaaagttgaagatgaagagtacgatgatgaagtttacttgaacactttccactcttcctcgcttagaggtagcgaggaagagtattttgggatgcattcgctgtcaggtacagcgacgaatgcatccacagtaagcaagaaactgtcgcgttcgacagtttctaagcttcgttcggctcttacttttggtaagagccgaacacaaatagggcttggtactaaagttattggtactttatttggttatagaagaggacatgttcattttgcatttcaagaagatccaaagttaggcccagcattctttgtagaaatggccactcctacaagtcatttagttagagaaatggcttcaggattggttagaattgcattagaatcagataagaggacaggtaaaaaaggggtgaaattgctagaagagccaaattggaggacatattgtaatggtagaaaatgtggctatgcaatgaaaagagaatgtgggcctgatgaatggaagattttgaactcaattgggcctgtttcaatgggtgctggagttttaccaagtgatggtgatggaattgggttagaaggtgaattgatgtatatgagggctaaatttgaaagagttgttggatcaaaagattctgaggctttctacatgatgaatcctgatggtcatggtggtcctgaacttagcctttacttgcttagggtttaaactgtggcgtcctggtcaacttgtgctctctcgactatttcactgagtacctattatgttcgagtttgaagtatgtgatcataagttcttatgaagacataagaagttagtttttttatgatgtatttttggtttgttttaatgtactatgagggtacgagggaaacaaactaaagatatggaggagggtggggtgtgaactatatatgtatagattatgtttttctagttttgttgaagtgaaagatgatgaagtaaaactttggtactctctttttact

SEQ ID NO: 110 - DNA, 1048 bp, Gossypium hirsutum
gccttttctgctactattaattgtttccccctccccaaacaacccatcgaaatcgcattctccatttattggttcccttcaagcaagaaactcctctttcgttctttgtgagtgttacagtgaaaaacaaagataatggcaggcgggtccaaatccaatccaccaaagcctaggaagagagtcgacgctgcttcagcccctgcccctacccctgccactgcctcctctcttgttcgcgctaaagatggcagtgcttttgccaaatgtgatgagtgtaacaaaaccgtacccatggctcttatcaatatgcatagctgtagccttgaagctaaaatcaaaatgaatttggagtctcaagttatagagaagcctgctgaagccaagaagaagcctgcagaaaggaagaagcctcccgcaacaacagagtcaaatcctaaaaagccgaagaagttgaagaagggaaaagatcccaatgcccccaaacgccctcccaccgccttcttcttgttcatggacgactttaggaaatcttacaaggaagcgaacccagatgcaaagggtgttacaggggttgcaaaggaaggtggtgagaaatggaaatctatgtcagaagaagaaaagaagtgttacgtggataaagcagctgagctgaaagcagagtatgaaaaggcaatggaggaggctaagaatgctgaccatcaaaatgaggaagaggaaggaggttcagacaaggaaacccctgctgctgaaaaggcaacagaggaggaagtgttggatgattactagttgaaggcatagttcttttcgagttcccccaagaatttgttcttattttgcccgggggtttgggagggagtgtaaatttttcattcaatttttggagctaatgttttctggtaggtgtctagatgcgttggagaatcagcttgacttgtctcttctccaatcaagttattatttttgtcttgtttgatatgtgaatgctgaagcagtttctcctgtaatgcttatgacttgtcagtaatgataacgaaatatgatctttaaa

SEQ ID NO: 111 - DNA, 1324 bp, Solanum lycopersicum
acatgtgtcatgtgtaaattgtgttctacatgtgtacaatttaaaacttatttgtgcatatttgaagtttaaaatttgagaatataaatataaaatgaagaaaatttgagaatataaatataaaatgaagaaaaattaaaaggagtattatgctataaactaattacataaattagaaagagggagttaaatatgaaaaaagaattactaaggaaaatgatgtcgctgcattgagcaaatgagtagtgtaatgttatcttcttcctcttcctccatggctctccatcgcctgctccgacccgctcccatcctttctttctccttccttaagcaatctctctctcttcttccccatcaaacgacgtcacttcatcccatcatcaacaattctctttcctccttcccctctcttcggacccatacatcaatcttccttcgttctagaactttctctaaccttccaattagctgtacctctcaagctctcttggaatcttctgaggatgtggaagatgaggaaattgtaaaacaaaatgaagaagtgactgcccccaggcctagtgagtctgagagaaaaatattaagggcgaaattgccgaacctgactgtgaaagagaagaaagaattggcatcctatgcacatagtttagggaagaagctaaagagccaacaggttggcaaatctggtgttactgatactgtggtcatggctttagaggagactcttgaagctaatgagcttctcaagctcaaaatacatggtacctgtcccggaggagagctggatgatgttgtaaagcatttggaagaagcaactggctccgtggttgttggtcaaattggtaggactgtgattctctaccgtccaagcctgacaaaaatgaaagctgaagagaagaagaaacaggctcaaattctttttttgaaaaaacaaaaacaatatgcagagagacgatcatttcaggataaaggaccggtacctagatcatatgctcgtaatcgccgaggaagtagcagggtttgatctttcattgtggttcatttcttaatttcctttccacggtagccaccatcacaatgcccccatggctcattgtaagggaatagtggacattatcatgggttcttgatgtcttaaatatttacagtatcgtaatcatagttctgactaatttgtggtcattgcactgggcaaaccccatcattctatttatgtttgttaagttgatgtaactttagacgaatcacacgcttcaaagtaattatatgtcaaatactgcacagcatattaataagcagattggtaactcaggacttggatgta

SEQ ID NO: 112 - DNA, 1243 bp, Triticum aestivum
ggacgcgtgggccgcacaccacacccgcccgccccaacaacagagacggacccggccatggtctacggcggagaggaggcgctgaggcggcagtactccatcggcgacgagatcgggcacggccggttcgggaccgtccgccgctgccactccaacgccacgggggaggcgctggcgttgaagaccacgcccaaggcgccgctgcgggacgctctcgacctggccctcgcggagcaggagcccaagctgcacctcctcgcctcctccccgccctgcagcccgcacctggtcgcgctccacgccgccttcgacgacgccgacgccgtccacctcgtcgtcgacctctgcgccggcggggacctcctctccctcctctccgcccgcggcggccgcctccccgagcgcgaggcggcggggctcgccgcgcagctcgcctccgcgctcgccgcgtgccaccgccgcggggtcgcgcaccgcgacgtcaagcccgacaacctgctcttcgacgccgccaccggcgcgctcaagctcgccgacttcggctccgcggagtggttcggggacgggcgccgcatgtccgggatcgtcggcacgccctactacgtcgcccccgaggtggtcgccggcagggagtacggcgagaaggtggacgtgtggagcgccggggtcgtgctctacatgacgctgtcggggtccgtgccgttctacggcgccaccgcaccggagatcttcgaggcggtgctccgcggcaacgtccgcttcccgccgcgcgccttcgccggcgtctcccccgaggccaaggacctgatgcgccgcatgctctgcaaggacgtctcccgcaggttctccgccgaacaagtcctgaggcatccgtggatcgcgagctgcggaggggatgcggttgcgggctgaagaaatcgatgggccaacatgcggcacgcgctccatccgcctgtagatagaagatgtctccacggacgacggctctgctctgtttctccggcaaatcggcgatggacagaagcagcggcggtgccggagttgagttgagtccagtaagtagaactagcggtagttccttcgtgatcatgtaggcctagaggtctctggtgaagctggaattgcagaagctttcaccagagttagcctgaatgtgtgtttgttctctgaatctctgaactagagtccttgtacataagtcttgatcagttctagctgaagaggaagagagggtttagtagta

SEQ ID NO: 113 - DNA, 1239 bp, Sorghum bicolor
gggaagatagaaaagcggaggggattggcgatgtctgtctgaatcgtctgtatctctctgaccactcactgtatagactccattctgggccggagattccggaactgggccgtcgagcgctaacgggccgagagtggtcttctcgagcacctgtcgttcttccttcagggagaggttggagccgtaggggaagcagggctgacagggttgcggctgcggcgcaaggacgccgagaggactagggtttagccatggcggccgaggagcagactccttgtaccaagccccgccccgacaaggccaagaagcggaagaagcccaagaaggacaagtggggccaacctatcgccaccgctgaggagccgtcggtggagccggagcaagagcacccggcgggggaagttgaggcggtggtacaggtggacaaggaggaggaggaggcgactgcggcggcggagggctatgagtttggcaaggtggtggccagcggcatgccctacacgaccaccgaggcggacatccggaagctgttcgagttctacgggcccctccagtcggtgcagctctctcgcttcccggactccggcaacttccgcggccttgccttcatctgcttcgagacgaacgaagatgcaataaagtctcttgagcttgatggattcaaaattggcagcagatacatgagggttgaaaggtgcagggtgacggccacctcaaataagaaaaggaaggcagagttccaaaccgaccccaagaagtccgaaggctgcctctcggcatatgttggcaatctctcatggaatgtcactgaaaaggacttgcgagatttcttcagatcatcaaagattgcatcagtaaggttcgccatcgacaaaagaactggaggttctcgtggcttctgtcatgttgattttcaagacgacgagtcgctcgagaaagccgtagcgatgaaccagtctgaactgcagggtaggcctgtcaaagtcgcgtattcagtcagtaacaggggctgaagagcaaagattactcgccaccggtggtttgtactagtgagcttgtagtgttatggttttgctccctcagttttggtaaggcttttgctgcttgaaagatgattttggaaccaaatccatggtgacaattcttgccccaaacatatggcaaatgtaacccttgtgtaacaagtacgagtttggtaaacctgcatctcatggttttgtcactgaatgaatgttttcg

SEQ ID NO: 114 - DNA, 1333 bp, Brassica juncea
aaatagcaaatacataaattcgaacattgcagctatggctcccacattgcaaggcgagtggatcaaggtgcagcagaaaggaggagagggacctggagcaagaagctcacacggcatagccgtggtcggagacaagctctactctttcggtggcgagcgtactccaaacatttccatcgacaaacacctttacgtctttgacttcaacactcacacatggtcaatcgccccggccaacggacaagcccctaacgtccaggctctgggcacccgcatggtggccgtgggaactatgctctatctattcggaggccgtgatgagaagaaacagttcgacgacttttactcgtacgatacggtgaaacaggagtggaagttcatcaccaagctcgatgaagagggaggacccgaggctcgtacttaccactcgatggcttcggatgaaaaccacgtgtacttgtttggtggggtgagcaaaaccgggaggatcaagacccccttcaggttcaggaccattgaggcgtataacattgctgatgggaagtgggctcagctacctgatcctggtgagcaattccctaggttcgagagaagaggaggagctggattcattgtggtggaaggaaagatttgggtggtttacgggtttgcaacttcgcctgatcctaatggaaaaaacgactatgagtctgatcttgtgcactactttgatcctgctactcaaaagtggaccgaagtggagactaaaggagagaaaccttctccgaggagcgtgtttgcgcatgcggcagtaggaaaatacataataatatttggaggtgaggtctggccggacccaaacggacatttgggtcccggaacattgaccaatgagggttacgcgttgaacaccgagactctggtgtgggagaagtttggaggaggagctgagccgggtgaactcggttggcctgcctacacgactgctaccgtctatggaaagcaaggcctcctcatgcatggagggaagcgtccaaccaacaaacgtaccgatgaaatgtacttctacgcagtccattccgcctaagcaatgctctctcactactctcaaaggttcgtttgtgtggtgagtattattactatttgtgttgtgtctcataatatgtatgataaaataaaggtctgtgaagcctatgtaaatcagccaactgtatgtggcttattatcaagttaaactatgtgtgtttctcgtttgcaaaactttactggttggaataatatgtactactacttgtgtgtttaataaatgatatgaagttatctactaaaaaaagaaagaaaaaaacataaaaaa

SEQ ID NO: 115 - DNA, 1317 bp, Triticum aestivum
cgaccccgcgtccggtaccactgggacctcccccaggccctggaggacaagtacaacgggtggctcgacaggcagattgtggatgactttgcggagtacgccgagacgtgcttcgcggcgttcggggaccgggtgaagcactggatcacggtgaacgagccgcacacggtggccatccagggctacgacgccgggctgcaggcgcccggccgctgctccgtgctgctccacctctactgcaagtcaggcaactccggcaccgagccctacatcgtcgcccacaacttcatcctcgcccacgccgccgtctcccaattgtacaggaccaagtacaaggcggcgcagaacggggagctcggcatggcgttcgacgtgatgtggtacgagcccatgtcgggcgcggcgatcgacgtcgaggcgactaagcgggcgcaggagttccagctggggtggttcgcggaccccttcttcttcggcgactacccggccaccatgcggaagcgggtcggggagaggctgccccggttcacggcggaggaggccgcgctcgtcaagggggcgctcgacttcgtcgggatcaaccactacacgacgtactacaccaggcacaacgacaccgacatcatcgtccgcctgctcaacgacaccctcgccgacaccggcaccatcagcctcccattcaagaacggcagagcgattggggacagggcgaactcgatatggttgtacattgtgcccagagggatgaggagcctgatgaactatgtcaagaacaggtacaacagcccaccaatctacatcaccgaaaacgggatggatgacagcaacagccccttcattgccctcaaggacgccctcaaggacaccaagcggatcaagtaccacaacgactacctcaccaatctggctgcctccataaaggaggacgggtgcgacgtgcgcggatacttcgcgtggtctctgctagacaactgggagtgggcggccggatacacgtccaggttcgggctctacttcgtggactacaacgataagctcaagaggtaccccaagagctcggtacagtggttcaagagcctcctccgccctagctactagcactttgctaggtcattggtttgtgctcgtgtgcatggtgtgactgcatgtattgtcaccgtgtctgtctgttgctgccagtatgttaggatgatacacacgtctggggtttcagagttagaaggtgttgtcttcatggattgtatagcttctacttgtgttcctcggacgtttcatcatatatacacacacataagaccgaatattcccttcgggtct

SEQ ID NO: 116 - DNA, 1510 bp, Solanum lycopersicum
acaaaattgaaatggatctgtgaaaagccatcaatcttgtcctttgcctaactccaaaggatcatcacttcaacaatccctcctcctattggccttgccaacttccccatttcttcttcccaacaaaaccccttaatatataaacccttctccatctttcttccttcagagtttttctccctatacacaaattgatagaatcggtcatttgatcagatcatggctcattcagctatctctcaggtgtcagttgctgttcctctccaaacggattcctctttccgaagatctacctttaaggctacaagcttaacattcagtgataaatcatgcatttctatgccatctatcgatctaaaagcgactcgatccagaagccaatacattgtttgcatgtcagtgcaacatgctagcaaagccaaggtttcagtttcacctttatcacttgaaaatgcaacagaaccacccttgaatatctacaagcccaaggagccatacacagcgacaattgtctctgtcgaaaggattgtaggcccaaaagctcctggggagacttgtcatattgtcattgatcatgatggcaaccttccttactgggaaggacaaagttatggtgtcgttcctcctggtgaaaacccgaagaaaccagggagtccccacaatgttcgtctatattcaattgcatcgaccagatatggggactcttttgatgggaaaacggctagcttgtgtgtcagacgagctgtctactatgatcctgagacaggaaaagaagacccatccaaaaatggtgtttgcagcaacttcctatgcaatgcgaagcctggtgacaaagtgaagatcacaggtccttctggtaagataatgcttctacctgaaaataatcctaatgccacacacatcatgattggaactggtactggtgtggctcccttcagaggctaccttcgtcgtatgttcatggagtcagttccaatgaagtttaatggccttgcttggcttttccttggggtggcaaacactgacagccttctgtacgacgatgagttcaccaagtatctcaatgactacccaggcaatttcagatatgaccgtgctcttagccgagaacaaaagaacaataaaggggggaagatgtatgttcaggataaaattgaggaatacagtgatgagatcttcaaacttctggatgaaggggcccacatctatttctgcgggttgaagggtatgatgcccggcatccaggataccctgaagagggttgctgaagagagaggtgagagctgggagcagaagctttcacaactcaaaaagaacaagcaatggcatgttgaagtctactaaataggaaatttttaattgttgcatttgtttgtgattgttgattgttgtcaactgaacttagcaagcagttagatgacacattgtattgctagttgacatacaaattgttcatgttgcatgggaaatgaaataataactgttgctgcttgaggcagtttaccttgca

SEQ ID NO: 117 - DNA, 859 bp, Sorghum bicolor
gcgtcccctctcgcgcgcgcggcgcgccattatagcacggcgcacggcacgccttcggtctcccactcactgcccagaggacgttctagctagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaataaggaaccacactggttgtccacggatcaagaatgcccgtatctttactattctgtgtcgaaattcttgtaatctttacttggaaaaaaaaacgagctatgcactagatttcttgttctggctgtaaatggcaaggaataaagttgtaatcgtggttcagcagtcaatcaatttctgtgttatatcgttttg

SEQ ID NO: 118 - DNA, 1751 bp, Sorghum bicolor
gcgagagggggcgaggccgcgagggtttagccggttggcgccgaagccgccgccgccgatcctctccggcagccgaactcgcagcttgcggcgcatcccttccccacttccggcggtatggacagcacaaaggggacggcggtggcgaggctctgcgacgacctgatggtggatatcctctctcgcttgcccgtcaaggacctccgccgttccacgtgcgtgtccaaaccctggcgcgacctcgtcaccgaccccctccaccgcaagaagctgccccagaccctggaaggtttcttccacggtggtgctggcgagcgtcacagctatgggcacttcaccagcctgtcggggaggggagaatctgctcctccagtcgacccttccttctccttcctcacggcgaagctgccttgggtcgagcgcatggacctcttggattcctgcaatgggctcctgctctttgggtgcaccacggagaacaagtttgggtacatcgtgtgcaaccctgcaaccgaggaattggtgaccatacccgccagctctggttcttgtccgcctccttcgcttactccattggaagacaaaactatcgctgtctgtgatggggatatatatgcacacacctatctgatgtttgacccgattgtctcctcgcgcttccacttggtccagttctggcaggataggtcgacgtgtgaggtgaaaaaggtgcactcttactcgtctgaaaccagggcatggagtgacacgtcaaacaagtgggagccaggtgaagagcgctgtggatggggggtactgcggggtcgtggtgaagccataatcgaattcacgcgtggcagggctttggttgatggtctgttgctttatattgaagctgttctccttttcatgcgcggcagggcttgggtcaatggtctattgcattttgttgcctaccattttgaggaaggagagaatctgatagttgcggtggatggggaagggacaatttgtaggatcatttgcccacctgttaagcatgtagatgccaatgcttttattggtcaatcccaaggccatctgcactgcatcagtacgaatctgatatctcaatacttcaattaccatttcacgcaactgtcaatttgggttcttgaggactatgatacacaagaatggatcctgaagcacaatgtgagctttccgcagctctttggatcaccgagttgcccaatcgacaaccacgatattgtggtcattcatccggaccacaattcgataatccttgttcagcactggaaccagaaactggtgtcatatgacatggatagtaaggagcaccgtgttctctgcactctaggagagggatatcggtccattaccccgtatgttccctatttcatggagtcaccagttcttgccaccaaggactgaggttgttgcttgtgggatacttctctgaatgttcagaaagagcttgatcttccaagtatgggcaactagcagtgtgggtaaatctaaatattagctggtgcaaatttggattaatctattatcaataggtgatctattctgctggtgctttactgtaaccctttttgtaatgttgtgagagttgtttactagacagcatgcaatttagcattaaatatgctagttcttttgttaatgcacaatgccatgaactagccaacggtctagtttgagctacccagcagtcgtgagtttgaaatgctaccctttatgtttctggaatgatgtctccatctttt

SEQ ID NO: 119 - DNA, 1197 bp, Sorghum bicolor
gacactcgccctctctgtcttccgctctcaccttatccccttgcggcaaaaacctccgcgcgctccccatggccgcctccctcccgaccaccgccgcggcggcgcgcctcgcggcgcaggccttcgcgttcccgtcgctcaagcctccctctgcctccgccttctccgccctcccgcgtgccgccgccttcccctcattcgccgtcgcggcggcggcgcccccgcgcccgcgccccgcgaggccgacggcggcccgggccgcgggcgacgagagggagacgatactgctccccgggtgcgactacaaccactggctgatcgtcatggagtttcccaaggaccccgcgcccacacgcgagcagatgatcgatacctacctcaacaccctcgccaccgtcctcggcagcatggaggaagccaagaagaacatgtatgccttcagcacaaccacctacactgggttccagtgcactgtcgacgaggagacatcagagaagttcaagggtttgcccggtgttctgtgggtgcttcctgattcctacattgatgtgaaaaacaaggactatgggggtgacaagtacatcaacggtgagataattccctgcacgtacccaacctaccaaccaaaggagcggagaacatccaagtatgagagtagacggtatgagaggcgaagagatggccccccagcagccagcaggaaaccaaggcaacaggctcctcagactgagtcagcatcttcataatgagttttgcaggcatttatccacatacttactaaaacaaaagagcacgcctaattctgtcactttggcactttagcaccacacatacaggcaggacaggcagatccatcatcatcatcagcccaaaatgtcacgcggtactgtccaagcagcctgggcagcttgtattgtatctggatcacgtggttgtgtgtgctgatattttgagctaggtgtgacagaaactgaaaaccctactattcttccgactcctagtgaaatgtgtgatgccgactggtctagctgtattgctgattgtgtgaaatgtgtggcttttccctcagggcatgtttagtctgaatgaagttggcatttagccatgggatcaaactcagcattgttatgttccatattggatcgctgaattaagtgagatttgcaggtcctttgaatctgatgtgtttcttgagca

SEQ ID NO: 120 - DNA, 1298 bp, Sorghum bicolor
ataaaatccccctcccctgcgcacccggtctctccggctccacgtcgcccatataccatacgtggacatcgaggtggtcggccatggcggagctccagcagctgcagcaggtggcgagcgacgacgcggcggagtggaagcaggtggcggagctgagggccgtcacccaagcccaggatccttcctgcaaggaggaggacgactacactctgcgtcggttcctccgcgcgcgggaccacaacatcggcaaggcgtcggcgatgcttctcaagtacctcaagtggaagccgacggcgaagccccacggcggcgagatcccggcgtcggaggtggcgcgggaggtggcgcaggcgaagctttgcctgcaggggtacgacagggaagggcggcccctgatctacggcttcggcgcgcggcaccacccggcgcggcgggacatggaggagttcaagcgctacgtcgtgcacgtcctggacgccaccgtcgcgcgcctgccgccgccggggcccgggcggcaggagaagttcgccgccgtcgccgacctcaagggctggggctacgccaactgcgacatccgggggtacctggcggcgctggacatcatgcagagctactacccggagcgcctcggccgcgtcttcctcatccacgtgccctacgtgttcatggccgcctggaagatcgtctaccccttcatcgacgacaacaccaagaagaagttcgtgtttgtggcggataaggaccttgataggacgctccgggaggccattgatgactcccagctcgccgagatctatggcggcaagctcaaactcgtcgcgccgccggcaaattaaacggcaacaactgaaaacggatccatcccatgaactctgcaatgcagctgagcagagcagagagaatgcagcagcagagtacagtacgcgagctagacggacggacgctcgaatacgtacgggtcagagaaatatatatgtatgtaaatcgtagcagctaggagaattagcaattgcaagtgacgacatgtcatcttgtacaagacacgcggaatgaaagatgcatggtttctgtatgctgtcctctgtactgtaaccagccggtgatgagtgcaaataagattattactacacttctctatatttaggtgcctgattctttttattgttcggtaaacatttgtttaactatagaaaaaattacgacatatgagttatccgtttgactgttaattagtttgttgtatgtatacgattgttgccaggaaattcagatcattactgcatgcagctaactgcagc

SEQ ID NO: 121 - DNA, 1929 bp, Arabidopsis thaliana
accaatcggtccgttcccatactctcctttaatggcttctgagagatatttaagtttagcaaaaaaatcctaagcttctacaatggcgaatcttcccaccgttctcgtcaccggcgctagtggcagaacaggccagattgtgtataagaagctgaaggaggggtcagacaagtttgtagcaaagggtttagttagaagtgctcaaggaaaagagaaaattggaggagaagctgatgttttcattggggatataacagatgctgatagcattaaccctgcgtttcaaggaatcgatgcgcttgtgattctcactagtgctgtgcctaaaatgaaacctggttttgatcccactaaaggtggaagacctgagttcattttcgaagatggacagtatcctgaacaagttgattggattggacagaagaatcaaattgatgcagccaaggttgctggtgttaagcatattgtcgtggtcgggtcaatgggtggtaccaatccggatcatcctttgaacaaactgggaaatgggaatatactggtttggaagagaaaggctgaacagtaccttgctgattctggaactccttacacaattatcagagctggaggacttctagataaggaaggcggtgtacgagagctgctagttggtaaagacgatgagctacttcagacagacacgaaaaccgtccccagggctgatgttgcagaagtctgcattcaggcattgctgttcgaggaggccaagaacaaagctttcgatctcggctcaaagccagagggaaccagtaccccaaccaaagacttcaaggctctcttctctcaagtcacctctcgtttttaaatcattatctttgttgccaataagaacatttgggatcaaaccttctaaaataaattctgtagtgtctatttgaaaggatacgttctttcaattcaatgagaatattggggttgaatgttcaaaatttaaaattttgatcatacagtaacttctccagagctattcattgaggtgaaacacttattttcatttagtctaacacatcaatcttatagccaacccctttaacaaattaaagaatctactttgttaacgttttggaattaaaaatagaaatttcagttgaaaggagacgatgaaccctttaagagacgtcatgaagatcgaattaaatctgcagttgaaatcgctagacgggatactttggatgattcgttatcaatttggtgttataggagcgtgaagaacgaaagaaacgaatgagatttgacaggcactctcgaaactctcagctggtttttcgtgatcagtcttatcagaacagagacattagagtttatgatcaaagcaagctccctcaggactgattgggaaggtggattctttccattaacgatgcacttcagtgaggattatccgagcaaacctccgaaatgcaaattcccaccctaatgtctatccatctggaactgtctgtctctctatccttaacgaggattacccattaccgtgaagcagattcttgttggtattcaggatttacttgacacacctaatcccgctgaccctgcacagaccgatggttatcatcatttctgtcagttgagtacaagaaaagggtgaagctgcagtccaagcagtatcctgctcttgtctaaaacctcaaaaaagagaacgcaccaaaactgatgacaagctctgaatatattctcgtcatgtgtgtcattgtgtttaaatgtcattgggtgattgaaaactcctcattttggcaccttaagacactggaatctatttattttcggaaaaaaactcttctttctctatataactgttaatattcttggtactgattcagttggtactgattcagttggtgttgcttctatattattataaagaaggaatgcaaaacatgacttgaaata

SEQ ID NO: 122 - DNA, 1107 bp, Hordeum vulgare
ctactgctggctgcgccctctcttccccccttccctgcctcccaccgtcctacaactagccactgtcctatatcttggcgtcgcggactagctactcggcggccatacctctagtttataccccggatccccttgctctgcgcacgctggtacgccgcctgcggccatctcccggcctcgtccgtcagaccagtcgtcgtcgccgcgaagccgccgccctatggaggactacggcggcgtggcgagcctggtggcgtccggggtggtgttctggtcgacggcgttcctgctgctgcgggcgctgctccccaagcgctcctacgacttctgcaaccgcgccgtctccaccatgcacgccgtcaccggcgtcgccctcggctgcctctccgtgcaggactgggcctcccccgtctcccccgtcgcctcaccatcctcgccgcgccagatgagggcgctggcggtgacgctgtcgtacatgatctacgacggagcgtgctgccacctgagcggcgacgcgcggctggacaacgccctgcaccacctcatcagcatcgttggcctcgccgccggtctcgcctaccagaggtgtgggacggagctggtggcgtgcctgctggtcacggagatctccagcccgctgctgcacctcagggagatgctcaaggaggtcggcgtcaaggacacggacctcaacctgctcgtcgacatcctgttcgcggtgaccttctccgtggcacggatggtttgcgggacgtacgtcacctaccgcaccgtgacggctgacaaccccatcctcatcaaggcgatggcgacgagcttgctgctggtgagcgcctactggttcttgaggatcctcaggatggtcaggcacaagattgggaagaagaggctagcatccaaagccgccggcaagtgatgctgcaacctgcagcgaccggtgtgatgcgacaagctgtgtttgcgcgattatgatcatgtacgcggtgtagcacattattaatttagctattgtctgatgggcaaagcatgtcccaaacaagagatgcatgtattctgttgttgtagcaattttagtttcattaattaatgctaatgcgcatgaattgt

SEQ ID NO: 123 - DNA, 1609 bp, Oryza sativa
acgaatcacgcatcaaaaattcctttttccttttctttcccactgttttataggtagagctggaagaagaagcagcgacccccaactcctccctccattcgcgcaaaaacaccgaacccacctcctctcctcccccaaccaaaaatcccttcctttttttttcttttttgttttttcttttattgtctctcccctcgccggcggcgatgagccccaggagggagcaggcggaggagcagcagcagcaggggtggagggaggaggcggtgtcgggcgcatcgctgaggcaggtggacctggagaggggcgccaatgggtgggcctcgccgccgggggatttgttccacctgcgcgcgagggggtacttttccggcggcggcggcggcggcggtggcggtggtgggggtgggaggcgcgggaaggcgccctccgccgccgagtggctcctccgccccgccggcgtcgactggttaaggagccactcccgcctcgaccacgtcctcgcccgcgacgacatccccgtcgccgccgccttccgccgcgcccgcctccgcaaggacccctccgcccacttcctcctcgccgtcaatctccaggtgccggggcggccggacgcgtacagcgcggtgttctacttcgcggcggaggcggcgatcccggcggagtcgctgctggggcggttcgtccacggcgacgacgcgtaccggaacgcgcggttcaagatcgtgaaccggatcgtgaagggcccgtggctggtgcgcgccaccgtcggcaactacgccgcctgcctcctcggccgcgcgctcacctgccgctaccacggcggggacggctacctcgagatcgacgtcgacatcggcagctccgccatcgccagcgccatcctccacctcgcgctcggcgcggtcacctccgtcaccatcgacatggggttcctcgtcgagtcccagtccgaggaggagctccccgagaggctcttcggcgccgtgcgcatcgcgcagatggagatgggcgccgccaagtatgtcgagacggcgcccgacgatgtggtccccgacgccggcagggctggcgccggattcagggttcactcggcgaaggtggccaacgatagccgccaccaagaacgcgccgccggcaaggtcgggaggtcgatgagctgccaggaacgcgggagcggaggaggaggaaaatagatgcgaaggaagagagatctttggatggagaaagaggggattgagatcgaactagccggaggagaaaggccggggcacataaaatggggaagcggcgaatactcccttgatcataatgtgcaagtcactgattaagctgtgatcagaactgaaacctgatcgatgagaatagtatattattcgtaattatgatgccattcttctcttcaattgcagcagaatgcagcttctctcttgagtgctccatcatcttttctgccatcatgtccaatcaagcgaaacccgttcaacagaaacagaatgttgcctgtttctgacttctgtgttttagtactactacaaaaagttctgcaaaaccaaatcgtactactcccctctgtcccaaaataagtgcagccataagttctctacct

SEQ ID NO: 124 - DNA, 1261 bp, Oryza sativa
ttatggtggccatgtcccaagtggatagacggtcctgatcttctgccgtgctgttctgctggtgttgccgcataacccacggcggcggcgcgtaggcaaagccgggaggaaggattagggtttaggcggcggccatggcagctgaggagcagactccgcgaaccaaacccagcaccgggaacagcaagaagaggaagaagcccaggaaggacaagtggggccagcctatcatcgacgccggcgatcgcccggcggttgagccggagcctgagccagagccggagcctgtcccagcgcccgcagcggcggcggcggcggaggaggaggaggaggcggggatctatgaaaccggcaaggtggtggccagcggcctgccgtacaccaccaccgaggcggagatccgggagctcttcgagcggttcggtcccctccggtcgctccagctctctcgcttcccggactccggcaacttccgcggcctcgcgttcgtctccttcgagtcaaacgaggtggtaatgaagtctcttgagcttgacggattcaaaattggcaacaggtttatgagagttgaaagatgcaggttggctgctggctcgaagaggaaaaggactgtggagttccaaactgatcctaagaaggctgatgggtgtctgtcagcatatgttggcaatctcaaatgggatgttacagaaacagacttaagggacttcttcaagtcactgaagatttcatcgataaggtttgctatcaacaagagaacaggtgattctcgtggtttttgtcatgttgattttgaggacgacgagtcgcttgagaaggctgtaggaatgaatcaatctgaactgcgcggccgacctatcaagatatcatatgctgtcagtaacaggggctgaaggctactagatagtaaactttgagcatgagcgagcctcagtgttatgcttttgctccctcagttttgttacggttatatatccgtattaagtttctactgaaagtgttgtttcttgcatcaatctctatgtagaatgtaattcaccgtgtgacaaatacttggtgctacttaatatcgaccttataaacacttctcagaaatctctgtcaaatataactatctggtcatagcagtggcgactgatgttggaatgttgtctcattgagtttgatgtcgagggcctaaagttagtaattgttgagctcagaactaaacctaatcttttagagtattatatcccatctgaatagacgttctttaactaga

SEQ ID NO: 125 - DNA, 1189 bp, Solanum lycopersicum
gtaaaggtgaggtgtgccaatcaaatccagcacatgcaaacaaagagtatatagtcagcaaacaactagctagccaccagacaatcaaatcaatatcataaatttcaacaaattcttctcctaacttcacacatcacacacttatctcttttcccttctttcatactattaatatcacacacctttttttttcctccttcattctctctttccttttcaaataatcacaaggaattcatttctagtttcaattcttagctatgggtggtgatcacaaagagaagaccactgtaatggtgctaaaggttgatcttcagtgtccctgctgctacaagaaggccaagaaaattctctgcaaaatgcctcaggttcgagatcaaatgtatgatgagaaggccaacactatcaccatccttgtagtttgttgcagtcctgaacggattcgcgacaaattgtgttgtaaaggaggaaaagcaatcaagagcattgagatcaaagagcccttaaagctcaaagctcctgaaaagcccaaggagcccgaaaagcccaaggaaaagcccgaaaagcccaaagaaccagagaagaaacccaaggttgtcacttttgaaacgcccaaggagcccgaaaagcccaaagaaaaagcaaaggagcccgaaaagctcaaggacaaagcgaaagagcccgaaaagcccaaagggcaagaaaaacccactgtaattgataagcccaaggacaaaacaaaagatccagaaaagcccaaggacggtccaacatctgcaatggtggcaaccccatggatatccgaaccaataatgatgatgcctccggtccacggatacccccaggtaatgccaagttgtggctgtgggcaatgccattataccggtggcccgtgttatcaatattatggaacacccgtacccccacaacccgccccatactacggtaactactcgtatggatatgggcccggcccgggcccatctagctatggaaagggttattacggaaacaatgattactataatgaagaagatggtcaaggatgcacaattatgtaattgtggccctacttagtacttcattattgggctttcaaaagagcccagaacaaagttttgggctccatatggatgtctattttctatattattactgtgttcattaataatagtaccatattcgatgt

SEQ ID NO: 126 - DNA, 1328 bp, Solanum lycopersicum
aaaacttggaatttcgttgaaagtgtttggagccttaacctctaagacacctaacgtgattattaaattggggacatccagagatcgggtcccaaaatagtgagtcggaccctagtttcttcaccccacaatctccgtcgaactggcgatgatcgataacatcgatgatatcatcaactgggacgatgtagatcacatcttccacaacgttctagacaatcccgacgatgatcaattcactcttcatgattcctccccacagtcattccagcagatcgagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggagttgtgatgtgactcgttgtgatcaaatcttttcccataggtggatcatggttccttttgagttctttagttttttatcagagattctcttgtatgtgtcttgctttgacatctgaaggatgaagttcactgttattagttaatgacttatgagctatataatatctatgcaactttttaatagttccaaccgagattcggttgtcttttccatttctcaatgtttattttgtcccatagtggtagttaggagcggccaccatttcatcctcgttgctgctatgaaatcatgtgtagatggatattaatttggtataacattcagcatctttaaact

SEQ ID NO: 127 - DNA, 1769 bp, Sorghum bicolor
gcagcagcagcagctcacgcgcgcgctcggcacggcacaccaccctctcgtctcgcctcagcgccggcccaccccctataaataacggcgccactctccccttcccccgcctccgcctccgctcccgtgtcctcctcctcctccctccgccgctcccttcctccaggacgcctccgccgcgccaatgcgccacgcctcgccgccgcaggagctccccgccgccgccgccgggggcgagatccaggcggcgctgtcccccgccaccgcctcctcctccgccgcgcgcgcccgcggaggcgggggcggaggcggaggctccttcacggcgctgctgggactccccacctcgcaggccatggagctgctcctcccccgcacggcgccgccgcccgccctagccccatccccagccccagccgcagcagcgcccgcgccaaccttcccctccgacccgcacctcgtggaccgcgccgcgcgcttctccacgttcgcgcccccgtctccgtccccgtcctccccgtccccagcgccgcctccaccaccccctcccgccgccgctaacgcaggcaagcgcaaggcggaacccgtcgaccgcgcctccaaggggaaggcggcgaagaaggggaagacggcggcggcggaggagaagcccacgggcggcgacggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcactggtgctagatgagatcatcaatcatgttcagtctctccaaaggcaagttgagtatttgtcaatgaggctcgcagctgtaaacccaagggtcgattttggtgggctagacagctttctgaccacggagtgtggaaggatagcaggcttcaactgcaagaacggaatcgacttggagcaggtaacctggccagaaatgggtgttcatggaacaaggcagctgatgcaacttcaacagcacttctggcatggtgatttagcacatccacaccaagtggcttcacagtgggaaaagcggggggatggccatcctcccgtctttggcaaccccagtccctctctcttcggctatgatctaacaagctctggaacgcaacaaaccccggcgagcaagctaaagaccgagctttgagcgacgatggtagatagcatgtcaggacagcaagctaaacatttgctgtgaggcggcagcagcgacagaatttcatcaatttgatcaagctacagacgagctgcgaatgaatggcggctgtggctgtggttgtggatggttgatgtcaagcgcagcgaaatcaatcaacattttcagaggggggatgtgtacatatagtgatagggatactattggcgttgagctgaaaacgggggatgcatgatgggccaggataccagctttcctgccgctgtcgttgtagagatgggcaagccctgctgctatcgttgaagagatgggcaagcgatactctggtttcgttgctgatattcttggtgtatttctgattataatggcccaatcttaaggttatctgagcagcatttttttttatgaacgaaaacagaaagaaatatcatgggtcatgtacccttctcgattgcatttcaacaagcattgcaaaagctgacatttttctctttctataaacacgaatgtaactata

SEQ ID NO: 128 - DNA, 1686 bp, Sorghum bicolor
aagagcaacccaatggcaccacttgtgcagtgcacactctggcacactttcacattgttgtttgaccaacctgcccttcaatttcatatggaaaaacgataacaggtgtagtactaggctatataatccacaaacacggacagggtttttcgcaaggatttcccagcctaagaaccagctcctggaacaagcttcctgactgtcaaaaatggaggctgcgcgtagctacttcttcgtcgccgcggttgccgtcgtccttattgcgcttctcccggccagcgccatagccgccggcctcaaggtcggcttctacaacaagtcatgcccgtcggcggaggccctggtgcagcaggcggtggctgccgccttcaagaacgacagcggcatcgccgccggcctcatccgcctgcacttccatgactgcttcgtcaggggctgcgacggctcggtgctgatcgactcgacggcgaacaacacggcggagaaggacgcgcccccgaacaacccgagccttcgtggcttcgaggtcatcgacgccgccaaggcggcgatcgaggcgcagtgccccaagacggtctcgtgcgccgacatcctggcgttcgcggcgcgggacagcgtcgcgctgtcgtcgtcgtcggcgtcggggagcggcaagaacctgacgtacaaggtccccgcggggcggcgcgacgggcgggtgtcgagggacacggacgccaacagcaacctcccctcgccgctctccaccgccgccgagctcgtcggcaacttcacgcgcaagaacctcaccgccgaggacatggtggtgctctccggcgcgcacaccgtcggccgctcccactgctcctccttcaccaaccgcctctacggcttcagcaacggcagcgacgtcgacccggccatcagctccgcctacgccttcctgctcaggagcatctgcccctccaacaccacccgcttcttcccccccaacaccaccacggacatggacctcatcacgcccgccgtgctcgacaacaagtactacgtggggctcaccaacaacctcgggctcttcacgtcggaccaggcgctgctcaccaacgccacgctcaagaagtccgtcgatgagttcgtcaagagcgacagcaagtggaagagcaagttcgccaagtccatggtcaagatgggcaacatcgaggtgctcacgggcacgcagggggagatcaggctcagctgcagggtcatcaacaacggcgccggcagcagcagcagcagcgctggattattcgagcttcaaatgacaaccgacaactctgctcaggaggaatcagcagcgaactagcaggtaggtagtaccagctatctgtagaggatctagtgatccactactactgctgctgctgtctgcatagccagtgacgatgttcttcagcactgcgatgatgagttctaccatgtcacctactgctcttgacctgcagaaatgaaataaacatcttctgaacatataaatttaaaacatggggcaattcctttttctgcttgtctgatgttggattacctgtgtgtaactacctctccattaatttcaaattacaagtcgcttttccttttctaggtatatacacaacttttgctatacatacatgtatctagacatacgtagaatatctaaatgcatagcaaaagctatgtattccctcc

SEQ ID NO: 129 - DNA, 1288 bp, Sorghum bicolor
agacatcaagcacagcacacagctagctagctagacccccatccggccatcagctagctagagctcccgcgcgtgcctgctgcagtcacgcgcgcgcgcgcgtagctcagcctccagccatccatgccggccttcgccgggagcgcagcggagccgccgctggcagacagctactacgcgctgctccgacgccgcggcggcggcggcaataatgatgatgaagaagcatcaggtggcgcctactactacgacacgacgtcgtcgacagtgccatcgtcggacgacgacgtggcggagtgcgagctcccgatgatcgacgtcgggtgcctgacgaccctgacgaggagcgagcacggatcgtcgtcggaggcggagcgggcggcgtgcacggccgccatcgcgcgcgccgccgaggagtggggcttcttccaggtgcgcaaccacggcgtgtcgcaggagctcctggacgagatgcggcgggagcaggcgcgcctgttccgcctgccgttcgaggccaaggccacggccggcctgctcaaccactcctaccgctggggcaccccgaccgcgacgtccccgcagcagctgtcctggtccgaggccttccacgtcccgctcgccggcgtctccggatccgccgccgccggcacctgcgacttcggcgacctcaccaccctcagggatgtgactcgggaggtggcgggcgcgatgtcaaagctggccggcacgctggcgcgcgtcctggcggaggaggcccggccccggccctgcctgcccgcgggcggcggcggcggtggcggtggcgagcgcttcccggaggggtgcgacgagacgacgtgcttcctgcggctgaaccggtacccgccgtgccccatcgccgccgacgccttcggcctggtcccgcacacggacagcgacttcctcaccgtgctctgccaggaccagcaggtcggcggcctgcagctcatgaaggggggcaggtgggtggccgtcaagccaatccccggcgccctcatcgtcaacatcggggacctcttccaggcgtggagcaacaacagatacaagagcgtggagcacaaagtgatgacgaacgccaagacggagcggtactccgttgcctactttctttgcccgtcctacgactcgccgatcggcacgtgcgaggagccttctctttacaggacgttcacgttcggagagtacaggcgaaaggtgcaagaagatgtcaagagaaccgggaagaaggtcggcctccctaattttctcgtgtaatggcctacatacccct

SEQ ID NO: 130 - DNA, 3684 bp, Sorghum bicolor
ccctcctcgcccgtcgcttccttcctcgtcacgagtcgtcgtctcctcttcgccgaccgggacgcggaaacgcccgacgcaagcaaaccctagccgccgagctcgcggcagggagggagggatgaagagtctgttcaagagtaagatcaggtggcagcaccggtctaccgaccccgcgtccccggcggggcagcaggcgtcgggcccgccgtcgccgtcgcccgcgagctccccgtcggggacggcgccggcgcccgcgctctccgtatccacggctgtctcctcctcgcctccctccgcggcggccacgcccacgggcgccgccgctgctgctgctgctgcggcgcccgcgcccgcgggggcgggggcgggagcgggaggggaggactacatatcgtccgaggaggagttccagatgcagctggccatggcgctgtccgcgtcttccaacggcgatttcgtgggggacctggacggggagcagatcagaaaggccaagctcatgagcctcgatcgcttcgccgcccaccgagacgaaggacacaccgcggagttgctctcccgccgatactgggactataactttcttgattatcatgagaaagttattgatggcttctatgacatctttggctcctctatggaatcctctaggcaggggaagatgccatcattagcagatctccaaacaggcataggggacctaggctttgaagtcattgtagtaaaccgagccattgatagtaccttgcaggagatggagcaagtggcacagtgcatcctattggacttccctgttgccaatattgcactcttagtgcaaagaatagctgagcttgttacagataatatgggtggacctgtcaaagatgctaacgacatgctcacaaggtggctggagaagagtactgagctgagaacctcgctacaaacaagtttgttgcctattggttgcatcaagatagggctatcacgtcaccgtgccctacttttcaagatccttgcagatagtgttgggattccatgcaaacttgtcaaagggagcaattatactggtggtgatgatgacgatgctataaacataattaagatggacaatgaaagggagtttttggttgatctgatggctgctcctggtgctcttattccagcagatatcttaagctggaaaggcaattcgttaaactctaatcgaaaacttgccctgaatcaaacagttggatcatcaagtactgttgattctaatatggatcctactgtattgccacttgaacctaaaggtggccaactgcctttgttcagcagtggtgattggatatcagacagtggttctggatatgaggcagcagaaactgcaggttctactcaaacctcttcgggtgccacatcatctgttcctgctggaaatgtttttgacagttcatggctgctggttaatcatgaccaatcagatggaccatcaacttctgctggtacatcatcccagcagaaagttgtacctcaaagtgaacatcagcagaatttaaatcgccttccagatttgcaggaaattccagagtcaaaaaacctttttgctgaccttaatccttttggggatatgaagtccaagaaaaagtcagtaccattcaaaggaccagatcataggaacaatgagttgcaaaagcgcagagagaacgtagttcctaatgctggaagaccacagcagcggttagttatgaagaattggtctccttacaatgatgtttccaacaacaaacagtacaattatgtcgaggattcgtttgctcgtagaaatgttggcaataatgctgcatcatcatcatcccagatgccacgaccagcctcaaggtctaatcttaattctggattgcgtaatgatgcatcatatcataattatgatagtattatggctggtacctctgccatgaagattacatctacagctgagactgggaaggttcctgaaagggttctgcgtggtgatttggacaaaggtcaaacaaattatagactggaggaccaacatgtcgtagttcaaccaccacaggaaagacttccatggggcaatcctgcagaaggaagatttccaatgaatagagttcagagtccagcaaaacaacacattgaaaacatggatgtaaagcaagaccataagaaaatgctccctgatccaaaaaaatctccccttgacagattcatggacacgtcattgccatcaagaaacatggacatgaggtcacagaggcttgactttgatgatgtgtctgagtgcgaaattccttgggaagatcttgtgattggtgaaaggattggcttaggttcatatggagaggtttatcgtgctgactggaatggaacagaagtagctgtaaaaaaattcttggatcaagatttctatggtgatgctctggatgagtttaggagtgaagtccggattatgcgtcggctgcgccatccaaatattgttctctttatgggtgccgttacacgccctccaaacttatctattgtatctgaatatcttccaaggggaagcttgtataagatccttcaccgccctaattgcctaattgatgaaaagcggaggatcaagatggcccttgatgtggccaaaggcatgaattgcctgcacactagtgtacctacaattgttcatcgagatctgaaatctccgaacttgctggttgacaataattggaacgtaaaggtttgcgactttggactttcacggttgaagcacagtacatttttgtcatccaaatctactgctggaacacctgaatggatggcacctgaggttctgcggaatgaacaatccaatgaaaagtgcgatgtttacagctttggtgtcatcttatgggaactggcaacacttagaatgccatggagtgggatgaatccaatgcaagttgtgggggcagttggtttccaggatagacggcttgatattcccaaggaagttgatcctctggtagcaaggatcatatttgaatgctggcagaaggatccaaatttgcgtccgtcatttgcacagttaacgagtgccctgaagactgttcaaagactagtgaccccttctcaccaggagacccagagcccccatgttcaccaagaaatctcagtgaacttgactccttaggggggctttcacacttcccgttgtgcatagtttatattcttttgctgtttgtgtttgtccaaaagtcggcaaatgcgggcgcaccttgtagattgagcgccccaggtggtagacactctgccgccgcgacaaggaccccgcagtagggtatgtatagagtcgcccatcaaacagcaatcggaagaagtgattcaatgtgtggcaactgattgttatgccctcgtcaatcccgcttttgtacacccaactggccaacgcgagccctctggaaagcagtgagagctctttgtgttcattgtgaagtgcctggctatgtgaaagtgttttttttttcatgctgctaaaagaagacagcatatttggaagctggaagtgttgtaacactatacaatcaggacacgtgaatttaggatacattgtacttttgtaagatgtgtttatgctcgcagagtagcatgagcatgactggcttaggtgttgtttagttacacctaaaatctaaaaactttttaagatttttcatcgcatcgaatcttacaataaat

SEQ ID NO: 131 - DNA, 1641 bp, Hordeum vulgare
tctttctcccctcgccgtcgcctcctcgtcttctcacacaaaccctaatctccctcctcttctcccgagaaccgaggccgcgggcgcggggcagatggcgggcaaggaggacagccggatcttcgtgggcgggctctcgttccacaccgacgagcgcaagctcgaggacgccttccgccgcttcggcaaggtcgtcgaaacccagatcatgctggagaggcacacaaaccgccaccgtggctttggcttcgtgacgttttcagaccccagggcagttgagactgctatcaatgacatgcacaacaaagagttagatggtcgtaccatttcagtgaacagggctgagccaaagttgcaaacagatgacacgcggtacagcggtggtggcggcggcggtgaccgtggggattatcgtggtggcaagggtgatggtccaccccctggcaattgctttgagtgtggccgtgctggtcactgggctcgtgactgccctaaccctggtggcggccgttcggggcgattcccttccaagttcagtggcggcggtggcaggggagaccgcttttctggatcagacaggtttggtgaccgttatgtggatgatcgctatgatagtggccgttatggtgggtaccgtgagcctattgacagcagagacagatatgatgggggccgtgatcgttatgccagcgaccggtacccctctggtggtgaccgctatggtacagacaggtacggagcagccccagaccgttatgcaccaagtggcggtggaggcggctacggcagggagcgagaaagaagctatgagagagacacggtgcgtggtggcgcctatgacaggagcggcccaaggggcggcgcaagctacgacagggatggcccaaggggcggcatcggcggtggctatgacagggacggtccacgcggaggcggtgccgactacggcagcggagggcctacccgctacgagggaggaggttacagggagaggcctgcgccgtatgaccgccccagcaggggaggaggccgctttgacgaccgctactagcgacccgttgctgcagccagtcgagctatgtatttgcgtttgaacccttttcagtttggcatggccgaatgcttgatgagtactctgtcggcaccggttacctctattctgtactgcaaatgttactccccccctgagcactggttgagtttatcctgcagactgttttccatggtgagttttgagtctgtggttgttggctgtgggccacctttgctgaacggtttctgtacttgcatcttatcatcaatctgtctgaatttatgaaatccctgctgcccggctgtggttggtatgaaatcttgcttctctgctgtggttgaacctgttctgtaccagaattggtacccacaactggctgagtttatccatctgtctgcttccattgctgaggtgaattatgccatggtttgctgaggtgaatctgctatgccatggttgtttggctgtgtgctaacctttgctgaacgatgttttatgtatgatcatgatataaccagcctgagcttatgaaaccctgctgctctgctttggttggcttcatggtggatctgcaactgccaaggttcgtgtttcgagaaagagggtcc

SEQ ID NO: 132 - DNA, 1433 bp, Hordeum vulgare
aacgtggaagctcaatataccaacactctaacagcaagcaaccatggcttcttatgaccaacaattcaaggttctcgaggtacctccgatcgtgcaagagctggtaggcgccggcgtgaaggagccaccgagccagtacgtgcttccggagcaagaccgtcccgctgcggcggctgtctccgagatgcccgagcccatccccatcatcgacctcagccggctgtctgccggcagccccgaagagttcgccaagttgcggtccgccttggagaactggaacctcttcctggctgttggacatggaatggagcctagctttcttgccgaggcgatgaaggccaccagagagttcttcaacctcccactagaagagaaacaaaagtactcaaacattgtcaacggcgagaagatgggcatggatggatatggtaatgacatggtcgtaaaagagaatcaggtccttgactggaacgaccggctcaatctcctagtggaacccgagtccctaagaacctacagactctggccaacacaacccccttctttcagagacatcctgtgtgagtacacggtcaggtgcaaggcggcggctaaccttgtctttcgaaacatggccaagatgctcaatttacaagaggaccacctggtaaacatgatcggcaacaactccatcacccaagctatattcaactactaccctcagtgtccaaggccggaccacgtcttgggacttaaggcccataccgatggctcgataatcacagtcaacttcgccgatgccgaggggctccagcttgagagaaacggcgtgtggtacaacgtgcccatcgttccaaatgcattggttatgaacataggagatataatggagattttgagcaatgggtttttcaaaagcttggtgcatagggttgtcaccaacgcggagaaagagcgcttgtcgttggtgctggtctatacgttggagctagagacacaacttgagccggtgtcagagctggtggatgacaagagacctgcccgatacatgaagatcaagctcaacgactacatggaaaaataccatgacacttatgccactgggacactagccatagacggcgtgaagatctgaatatgattccgatgtatgcaagctcgctgagtaagatctatggtgaagtatcttccgttgaccagtttgtaacgagtttatgtttttacctatttcccagatttttgtgtgtgtactcctcatgtaaaatgttgggcagcttgtgtggtcgcattaaaccctattataaaacttatccgctgtgggcaacatacggatgcaaaggatggaataaaacttatcgattgtgtgcaacatgcggatgcaaggatagtttttcctgttagtatgtatcattgataagtaccattgtgcctccgtttcaagaaattaagagacc

SEQ ID NO: 133 - DNA, 2134 bp, Hordeum vulgare
ctttcactttctttcaaccatgtaaactattacggggacatgcctgcagaaatgagagagcaaggattcgccgaaagccgtcttcagttgctctctgatatcagtggtgcttttaggccaggtgttctgactgcactagttggtgtgagtggagctgggaaaaccactctaatggatgtcctggcaggaaggaaaactagtggatcgattgaaggaagtatcaccctctccggctaccctaaaaaacaagaaacttttgcccgcatcagtggctattgtgaacagactgatatccattcaccaaatgtcactgtatatgaatccattctctactctgcctggcttcgcctttcctcagatgttgacgaaaaaacaagaaagttgtttgtggaggaagtcatgactcttgtagagcttgatgtgttgcgtaatgctatggttggtctccctggagtggacggattatcgactgaacagagaaagagactgacaattgccgtggagctggtagcaaatccttcaatcatattcatggatgagccaacttctggtcttgatgctagagccgcagcgattgtaatgcgggcggtgagaaatacagtcaacactgggcgaactgtggtttgcactatccatcagcccagcatcgatatattcgagtcttttgatgagcttctgcttatgaaaagaggaggacaggttatttatgctggtgaacttggtcaccactcttataaactagttgaatattttgaggcaattccaggtgttgaaaagatcacagaaggatataatcctgcaacatggatgctggaagttagctcccctttagccgaggctcgcctgaacgtcaactttgctgaaatttatgctaattctgaactttataggaaaaaccaacaacttattaaggaattaagcgttcccccgccaggctatgaggatctctcgtttcctaccaagtactctcagaacttctacaaccaatgcattgcaaacttctggaagcaatacaaatcttattggaagaatccgccccacaacgccatgcgctttctgatgacgctcatcaatggccttgtatttggcacggtgttttggcaaaaagggacgaaaataggctcgcaacaagatctgttcaatctacttggagccacttatgctgctgtcttcttccttggggcctccaactccatcacagttcagcctgttgtgtcaatcgagcgaacagttttctaccgtgaaaaggcggcagggatgtactctccattgtcctatgcattcgcccagacatgtgtggaggtgatctacaacgtcgtgcaggggatcgaatacacggtgatcatctatgcgatgattggatatgagtgggaagctgcaaagttcttctacttcctgttcttcatagttgcaagcttcaactacttcacattgtttggcatgatgctggtggcgttgaccccgtcctcgatgctcgcaaacatactgatatcttttgtacttcctctttggaacctgtttgccgggttcctcgtcgtcagaccgttaataccgatctggtggaggtggtactactgggccaaccctgtgtcgtggacaatctatggtgtggtggcgtcgcagtttggcgacgacaagagtcctctggaggtccccggtgggatcgacacgtttgtgaatcagtacttggaggacaacctgggcatcaagcatgatttccttgggtatgtggtgttggcgcactttgccttcatcatcgccttcttcttcgtgttcggctactccatcaaggtgttgaacttccagaaacgttaggcagacggccacttatgcttatgcaagagagaggcggcaatatatagtttgtgtgtatatgtgtatagtagaagtagtaggatacatacataacattattgcataagctctgctatttagaagccaggtagttgatagcgatatgccggccctatttttatcataataattgttgttggtgtcctgcaagacacaaggttatgtagcatcttgcgtgtaagtatcccaaaatagtattcttccccaataaaaagtgaaggaaagtgttaacgcgagtgtttctgtcacatacaagttgttacggtcccggtatgaatta

SEQ ID NO: 134 - DNA, 2211 bp, Hordeum vulgare
ttctcccccgcctcgcctcccccgacatggcgatcaccggcggcccgcgcggccgcctcctcctcctcctcttcctcgccgccgcctgcctcgtctgcgcccccgcccgcgccttctacctccccggcgtcgccccacgcgacttccagaaggatgatgatctccaggtgaaggtcaacaagctgtcatctataaagacacaacttccatatgactattatttcctggactactgcaaacctgaggcgattaagaacagtgctgagaacttaggggaagtccttcgtggggaccgcattgaaaattctgtctataatttcaagatgaggagggacgagagctgcaaagttgtttgtcgaacaaaactttctgcagaagctgcaaagaatttcagagagaagatcgatgatgaatatcgagtcaacatgattttggataatctcccagttgtggtccctagacaggcacgggaaggaagcccaacaccgaactttgaccatggttaccgcgttggctataagctcaaggatgacaagtactatattaataatcacttgagctttaaagtcttgtaccatgaagacctgaactccccagaggctcgtattgttggcttccatgtgattcctagcagcattaagcatgaatatggtgcctgggatgacaagaatcctacagtacaaacttgcaatgctaacactaagataactcctggtagtcacacacctcaagaggtggcccctgatgcctatgttgtattctcttacgacgttacctttgaggctagtgagatcatatgggcatctcgctgggacgtctaccttctctctagcgacagccaaatccactggttttctatcattaactccttgatgattgtccttttcctttctggcatgatagccatgattatgatgaggaccctttacaaggacatagcaaactataatcagcttgacaatcaggaggaagcccaagaagaaactggatggaagttagtgcatggtgatgccttcaggcctcctgttcattcaggccttctttgcgtttatgttggaactggtgtgcagttctttggcatgacagtggtaaccatgatgtttgcgctacttggattcttatcccccgcgaaccgtggaggactcatgacggctatggtccttctgtgggttttcatgggtgtattggcgggttacacgtcgtctcgcctctacaagatgttcaagggcactgaatggaagaagattaccctcaaaactgccttcatgtttcctggtataatctttggggtctttttcgtcctgaatgcccttatctggggtgagaaatcatctggtgcagttccttttgggacaatgtttgctctggtccttctctggtttggcatctccgtgccactggtctttgttggaagtttcttgggattcaagcagccagccattgaggacccagtcaagacaaacaagattcccaggcaaattcccgagcaagcatggtacctgcagccagctttctcgatacttgcgggtggcatattgccatttggtgctgtctttattgagctcttcttcatcctcacatctatctggctgaaccagttctactacatcttcgggttcctcttcatagtcttcgtcattctgctggtaacctgtgctgagatcacaattgtgctctgctacttccagctgtgcagtgaggactaccactggtggtggagggcatacctgaccgcaggctcctcagctctatatctattcgcttatgctatcttctacttcttcaacaagctggagatcacaaagcttgtttcaggcattctctactttggttacatgctgatcatttcttatgccttcttcgtcctgactggcaccattggcttctatgcttgcttctggtttgtgaggaagatctatgcttctgtgaagatcgactgatatagcaactttcaagataagtttcccgtctgcttctagagcatatcccgtacaaggttttcttgcgatatcatacatggtgctgagaactgggatttgagatgggattccatggttttggtagaatatgtgtagcctggtaggagtaagaatcaccggatgttcacggatgttgaagagagaatttgatactcgtcgcagattagcatgtcttgtgtaattctaaaagtatcgagtgctcctgtactgtttgggatcttgattgaccatg

SEQ ID NO: 135 - DNA, 1389 bp, Sorghum bicolor
gtgcatcgcagatagaacaggggacacacagagtgttctcctagcacgcagcagatcgggtgcgtggcgcagtcgcaatggcaatggcaatggccacggccaagctcgtcctcctgatggtcctcgtggccggcagctcctgcggcggcagcgcctggcgggggccactgagcctcctccggacgctgccgacgacgacggcggcgcagtccgtcgaggccgccgcggagcgcctgaaggaagacctgtcgtcggcggcgtcgtcggcgtcggcgtcgtcgtcgctgatccacgcgctgcggcccctgatgggctccgcgggagacctgggcctgcgcgccggcgtgccgtgcgacagctggcggctggccgtggagacgtacaacaagcgcgactggacgacggtgccgggcagctgcgagggctacgtcggccactacatgctcggcgggcactaccgccgggactcccgcgtcgtcgtcgacgaggctatcgcgtacgccgaggggctcaagctcgccggcaacggcaaggaggtgtgggtgttcgatatcgacgagacgtccctctccaacctcccctactatgccacccatggcttcggcactaagccgtacaacgcaacgagcttcaacgagtacgtgctggaggggagcgcgccggtgctgccggagtcgcagcggctcttcaagaagctcatctcgctcggcatcaagccggtgttcctgacggggcgcaccgaggaccagagggccatcaccgtcaccaacctccgccgccagggctactccggctggatggacctgctgctcaagcccgtcgggctcaaggccaccgccatcgcctacaagtccggcgagcggcagaagctgcaggacgccgggtacgtcatcgtcggcaacatcggcgaccagtggagcgacatcctgggcgcgccggagggtgctcgcaccttcaagctgcctgaccccctctactacattggctaattgagcgatgatgccacgttggcctccgtataattgttaatccatcgcagcggctctccatcagcccatcatcgatcgatccgtcgcccggttgcaatgcctgtgctgtttgtgatgaactgctctttgttgtttgttatatccttcccttcttattttacgaccgctgcatgttatcattaattcctaaaggttaatttcctgagctgagtggaaataaaagctgactatgtggagagctgtcgatttgtcaataaaggttatgacagctgcattttatttttcgtagcctgggatggtatttgtatttagtagatatgatggttgcgtaatttaacacgtatgttatacgtgttttcctatgtgttaaataaaggatgccatgccacaatgggtcgcg

SEQ ID NO: 136 - DNA, 1531 bp, Sorghum bicolor
caggtttatcagcccactgaagaagaaatcaggcgttggctagacccgtatgagaatgtcgtttgtatagagtgcaatcaaggtggtgatgatagtctcatgctactatgtgacatttgtgattcctcagcacatacatattgtgttggcttgggaagagaagtacctgaaggaaactggtactgtggaggatgtagactcggtgatgagggaccatcatatactggaattcagcgtacagtggcttatgaaagacaaacttacagaaatcatgtcgatagtagttctgtaagttttggcatgcttgcatcaagtggcacatttgaaaggccaccatcaatcaaccctcgccattcttttcaagggattgatctaaatctatcaccaagagagtttcctggagaatcacatcctgctgaatcacaagtttcaactgatagcgtatcaactcccactggaagacgaactgtttcggcaaggcgtcaaatacatcggtacattcggattttgctagccagaccaagacaacctagtagaccagacgtattccacaatattgcgcagcacagtggtggtgtaccaagaactgaaccgaaccgccagaacttcccttcttcatcagaagcaaacacatcacataatctgcctgatggcattcagaaccatcacggtagccttccatttgttcaagctcaaaacaattttgctccattcatgtccctagatggggatgacttccagcaaattgagggtgtcaagagcaacctcaggaacatgtagcccttactagaaggcccattctaccctgtgaagcttaccaagggagcaacaagtgccgtttgtatgacttgtggaactgaaaatagtaaaagcttgtgcctgttgcctgaccttggcatcctccctgaaattgcaaccatgctctcaattgtgacagccttgaaaatatctggttgatgtggttcggctcatttgtggagatgtggtcaatgacataagatacatgcttttcccaaagccgtctgtttaagtttaggcattttttgttgttatcattcttattcattcagtcattaagcacaacctcagattacacagcgaaaaaggaatttctgaatgtcttgatagcttcagatttatacactgtaacattgtggggacaccaatttcattagactaatcattcttttccttgcgacatgcttttttgcctattaaggaggctgctaacttcccagcctctcttctgtaatcatgtatggtgtggagctaaactggtaagcattaggcaaaaacctttacctcgttcaggtaactggatttctgttctatcagggtacatttttggcttgtattttatctgagcatagtggtctagttgtccagcgcagatgcatttttcacaggtgaatgtttgaaagcttgttccatatcggctcaagtttgccttgtttagttctaaaatttttttggttttgtatattgtagcactttcgtttttatttgacaattattatttaattatggacta

SEQ ID NO: 137 - DNA, 938 bp, Solanum lycopersicum
ttgttcattttcctcctttgggtattcaattttttgaaattcttggagagtttgttaagtttcttcacttgggttttcttcaaaaaaaccaatctttttcgtctctgaatcaaagaaattgctactctgtactgcaaaagtgaagaaagacatgggtgttgttcatactctgcattttgtttttgggatatttggaaatgccactgctctgtttctgttcttggcaccaataatcacattcaagagggttatacaaaatcgatctactgaacaattctctggcttgccttacgttatgactttactcaactgccttctttctgcatggtatggtttaccatttgtgtcaccaaataatctgttggtgtctacaatcaatgggactggagctgtaattgagaccatttatgtgctgatcttcattgcatttgcaccaactaaagagaagaagaaaatctcagcactttttctattagtccttactgtttttgctgctgtagcccttgtttccatgcttggtttacatggaagcaaaaggaagctcttttgtggtatcgctgccaccatcttctctatcattatgtatggatctcctctatccatcataagactggtgatcaagacgaagagcgtggagttcatgccatttttcttgtcgttgtttgtgttcttatgtggcgcttcctggtttgcatttggccttcttggcaaggacccttttgttgctattccaaatggttttggttttggtttaggaacagtgcaacttatcttatatgcaatctactgtgagaagaagggattcacaaggaaatcaaaccttgatgagtcaaatggcaagtctcaccaagaggagaagcaatctagcaagtcaaggcttgagcaagtttaggacatgattgcctctaattcttcttgaatgatgattgtgcatcttc

SEQ ID NO: 138 - DNA, 1765 bp, Brachypodium distachyon
aagcactcgcaaaatccttcaaaaactggccagcctagccgcgaggatttccggactagcgtaccatggcgccatttcccgtctctcctccttcctcgggcggcggtaaacaagctggtgcagtaataggcagtccaagatcatcgctgcagaggagcagcagcgagtgcaacgtggtggtgcagaggaacatcaagtcctcgctgctgctcctgctggcgatctccgccgtcttcgccttctccatcctctactcgtctcgtaacctgaccgtggcgaccatggccggcgaagcggtgacgcagggacccttgctcgcagcccttgacatgggccgtatggtgcatgacgacgaggccgttgatgggccagccggcccagacacggacgtgaatgaacagcgcggcggacccgcagatgacgtctccttgccggcggcgaacgacccatcggctgctgcagtagtagcccctgcaccgagcacagctgaccaaacagctggtctaagtatgcagcttgaggagaaatgcgacatttccatggggaaatgggtgaaggagccgaaaggtccggtgtacaccaatctgacgtgcccgatgctgccggactacaagaactgccagaagtacggcaaggacacgggccacctctactggcgttggcagcccgacgggtgcgacctgccgcggttctccccggcgcggttcctcgacgtcgtccgcgggaagcggctcgccttcatcggcgactctctggcccgcaaccagatggactccctgctctgcctcctgtcgcaggccgagacgccagcggaagtgtactcggacgcgctggacaagttcgggacgtggcatttcccggcgcacaacttcacgctgacggtgatgtggacggagttctacgcgcacgccgagccggtcctggactcgtccgggaagccgacggcctcgttccacatccacctggaccggctcggcgccgactggacgagccggctgcgggacctggactacgccgtcatctccggcggcaactggttcttccgcgtcaactacctctgggaaggggggcggctcgtgggctgcctcaactgcggcggcaaggggaacctgacccaattcggcgtcgcggacgccgtccgccgcgtcgtgagagccgccatcgagggcatcgccaagtgcaaggactgcaagagcggcctcgtgacgatcctgcggacttactcgccggaccacttcgagcacggctcgtggttcagcggcgggtactgcaacaggacgcagcccctggaggagcgcgaggtgagctttgagagcgtcgggtgggagctgaggaaggtgcagagggaggaagtgaggcgggcgatgaggaaggagaacttggcgagcggggccgggaagaggtacttcggggtgatggacgtgaccaaggcgatgatgatgcgcgccgacgggcaccctgatagacactatgacaagcggtgggtgaggaacggcagcgactgcctgcactggtgcctgccggggccggtggacatgtggaacggcgtgctgctccagaggctcgccgagatcgatcccgcaccgctgccgatcgatcgtggtgaggtggtcaattagaggagcctcacatggtttcgcgtcgccgtgagcccgtgatcttgtttatactcccaagttcgaaatcttacgtcttggaagctgtttggttttcacactccccggaaaaagaagaaaatattagtactcacatgttacagttgttt

SEQ ID NO: 139 - DNA, 1097 bp, Gossypium hirsutum
caaccacaaccatccatctcagctttcttatccttcctcccaccactagtctctcccttacccgaatctaaaagaataaaaccgatccctcaccttcctctctttcttcatcatcagcaaagaaatataccagaaaatcaaaaagaagaagaaaagagatccccaagatgtctcttacaatcccaactaatctctcaaaatcaattttgaagccaaagctggagacccaagtgatccccaaggcttcatccagatcattgattgtatgctcctccagcaatccttcctcctccgacaaatcggcttcaccactccaggccttctcagcggctctggctctttcttccatccttctttcagctccactccctgctgttgccgacattgcggggctcactccttgcaaagagtccaagcaattcgccaagcgcgagaagcagcagatcaagaagctggaatcctcgttgaagctttacgcccccgatagcgcaccggctctcgccatcaaagccaccatcgagaaaaccaagagacggttcgacaactacggcaagtacggcttgctctgcggctccgatgggttgcctcatttgatagtgagcggcgatcagaggcactggggtgagttcatcacgcccggcctgttgttcttgtacatcgctggatggatcgggtgggtcggaaggagctacctcattgctataagcgatgacaagaagccagccatgaaggagatcatcatcgatgtgcctttggctaccggtctcatcttcagaggctttatttggcctgtcgctgcctacagagagcttatcaatggtgaccttgttgtcaaggacgtttaatcttatcttcctcagagattgaatggaacaacaactaggatgcgaagactgactttgttcatggagaaaagaggcgtcttgggaaatttcttctacttgtatatgtaaaggtttttttaatctgtgtgagcttatgtaatgctagtgttaaaacataatttggatatgatttttctctccatctcaatcgttgttacccaaattcatgtgacagtaaatacaaatgtgtgctataaacaggaaactttgaat

SEQ ID NO: 140 - DNA, 1723 bp, Glycine max
agtgccaagtaacctactaaccaagccaatggattctcccttactagaaaacattgacaactcttgttctaatgttgaggaggagaagacaccgaacactgttgttaagagatttgggtttgagtcgaagaagctatggaaaatagctggccctgctatcgttacctctatatgtcagtactcacttggtgcactcactcaaacatttgctggccttgttggtgaccttgatcttgcagcagtttctgttgaaaattctgttattgctggcctcgcctttggagtcatgttgggaatgggaagtgccttggagactctgtgtgggcaagcatacggtgcgggacagatcaggatgttgggtgtgtacatgcagagatcatgggtcatcttgttcatcactgcccttattttgttacctctttatatttggtcacctcccatcttgaggctcgctggacagacggctgagatctcagatgctgctggaaagtttgctgtgtggatgatacctcagttgtttgcatacgctataaactttccaatagtaaagttcctacaggcacagaggaaagtgctggtgatgttatggatatcagtagttgttttggtgctgcacacattttttagttggcttgttatatttaagcttggatggggcctaattggagcagcagttactctcaatacatcatggtgggtgattgtgattgcacaattgttgtacattttcatcactaagtcagatggagcatggagtggatttacatggctagcattttcggacttgtttggttttgtaaagctttctttggcttcagctgttatgttatgcttggagttttggtatttgatgatactggtggtgataacagggcgtttggaaaatcctctgatacctgttgatgccatatctatctgtatgaacataaatggttgggatgccatgattgcgattgggttcaatgctgctataagtgtgagagtatcaaatgaacttggagctggtgatttcaaggctgcaaagttttcagtgtgggtggtttccatcacatcagtgtccataggtgttgttgtcatgatcggagtgctattaacaaaggattactttccctacttgtttaccaccagtgttccagttgccaatgaaacaactaggctttctgctttgctagctgtcacagtgcttctaaacagccttcaaccagtcctatcaggtgttgctgttggggctggctggcaatctctagtagcatacatcaacattgtgtgctactatctagttggattaccggcagggataatattgggatttaaacttggtcttggagcagagggtatttggtcagggatgattgcaggcatagttttgcagactacaatccttataatcgtcacttcaatacgaaactggaaaaaagaggctgaagaagcagaaagccgcgtgagaaagtggggaggagcaatttcatatgatcaatgatttttttttatcatagtagagaattagacagagactctattgagtggcaccaataaatgaagaactttaaatttttcgacatgtatttgagtgaggacttggaaatttaattttagattataggccagcttgttatgatttctacatggatatttcacatgattgagcaccatttggttgagcactaattacaagtgtttaactaagttagtagtatttaaacaaaagaatctcaatcttatc

SEQ ID NO: 141 - DNA, 1637 bp, Glycine max
aatcacaattaacaaatcctcgaaacaaaacaaaaactggggcgggcacgaagagcagagggaggaagaaagggtcgaagagaatgtgggaatcaattgttttgacggtggttgccaccgccggcaacaacatcggcaaaatccttcagaagaagggcaccgtcattcttccccctctctctttcaagctcaaggtcataagggcatatgctttgaacaaaacctgggtgataggttttctaatggatatatttggggcactgttgatgttaagggcattagctcttgcgcctgtctctgtcatccaaccagtttctggctgtggactggcaattctctcagtcttttctcatttttatctcaaagaagtcatgaatgttgttgattgggtgggcattaccttggcaggttttggcacaataggagttggtgctggaggtgaggagcaagaggctgctgctctatctattttccacataccatggctggcatttgttgttttcatcttgtttataatgcttaatggatggcttcgtatattcaaacgtaatcgaagagaacaagagatgatggaatatgatgttgttgaggaaattatttacggcttggaatctggaattttgtttgggatggcatctgtaatatcaaagatggggtttctgttcttggagcaaggcttccccaagctgttggttcctatttgcatcatcataagtgtctgttcaagtggtacaggcttttactaccagacacgtggtctaaaacatgggagggctattgtagtttctacatgtgccgcagtggcatctattttgactggtgtacttgctgggatgcttgctttgggtgagcgactcccttcggccccaaaagctcgctttttacttcttcttggatggctacttattattgttggcgtgattttacttgttggttcaacaaagctagtgagattctttcgattttcttcacaccactttaaaagaagcagcgttgataagaattatggccctagaagatctggaacttcccgtgttagggaacctagcccaactgctgtcattcaagcggctaccttaaatcatttactctcatcatcttccaaagaaaaagcttgatttgacttgagctggaaaatgatccttcatccattctcaggattcaccctcaccccttaaagaagaagaccccttttgtaaggctagattgtttgtgtacagtggttgctttatcagagggcatgaatttttagggatcgttccttccgactcacgtattttgcgtgaaaaatcattatcttttctgatgccacttgtataattcatgaacttccaatatttctcgatattgtatatgaagatggtatagcaagatgctgaatgctagcattgcatggaaacaaattgcagggtgcagtgcagaacaatttattcctaatttcctatgctaatgtagtagcagtgttctttgagattaggtctgatttctgttaccaagtaatacgagaaggctgtactttatcctctccgttgaagggaaatataatggaaagtttactatttgacatttcaaaagtgagaggtatattatatttccttttaatttaaagttaagattgagatattttaatcgaaatt

SEQ ID NO: 142 - DNA, 651 bp, Hordeum vulgare
aaacacacagctcccactctcctcactccacaccagcgcacccacccaagaaccgcaaagccacgaccacgatcgagagcagagcaccccatgggggcgaggcagcgcggtgagagaggcggtatgccgacgacgaccacgaggtcgaggctggcggacgcgtcgtcgtggtgcctcgcgctgtcggcgctggcggcgctgctgctggtgtgctcgctgggggagacgacggaggccgtcaccgtgcggggcgcgtcgctgtcggcgcggtggcggccgtgcgaggagatctacgtggtggcggagggcgagacgctgcacggcatcagcgaccggtgcggcgacccctacatcctggagcgcaacccgcacgttcacgaccccgacgacgtcttccctggcctcgtcctcaggatcacgccctccaaccccaggccgtccgtccccgctagccccccgtaggtaggccacaagaaagaacagactggttgttctggagattcgttcaagtccctacgatggactctgaatctctgatttgcgagcaacctcggtactcccaagtactaaactactactaatagtccagaatagttcagtggtggattgaataaggccttgttcctttggcctcctttcagcccttaattc

SEQ ID NO: 143 - DNA, 1335 bp, Hordeum vulgare
ctgtgtatgtactacgctcggttctgaaaccacgacccacccagcagccagagggaaagggggagaaggagacaccgcggcgggcggagaggcaatggcgacgacgacgtgcctgctggcggcctgggcgctggtcgccgccggactgttcggcacgggcctcgcccgggcgtccttcgccccggccgccgtcgggaaggagcagcgcgagttcgactacttcgcgctggcgctgcagtggccgggcaccatctgctcctccacccgccactgctgcgccgtcaacggctgctgccggaaggagccgctccacacgttcacgatccacgggctgtggccggactacgatgacgggacttggccgtcgtgctgccgccacaccagtttcgacatggacaagataacgcctttgaagcccactctggacaagtactggccgtccctctactgttcgtcctcttccacttgtttcagtggtaggggccccttctgggctcatgagtgggagaagcatggaacatgctcggcccctgctgttcgggaagaattacagtacttcagcactgcccttgatctctacttcaaatataacgtgacagaaatgttggcgactggagatatcctggtctccaacggtaaagaatatgcactgagtgatgtcattgacaccatcaagcatgcttttgggggctcaccgcagatcatctgcaagaagggctcagttcaagaactaaggttatgcttcaccaaagatttgaagcctcgtgattgccttactacttcggcaatgtacaagaacctatcgaaatcaaagcattgccctcgaaaaatctccctgccaacatatgatcccatcgtactcgccaattcaacactggagattgtcccagaagccagcgacaatgggctgtacttctttacatcctaagatactgagcattgctgggttacgaggaaacagatgccttcacggccccgactgcttgcaagacctgtagccacagatgctgggcactaagatcccagtaaaatgggtctctggtttgtccatgctatttgtaaaggagaacattccacattagaacaacttagttcaattatgttctgaatatttataaaactgctggaaatcaaatactcagctcagatgcctcgttgtatgaataatgaaagttgcatgtacatactaacacgctttagctgggcaagggccctttgtacttcattggatctttagctgggcagggccctttgtacttctttggattaccaaaggatttggcatgccagtatgccactgttctaagcacgtctagttatgaacggtttacgctg

SEQ ID NO: 144 - DNA, 1184 bp, Gossypium hirsutum
gtcaaacaaacagccagaagcagccagccagccctcgtttccctcattttcctcttcattttctcgggaaaaaagaagcatgggaaaaggtcctggtctctactccgatatcggcaaaaaggctagagatcttctttacaaggattaccaggctgaccacaagttcactgtcactacttacacttccaatggagtcgcaatcacatcaaccgggactaagaaaggtgaattgcttttggctgatgtaaatactcagctcaagaacaagaacatcacaactgatgtgaaattcgactccagatcgaatcttttcaccactgtcactattgatgaacctgcaccaggattgaagaccatctttagtttcgttgttcctgatcaaaagtctggcaaggtggaactgcaataccggcatgaatatgctggcataagcactggcattggattgactgcaaagcctcttgttagcttttctggtgttattggaaacgattctgtctctgttgggactgatctctcatttgacactgccagtggaaactttatcaaactgaatgctgggttaaatatcacccattctgacctcattgcttccatgacattgaatgataaaggtgatactcttactgcttcctactaccacattgttagtccattgactaacacagcagttggtgcagagctgacccatagtttctcgagtaacgagaacactctcactattggtacgcagcatgctcttgacccattgaccacagtgaaggctcgtatgaacaactatggcagagcaagcgcactgatccagcatgagtggcgcccaaaatccctcttcactatatcaggagaggtggacaccagagcaattgaaaagagtgctaaggttgggttggccttggcactcaagccataggtaaatttattatcattgttgtgcagttgaagggaaggccataaatttgattggtggagacttggagagaaataatgtactttttacggatttgacattgatggtcatggccctcatggattgtaaaaataattgtgagtggcaaactttagcgatttgtttttgttgaatttccaagggcatgcagttttgttgaacaagcttcatgttgtcaaatgtcaattgacctgtgaaattgagtgttgttttattcatctgtgaaatggttcacttt

SEQ ID NO: 145 - DNA, 1534 bp, Gossypium hirsutum
aatccgtgtttccgatttacattcaatactataaagctttgagcttttattttttcttctcatcacttgtttatttttcagtcttctcttctccctctcatggctttagaaacccctaaccacactcagacggtagcaggatgggcggcttatgattcctccggtaaaatcgccccttacatcttcaaacgaagggaaaatggcgtcaacgatgtgaccattcaagtgatgtattgtggggtctgccacactgacctccaccatgttaaggacgactggggtatcaccatgtatcctgttgttcctgggcatgaaataacgggtgtgataaccaaggttggaagcgacgtgaagaatttcaaactaggggacagggtgggggttggttgcttggcagcatcctgtttagagtgtgaattctgtaaaaactcgcaggagaactactgcgatcagatccagttcacctacaatggcattttctgggatggtaccattacttatggtggatattccgaaatgctagttgcagatcacaggtacgtggtccacgtgccggataacctgccaatggatgcagcagccccactattgtgtgctgggataacagtttttagccccatgaaagattgccaactgctggagtcaccagggaaaaaagtgggaatagttggcctggggggtctgggtcacgttgctgttaaaatggcaaaggcatttggtcatcaagtaaccgtcatcagcacttctccgtcaaaagaaaatgaggctaaacagcgtttgggcgctgattatttcctagttagcacagatgctaaacaaatgcagagaggtaagaggacgctagatgttattttggacacagtctcagctaaacactcactcggaccgatcttggaactgctcaaagtaaatgggactttggtagttgtgggggcacccgacaggccaattgagcttccttcttttccattaatatttggaaagagagcagtaaagggaagcatgacagggggtatgaaagagacgcaagaaatgatggatgtgtgtgggaagcacaacatcacgtgcgatgtagagcttatcaagccagataaaatcaaccaagctttggaccgccttgccagaaacgatgtcagataccgttttgttatcgacattgccggaacctctaagctttgaagatcgaatcagtgttcccttgcatgttccttggcaatcgattcatctatatctatttgttttactctttactacaaccagttgttttattggtcgtcatcttcaatcttcattaagtggtggtgttgtaacattacataaatcgagtttttcatcacttttttttggttatttcgtgtatttaattagaagaatcatgctatcttctccttgaaacgactttgcgataagcagaaaagggaattctgcttgagcaattttataatttcgagcataattagtattttaataaattaataattaatttcaatgttattgtttagactcaataatacaatcttttgagattcttttg

SEQ ID NO: 146 - DNA, 1356 bp, Solanum lycopersicum
tgtttctacacaaagagtggccttttcacttgttcccacactcactcatctttgtagatctttaattaagaaagaagaatggctcaaacaacacctaatcacacacaaactgtttctggttgggcagctcatgattcttctggcaaaatcacaccttttattttcaagagaagagaaaatggtgagaatgatgttaccattgagatcttgtattgtggaatgtgtcatacggatattcatcatgttaaggatgactggggcattactaagtaccctgttgtgcctgggcatgaaattactgggattataacaaaggtgggaaggaatgtgagtaaattcaagataggagacagagtaggggtaggttgcttggcagcaacatgtttgaagtgtgagtattgcaaggggtctcaagagaactactgtgaccaagtggaattcacttataatggcatcttttgggatggtagcatcacttacggtggctactcaaaaatgcttgttgctgatcataggtacgtggtatgtataccagataacatggcaatggacagagcagccccattattatgtgcaggaataacagtttttactccttttaaagacaataatttggtggatacaaaaggtaaaaaaataggaataataggtcttggtggacttggacatgtagctgtcaaatttggaaaagcatttggacatcatgtcactgtcattagcacctctccatccaaagaacaagaagccaaacacaacttaggtgctgatgattttataataagcactaatcccaaacaaatgatggaaaagaaaagaactcttgactttattttggatacagtatcagccaaacactcacttgggagttacttagagcttttaaaagtgaatggaactttggtgattgttggagcaccagataagccaattgatttgcctgcttttcctatgatttttggaaaaagaacagtgaaaggaagcatgataggaagtatagaagagacacaagaaatgatggacttatgtggaaaacataacatattaagtgatatagagattatcactactgatcaaattaatgaaggacttgaaaggcttgctaacaatgatgttaagtaccgttttgtcattgacattgctggtccatcttctcatctttaatttgaaatttatatatttatttttgtgtgtgtaatttacatttcatttaattccgattccctgaatttgtatttcttaatattatgatgttgttcatttacactttgtttggtggttcatgatgtatcttatttctattgtttagtgttgtattttatcgtattgtattgttttaatgaatacaatgattggata

SEQ ID NO: 147 - DNA, 3544 bp, Sorghum bicolor
agagagctcggctcctcaccagttgtcctcctcttcaccatcctccttccttgcccacctcaaaacaagaatcttgctttttccgacgataccatagctccacccaatccttgcgctccctgccgtcgccatccctcatcctcctagcgcatctcattcagtcattcctcgtcctcaaactgactgatgcggttggtaccaaggttccggcgctcgacggcccccgcgccgtgctcttctagcctctagtgccgcttgaattccgggcaatgggcgccgctcagttggtgattctgttcttggcgcttggcgccgcgatgcgggcggcgtcggcggcgggggcgcggccgagcgaggtgaccgttggcgctctcttcacgtacgactccacaattggtcgcgcggcgcagcttgccatcgagctcgccgtcgatgacgtcaacgcggacggcaaggtcctcccggggacccagctcaatttggtgccccaggacaccaactgcagcggctttattgggaccatcgaagcgttgcggctaatggaaaaaagcgtagttgcggtgattggcccgcaatcctctgggataggccatgtcatctcccatgttgttaatgagctacatgtacctcttctatcatttgcggctacagatccaactctctctgcatcagagtatccgtacttcatcaggacaaccataagtgactacttccaaatgaatgccgttgctagcattgttgattactatcaatggaaaagggtgactgctatattcgttgatgatgattatgggcgaggtggcatggaagccctcggtgatgcgcttgcattaaagagggcaaagatttcatataaagcagctattcctccaaattcaaatacggatgtgatcaatgatgtactatttagagcaaatatgatggaatcaagggtcatggttgtgcatgtcaatcctgacacggggatgagaatattttctgtagctaagaacctccaaatgatggccagtggctatgtatggatagtaactgattggctagctgctgtccttgattcctcagcatatagagatcttaaagatatgggtcatattcagggactaattgttctgcgtcagcacattcctgaatctgaagccaaggataagttcatatctaaatggaatgatgtggctcgtaacagaagtattacttctggcttgaactcatatggtttttatgcttatgactcggtttgggctgttgctcgtgctgtcgataaatttctcagtagtgggcaacagatcaacttctcaacagatcccagattacaaaatttaaatgacagcacgttgcatctatcaactctgaagatatttgatggtggtgagcagatgctgcagcaacttctactctccaaatttacaggtgttacaggtccagtccagtttgattcagaccacaatttggtacgcccagcgtatgatatccttaatattgctggctctggctcccgcttgattggctattggtctaactattctgggctttcggtggctgctcctgaaattttgtatcagatgccacgaaatacatctacaagtgcccagcagctgcatgatgtggtatggcctggtgattccactactaagcctcagggatggatattcccaaacactggccaacctctgagagttggggttccaattaaagcaagctttaaggaattagtgtcaggcagaggagataacatgagtggttattgcgtcgagatattcaacgcagcaattaaactgcttccttacccagttccttaccaatttataactattggggatggcacaaaaaaccctagctatattgacatcattagaatggttgctgccaattcacttgatgcagctgtaggcgactttgctatagtgagaaatggaacgcagcttgcagaatacacacagccttatattgagtcagggcttgtgatagtagcgcctgtgaaacacgtaacttcaagtgcctgggctttccttgaacctttcacattggagatgtggtgtgtcacagttgctctttttattttggtgggtgtagtagtttggcttcttgaacatcgtactaatgaggaatttcgaggatctccaaggcgacaagtcataacaatgttatggtttagcttctcaacaatgttcttcgcacacagagagaacactgtaagcacacttgggcggttcgtgttgataatatggttgttcgttgtgctgatcatcacttcaagttacactgctagcttgacgtcaatcctcactgtccaacagctctcaactggaattacagggattgatagtttggtttcaagttctttacctattggataccagaatggaaaatttaccaaaaggtacctgagtgaaaacttcaatgttcctctctctcgactggtgccactgaatacgatccaggaatatgctgatgcccttaaccgtggaccaaaatacggtggtgttgctgcaattgttgatgagaagccatatatagatatcttcctgtcaaactactgcaaattcagaatagtgggagaggaattcacaaaggaaggatggggctttgcattccagagagactcccccctcgctgcagatttatcaaccgccatccttcaactttcagagagtggccaacttcagagaatccacgacgagtggttctcacggtctagttgctcctcagatgacagcgaagtgggagcaaccaggcttggcctcggaagcttttggggcctcttccttgtgtgtgccctgatatgcctcttcgctctgctggtattcttcatacgggtctgctggcagtacaaccagtactccagttctgaatcttctggcgagcccagcgcagccacccctggtcctgtcataagacagcggcgactatcacgccttggcagcttcaaagagctgatccagtttgtcgacaagaaggaggaggagattaagaaaacgatgaaacgaagatcaagcgataaagatagccaagctgcaggattctcatacgctcagtcagtggcttcagcttaggccttgttcagttcgcaaaaattttaaagattctccgtcacatcgaatctttggtcgcatgtatggagcactaaataaagacaaaaataaaaactaattacacagtttatctgaaatttgtgagatgaatcttttgagcctagttacaccgtgattggacaatctttatcaaataaaaacgaaagtgctgcagtagcaaaaaaaaaccaaaattttgtaaactaaacaaggccttaggacaatctttcagatatctgtccttcagatggataaatatggcaaagcaggggaagtacattaccaaccatattgaattaggctattgtctccaaaagcaaaacaaatcgatgtaaatagtaaatagtgtatttgatctaggagtccattccttatgcccctgatatatgctgtttgtatttgacaaaactgttttcagcaattgaccattgctccaggctgttcaaagtggtttatttcaattgcttttctggcag

SEQ ID NO: 148 - DNA, 2088 bp, Solanum lycopersicum
acttctaatttgattgcaattaattgtctagaaatcatttattgcacaaaattacattttactatttcactatcacatttgtacgtaccttgttatatacttatagatatctgagaaacaagttttgagtgatttttcattaagataagacgacgacaatcgaaagatggccggtggtggtggtggtggaagatcgttggagcaaacgccaacttgggcggttgccgttgtttgttttgtgttagttgcaatatctattgtcattgaacatattatccaccttattggaaagtggttgaagtctaaaaataaaagtgccttgtatgaagcacttgaaaagatcaaagcagagcttatgctgctgggattcatatcattgttgttaacagtaggacaaagtccaatttcgaacatatgtgtatcagaaaaattaggaaattcatggcatccatgtagtaaaaaagaagaagatagtagtataatttcagaagattcgttgtcggagcaacaccgccggagacttcttatggatgctgccggcggtggcgtacgacgaatattggctggtggtggtggagatgacaaattaccatttgtgtctgctgatggaattcatcaattacacattttcatctttgtgctggctgtatttcatgtcctctattgtgttacaactttggctttggggagagctaagatgagaagttggaagtcatgggaaaatgaaactaaaacagctgaatacgaattctctcacgatcctgaaagatttcgatttacaagagaaacatcatttggaagaagacacttgagcttttggaccaaaaatcctgtcctactttggatcgtttgtttctttaggcaatttgtaagatctgtcccaaaagttgattacttaacacttaggcatggatttattacggcacatttagcaccacagagccaccaaaaatttgatttccgaaagtacattaaacgatcacttgaagaagattttaaagtggttgtaggaatcagtcccccaatatggttcctcgccgtgctcttcttactctttaatactcatggctggtattcctatctttggctaccattcatccccttgattgtgatattattagtagggacaaagctacaagtgataataacaaaaatggggctaaggattcatgaaagaggagaagtagtaaaaggggtacctgtggttcagccaggagatcaccttttttggttcaaccgtcctcgtctcattctttatcttattaactttgttctctttcagaatgcttttcagttggccttctttgcttggacttggtatgaatttgggttgaaatcttgttaccatgaccatactgaggatattgtcatcagaattactatgggggtcctcattcagattctgtgcagttatgtcactcttcctctttatgcccttgtgacacagatgggttcaaacatgaaatcaactatcttcaatgaaagagtagcaacagcattgaagaattggcaccacacagcaaagaaacatgtaaaggatcaaagcaaacattctaatccagtgacaccaatgtcaagtagaccagggacaccttctcatcatggcatgtcacccgtgcatttattgcgcggacattataggagtgatatgggcagtctacaaaactcacctcgtagatcaaactacgattttgatcattgggacaacgagggctcaccttcaccctcccggttttaccaggaggctgttgatggctcattgcaccatattcaacttggtcaattggaccatgaactgcaacaagttattgagcctaattcgtcacaagtggttcctctatcacaagagggtcgcgaccaacatgagattactattgctggatcaagagatttttcgtttgagaaaagaacaaccagtatatagatattattatttaattaacaaggagcacattaatactatattctatattatttttattaatttatatacttgatttcggagaaataacgattgtaaagttgcagcaatggatgcacggtgtaaatttgtaattaaaatatggagaattcgatctgaaaattcta

SEQ ID NO: 149 - DNA, 882 bp, Solanum lycopersicum
atataaatttatatatttatatatatatatatatattccttataatcttaaacaaacaacaaacttactttcaaatatatttttttcaagtccactttcaaattctctaagttttcccaatcaagttcaagatggtaaagaatgaagtgatggtggatgaaattccttttccttcacaattcatggtgaataataagcctttacctttgatgggccatggaataacagatatagagatacattttctccaaattaaattcacagcaattggagtttacttggatccagaaattgtgactcatttgcaacaatggaagggcaaaacaggggcagaactaactgaaaatgatgaattctttgaggctattgtgaatgctccagttgacaagtttttgagagtagtagtgattaaagagatcaaaggttcacagtatggtgtgcagctagagagtgctatacgcgatcgcttagcagaagtcgataagtatgaagaagaagaggaagaagcactcgaaaaaatcgttgaatttttccagtctaagtatttcaagaaagattcagtaataacatattattttccaggtgcttctgggagtgcaaagatatcgttcgcgatagaaggtaaggaagacttggaaattgaagtggaaaatgcaaatgttgtagagatgatgaagaaatggtacttaggtggaacaaggggagtgtcacctacaactatttcttctttggctaacaacatttgtgttgaattgtctaaataaaagacattatgtgttgtgtttgttgttttgatttttgttgttttggtcatgttggcttattgtatttggcctatggagacctttaataaattagaagttcattttagtttgttttgca

SEQ ID NO: 150 - DNA, 892 bp, Hordeum vulgare
cttctttgtttctctttcttctcttgagtcttgacctctgcaagaaaacaatgggatcggagcaggagaagaagccggccgccacagtggaagtggagggcattccgttcccgcgggaaatcgccggcgccaagacgctctcgctcgtcggccatggcgtcacggacattgagatccatttccttcagatcaagttcaacgccgtcggggtctacctcgacgtcgacggcgccatggagcacctgcaaggctggaaggggaagagccagctgatggaggacgaggctttcttcgacgcacttgtctcggctccggtggagaaggtgctgagggtggtggtgatcaaggagatcaaggggtcgcagtacggcgtgcagctcgagagctccgtcagggaccgccttgtggcggcggacaaatacgacgacgaggaggaggaggcgctcgagaaggtctccgacttcttccagtccaagtacttcaggcccggctccatcgtcaccttccacttcccggccacggccgccgccgcgccagagatatcgttcgtcacagaaggcaaggaggaggccaaggtggcggtggagaacgcggccgtggcggagatgatccagaggtggtacctcggcggcgaggcggcggtgtcgcagaccaccgtcaggagcatcgctgatggtttcgcggcaatgctctcctcagcatgattctttttacaagtgatgcgtgcttgcttttgcaataaatccataagtcacgatgaaatatttcaaaaagacacttgctcaaatcatttttaaatgtccaaacgggatgattcgtacttctttacactttttttgccgtataatgtggcacatcaaatgtctgcggacatgcacgatttttataaaaa

SEQ ID NO: 151 - DNA, 4655 bp, Solanum lycopersicum
tatcattgattttttcaacatcaacttttacatcaaattactatattagtaaccatgaagttgattctctagtctattatatactctttacttgtatacacaaatcacaccccttctacacaaaatttcaagaatcaaagtcccttattcttaaaacttgtttggttaagcttgttcaatataaagttgttatgttaaaaaatggagggtggtgaaaatcttgtgagggtgagtagtgcacgtttgagtggttcaaatgtatggagaaatagtgctatggatgtgttttcaaggtcttcttcaagagaagattacgatgatgaagaggcgttgagatgggctgctcttgaaaaacttccaacttatagtcgtataaggagaggccttctcttagaagaagaaggacagtctagagaagtcgatataacaaagcttgatttgatcgaaaggaggaatcttttagataggctagtcaagattgctgatgaagataatgagaagttgttgatgaagctcaaacagcgcattgatagagttggtctggatcttcctacaattgaagtccggtttgagcatttgaatgtagacgcagaagctcgtgtaggtagtagagctttaccaacaatattcaactttacagttaacatcttagaggatttcttgaattatattcatatccttccaagtagaaagaaaccactgccaatccttcatggggtcagtggaatcatcaaaccaggcagaatgacactgcttttaggaccaccaagttcgggaaaaacaacgttgctgttaggtttggctgggaaacttgataaagatctcaaagtttcaggtagagttacatataatggtcatgggatggatgagtttgtaccacaaagaacatctgcttatataagccaaaatgatcttcatattggagaaatgacagtcagggaaacactggcattttctgctagatgtcaaggagttggagacaaatatgaaattttagcagagttgtctaggagagaaaaggaagcaaatattaagccagatcctgatgttgatatcttcatgaagtcagcgtggaatgaaggacaagaggctaatgttataacagattatactctcaagatattgggacttgaaatttgtgctgatacacttgttggagacgaaatgattcgaggaatttctggggggcagagaaagaggctaacaacaggggagatgatggttggaccagcaagagcactttttatggatgagatatcgactggtttagacagttcaacgacttatcagattgtcaattcaattaggcagtcaatccacattcttcaaggaactgctgtaatatcacttctgcagcctgcaccagaaacttatgacttgtttgatgatattattcttctatcagatgggaaaattgtgtaccaaggtccccgggaaaatgtactcgagttcttcgagtacatgggcttcaaatgccccgagaggaaaggagttgctgatttcttacaagaagtgacatcaagaaaggatcaagagcaatactggtcacgtcgtgatgaaccttataggtttatcacatcttgcgaattttctgatgtatttcaatcgtttcatgttggacggaagcttggtgaagagcttgctgttccctttgacaaatccaagagtcaccctgctgctctaaccaccaagaggtatggtattagcaagaaagaactcttgaaagcctgcgcagctagagaataccttcttatgaagaggaattcgtttgtctacatattcaagatggtacagctaacaatgatggcgtctatagcaatgacactcttcctacgaacggagatgcacagagatacaacaatagatggtgcagtatacttaggtgcactgttctacgcagttatcacggttatgttcaatggtttctcagagcttgccctcagtattatgaagcttccttccttttacaaacaacgcgatcttctcttctttcctgcttgggcatatgctctgcctacttggatcctcaagattccgatcacacttgtagaaattgctatttgggtgtgtatgacttattatgttattggattcgaggcagacgttgggaggttcttcaaacagctatttctgctcatatgtcttaaccagatggcctcagggctgtttcgattcttagctgctcttggaaggaatatcattgttgcaaatacatttggatcatgtgcactgctcgtagttcttgtaatgggtggattcattctgtcaagagatgatgtgaaacaatggttgatatggggttactggacttcccctatgatgtatgcgcagaatgctatagctgtgaacgaatttctagggaagagttggtcacatgttcctccgaactccacgggcacagatacattaggagtatcattcttgaaatcgcgtggaatctttccagaagcaagatggtattggattggagcaggagctcttattggatatgttctgctcttcaatttcttgttcacagtggccttagcttatctcaaccgtaagaatccgcctactattatgcaatttaatctcatttccatctataggagatcctaacatatcaacaagaaagaggaaatgatgttgcgataagtgcatcttccaggtctctgtcctcaagagtaggcaacataactgagggtgatttaagcaagagaaggggaatgattcttccttttgaacccctttcaattacttttgatgatatcagatatgcagtagatatgccacaggaaatgaaagctcaaggttttatcgaggaccgacttgaactcttgaaaggggtaagtggtgcttttagaccaggagttttgacagctctaatgggtgttagtggagctggtaagaccacacttatggatgtcttagctggtaggaaaaccggtggctacattaatggaactatcagtatatcaggatacccaaagcagcaagaaacgtttgctcggatatcaggatactgtgagcaaactgacattcattcacctcatgttacagtatacgaatcattgcagtattctgcttggcttcgactgcctcgtgaagttgacactgaaacccgaaagaatttcattgaggaggtcatggaacttgtagagctaatccctctaagagaagcacttgttggattgcctggagtaaatggtctttcaactgaacaacgaaaacgacttacagttgcagttgaactagttgccaatccttctataatattcatggatgagccaacctctggattagatgcaagagcagctgcaatagtgatgagaacagtcagaaacactgtagatacaggtcgaacagtagtatgtaccatccatcagcctagcattgacatatttgatgcttttgatgagctcctactcctgaaacgaggaggcgaagaaatatttgtcggcccattaggacgccattcttctcaccttattaagtattttgagggaatcgatggagttctgaaaatcagagatggttacaatccagcaacatggatgttggaggtaacttcactagcacaagaagcagttcttggaattgactttacagaattgtacaagaactcagaattgtataggagaaacaaagctttaatccaggaactaagtgtggcagccccaggttcaaaagacctatactttgaaactgagtattctcagtctttcttcacccaatgcatggcttgcttatggaaacaacacttgtcatactggcgaaatcctccttacacagcagtcaggctcatgttcacattctttgtttctctcatgcttggaacgatattctggggtcttggttccaaaaggggaaggcaacaagatattttgaatgcaattggttcaatgtattctgcgatcttatttcttggcataataaacgctacttctgtacagccagtcgttgccattgagaggacggtcttctatagggaaagagcagccggaatgtattcagctctgccttatgcatttggacaggttatgattgaactcccacaccttttcctccagacgatcatctatggtgttatagtctatgcgatgatcggatttgaatggacagttgccaagttcttttggtatctcttcttcatgtacttcaccttgttgtacttcacattatacgggatgatgacagtagctgttactcctaatcacaccattgcatccatcgtttcatctgcattttacacaatatggaaccttttctgtggattcgtcgttccaaaaacaaggatgccagtgtggtggagatggtactattacgtttgccccctttcgtggacactatacggactaattgcatcacaatttggagatgtacaagacaaattggatacaaaggaaacagtggaacaattcttagagaattttttcgattacaaacacgattttgtgggatacgttgcagtcattcttgttggaatatcagttgcttttctcttcatttttgcttactcaatcaaagcattcaacttccagaaaagatagtttaaaaatgtgtattagggcaataataatgtaacgtctcctcaaccttttttctttttttttcatagaaagaagtaatgtatctaagaacatcatattgatgatatttactggatgattaccaaa

SEQ ID NO: 152 - DNA, 717 bp, Gossypium hirsutum
gagagagagagagagaggggaaaggaaatggaaaacgtgattcctcagcaatgggcttctccttgtggaaatcaatgcactcacaaatacgctgctctcatgcaaattccttggagagtgttctgcaaaaaagggtgtaatgcggatggagacacttgggaagagtgtttagcagagtgtgatgagatatgctataaggatcctgtattaaaggatcagcaatggagtgcttacatcgatcgctcccctggagctgtcaattactctcaggactgcttcaatgcttgtgtaactggctgtggttataagtttgaaatttgtaaagagaaagttgatcaagtcagaccaagaccattaccatccgagcctcttccagaggtgaaaccaccaacctcgcctgcagccactaaacctgatgaacccgctgaagatgtaccaagtacttcagcgtagcaagagggccgtttgtgaagaaacatatatatttttcttctgtaatttgcctcttgtcagttgccaccttatataacccttcaacatctctgcaaattgatatgggaaggcgatataggcatccaattttgttaatcatggcataatggaaaagctttttttgatattttgatgattttgtaattttgatattctgaatgaaacattggaatctttggtctgctcctttacgagccaagattgaagcttggaatgcaagaattc

SEQ ID NO: 153 - DNA, 1023 bp, Zea mays
accagcaagcagcagtctaccaccatcccaccaatctcccaaattaagccatccgtcaccagccagccaaccagcactcactcactagctacgtccaactcgtacacaacccctctttctctctatcttctctccatccatccatcctctcgctcgcccttcgacagctagctaagcagtacgacgtagtatactagcatttagcagttcatcaacgcgctcaacctagcacgacgtacggcgatgaggcgccgcggcagcaactcctcgccgcttgcggctgctgccctgcccctcctactcctcctcgtcgccggctgcttccactgcatggcagcggcggctcgccacctgccttctcctggcgccccagtccaagcgctggatcaccaagccgagaacggtgtcaaggctgcatcagctggtgcagacggcgccggcggccttgtgctccaggaaggtggcacgggcaacaacggcgacgacctctcctccaaaaccctcctcgagacgacgacgacgacgatgggagcggaggcgtgcgaggaggggaacgacaaggacgagtgcgtgcagaggcggctgctcgtcgacgcgcacctcgactacatctacacgcagcacaagggcaagccgtgaccgtcagcgacgaggacggtgcatgccgcggctgcagaaaatgaggagcggaagaggagtgaaaaaatgatggaccatcctcaaaccaaatatcctataaattcacgcacaaggggaaggggatagtaatctcatctgctgctgctagctactagtacatgcatcgatcgaccttctgcgtgtgctgtatatttctgccacgctgcctatatattagcatgcatcatcatctaggtctaggactgtctgatggtttcccgtatttgtaaacactgatgaacagtacctctctctctctctgcttcctgtaaccaccaagcttacttggtccaagagaacgtaacaacgcacatttgtttacttggcccgagaaaacaaacgctt

SEQ ID NO: 154 - DNA, 2206 bp, Zea mays
gcttccctgtctcgccgccacctcctctgcgctccccgttccccaggtcgcgcgcacccgctcccgcaccggagaacccaccgcacgccggcctcgttccgagatggcggcggcgctgcgcttcccgggggtcgcgagggagtctctgtctctggacgcgcccgtcgccgcctccaagctcgggagggagcggcgcccggcccccgcgagcgcgaacccggggccgcaatgctggaggcggaggaggggcctggcggtgcgctgccagacggggtccaccgcaccgcccgtccttaggacggaggaggcccccgcggctgcggcgggggcaaggaatgcccaggcggggttcaccgtcgtcatgaagttcggcggctcgtcgctcgcgtcagccgagcggatgcgggaggtggccggcctcatccttagcttccccgacgagacgcccgtcgtcgtcctctccgccatggggaagaccaccaataacctcctcctggccggcgagaaggcggtgagctgcggcgcccccaaggcgtccgaaatccctgagctcgctgtcatcaaggacctgcatcttaggacggttgatgagctcggtttagataggtcgattgtttcaggtttattggatgaattggagcaacttcttaaaggagttgctatgatgaaagagctgacccttaggacaagagattaccttgtttcctttggtgaatgtatgtcgacaagaatatttgctgcatatttgaacaaacttgggaaaaaagcacgccagtatgatgcatttgatattggctttataaccaccgatgatttcacaaatgcggatattcttgaagccacttaccctgctgttgcgaagaggctacatgaagactggatggatgaccctgctattcctatagtcactggttttcttgggaagggatgtaaatcatgtgctgtcaccactttaggcaggggtggtagtgacttgacagctacaaccattggcaaagccttgggattaagagaaatccaggtttggaaggatgtagatggtgtgttgacatgtgatcctaatatatatgcaaatgctatacccgtgccctacttgacttttgatgaggctgctgagcttgcctactttggtgcacaggttttgcatccccagtcaatgcgaccggctagggatggtgatattccagtgagagtaaagaactcatacaatcgtcatgcacctggtactgtcatcactaaatccagagatatgagcaagagcatattgactagcattgtgttgaaatctaatgttaccatgctggatatagtgagcacaaggatgcttggccaatacgggtttttagcaaaggtattctcaatatttgaagatttgggcatctctgttgactgtgtggctactagtgaagtcagcatctcgttgactctagatccatcaaaactatggagtcgtgaattgatccagcaggaacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaaggtgaacatttccttggtagtcaatgacagtgaggcaaaacagtgcgtacaagccctccattcagcgttctttgagaatggcttcttgtcggaggtagagggagctgacgttccccagaacggagcctctctgaactcaaatggcgctgtctatggaaactagtcgactctgcaactgatttcttcaaaatttgtgtaccattggtaggttgaatggtggtgattcatagctatttatttagggcatcagtcatgttggtgcaaattttcttgatgttttaagagcttattaccagaacagtctgcatggtataccttgcgattgggtgctaccaagtagtagccaatgtcttggggatctgccacatgtttaaggcattccaaggcttatatgtatctgagttgtattgtatgtgagaactattgagttgtattgtggtgattaagtttggtagttttagactgaactcggtggatggtccattatcatgcaagcgaatgtggtcttctgtttctgttaccattatctgtttgctcatcatatgtacgttcatagata

SEQ ID NO: 155 - DNA, 2369 bp, Solanum lycopersicum
aaaagaaaaaacaacaaaaacctaagccgccaaacctgtagccacgtccctgccgagcttctcctctctgagctgctttaagaatttgtgatttaacgacccttttctcttcccccaattgggtttacgacaccattaacacaatttcaagaaatagtgtaaatttcccacgaaagtttggtttcagacggcagttttgaacctgaaaaatctgtttttgaatcaggattgcttgattattggagtatattttcagcagggggagctaattagctaagttaattggctctctctgctttttgcaaaacccgagtcacttcattcgtcgaaagaactttattgtcatttatatccttttttggaggttccttagctgatttattatggcaacattgtcacatttttctggggttaaaactccctgcccttctatattcaaaagaagcgtgcacttcccacaacttgattttgtggctactgtcccctttgtttctgcgccaagtaaatctgtgaaggtttcttgttgtgaaagagtgcagagattggtatgtaaagcacaagcaactgatgttaatcgtaaagagaccaagaatgaatcttttggtgaggctcctgatgaattgacatgtgttatgaagtttggtggttcatcagtagcctcagccgaaagaatgagagaagtagctgatcttattcttagctttccagaagagagacctgttattgttctctcagcaatgggaaagacaacaaacaaccttttgctggctggtgaaaaggctcagagttgtggtgtttccaatgtttctgatctgcaagagttggcttttataaaggagctccatcttaggacaatagacgaacttggagtagagagttctaccatttcaaagcatctactcgaactggaacaacttttgaatggaattgctttgatgaaagagttgactccacgagcaaaggactacttggtgtcctttggagagtgtatgtccacgagaatattttccgcatatctgaataaacttggtgtcaaagcccgccaatatgatgcatttgagatgggtattataactactgatgattttactaatgcggatatattggaagcaacttatcctgctgttgcaaagagattaactggtgattggatgagtaatcctgcaatccctattgtcactgggtttcttgggaagggttggagaacttgtgctgtgactacactaggtaggggtggtagtgacttgactgctacaacaatcggtaaagcattgggattacgtgaaattcaggtctggaaggatgttgacggtgttttgacatgtgatcccaacatatatccacgtgctgagactgtgccatatctaacttttgatgaggcagctgaacttgcatactttggtgcacaggtccttcatccacagtccatgaggcctgctagagagggtgatattcctgttagggttaaaaactcgtataatcctaaagctcctggtactctcatcgttaaaacaagagatatgagtaaggcggtacttacaagtattgttcttaaacgaaatgtaaccatgttggatattgcgagtacccgtatgcttggtcaattcggcttccttgcaaaggttttctccatctttgaagacttagggatttctgttgatgtcgttgcgacaagtgaagttagtatttccttaacattggacccatcaaaactttggagcagagaactaattcaacaggcaagcgagctagataacgttgtagaagaacttgagaaaattgcagttgtgaagctacttcaaaacagatcaatcatctctcttattggcaacgtccagaggtcctcgttgattttggaaaaggctttccatgttatgcgtaccaatggtgtcaacgttcagatgatctctcaaggtgcatccaaggttaatatctcgttgatagtaaatgatagtgaagcggaacaatgtgttagggctctccaccattccttcttcgagagtgatctttctgaactagtctgggaaagtcaatctggaaatggctatgctactactactactcccttgcccacgttgtccaattaattttccttcgtatgattgttctttccaataatattttctaggaaatgaatgaaattttgctaggtactttttggagtgtgggtgcagtttcgtcgttgtaacatttatcacttgtagcaagaagacacattttatgatctatctaagttaggctttttattatatctctagtggaacaaatttcctttaccaatgccagggaacttctgcagtttgcttatccaactttagttattatattctcaaaacataacagatgaataaattgagttgatactctta

SEQ ID NO: 156 - DNA, 1440 bp, Solanum lycopersicum
gtattctcatttctccagctattactatatgtccaagtccaaccgccctctctccttgatgtgatttttcttgggaattgtatcaaacaacaagatctgcaagtagcttaaatttgcttctaaatttgcttctaacagatccatggctgaaaatcaaaaaacagttttcaagtcagtacaagaactagcaaatgaaaatcaagttccagaaaagtatattcatacacaagggtcaatcaatagctcttgtcccatgctgaatgtgccagtagttgaccttagacttctcacatccactgccagaaaacaagagctcaacaaacttcaatcaggcctcaagttttgtggctgcatccaggtcataaatcacggactagcagattcatttcttgacaaagtgcatgaaattagcaaacagttctttgctcttccagctgaagagaagcttaaatatgccagaacagttgatgacatttatggatacggaaacgattcagttctttcagataagcaaaagcttgattggactgacagattgtatctaaatgtgtttcctgaagctataagaaacctcaaattgtggccccaaaaacctgaatgtttcagggaagtttttgaagaatatattaataatatgaagttgttgagtgagtccctccttaaggccatggcagtgtcgttgaacttggaggagaactgctttctggatcagtgtggagaaggcagagagatgattgcaagattcaacttctatcctccgtgtccaacacctgaggttgtacttggaatcaaaccacatgctgatgcatcggccattaccatccttttgcaagacaaagaagttgaggggcttcaggttctcaaagatgatcaatggtttagagtacctattgtaccatatggtctcctcgttaatgttggagatcaagtagagataatgagcaatggtatctttaagagccccgtgcacagggtggtaacgaatgcagaccaagaaagaaacacccttgctgttttcattatgccagatgtaactgatggaattggaccagtggagaagcttatcaatgaggaaatgccaagagcatacaaagacgttaagaattatgttgaactcttcttccaaagctatcagcatgggaaaagaccaattgaaacagcaatgatatgccaagaacaagattagttgtcaacaaaaagctccctttcttgttattccatcaaacccgctacagtatgcttgtctctatttttatttttactagtcgttgttgcctgtgccgtacacgatctcaacactaagatctcaacatgcaagatcttgaataggagaaagacaacagtttgatctagaacctatagtaattcatttacaaaatatacatatttacaatatttaccaagcaggatgaatgaaagttgttttgcgactgaataaaa

SEQ ID NO: 157 - DNA, 1323 bp, Vitis vinifera
agagatttgcagtgaaaacgaagaacagatgaagaagaacgcataatgatggagtgggaagcccaagaactccagcagcagccgcagcatcacaatcagaatcagaatggggttgttgttggaggagggagtggagggttgtacgtgaaggtgatgactgatgagcaaatggagctgctgaggcgccagatctcagtctacgccaccatttgtgagcagcttgttgagatgcacaaggccattactacacaacaggacctcgctgggatgaggctggggaatatatactgtgatccattgatggcatccgctggtcacaagatcagtagcaggcagcggtggactcctacgcctgtgcagcttcaaattcttgagcgaatctttgatcaaggcaatgggactccaagcaagcagaagattaaagagataaccactgaactgacacaacatggccaaatttctgaaaccaacgtctacaattggttccagaacaggagggctcggtcaaagagaaagcagtcagttccattaccgaataatgctgattcagaagtagagacagatgtcgagtctccaaaagagaagaagacaaaacctgataatatccagtcccatgagaactcagctctggggactgaaaatatatacttccagagtccggaaatgggaagtgaaatgcattgcttggatacactgcctaacaaaggggagcccatgtttccatctgatcgcagtttaagatcttctggcagcttggggcattcatctttgtacgaaaccggggttccaaatccaagaatggaccagttgatcggtaaagtggaagttcctggtagctttagtccttatcggcagggaggggaagggtttgacatggttggatgatctgcccacccttgatgtttgttcttgtgctcacgtacaagcttatcaaacataaggtaatgggttatatttacagttaaagaagacgtttagttaacgatatatttatatatatggaccaacgacatagcagcatttacaagtatacgacaagaagttagaatttggcagatttcttaggtttaagagtcaggtactggtagcatatatactatataatccttacatttctgattccgatgaactggtttctttgaaattgaagaggttttgaaggtgagtgaaatatagaatccatttgatatggtagtaaagcttgcttgtggcctttttttttaatttttttttggtggggaaatatgttgctggtgttgagtttcaggtttttgtgtttgactgaactgatgtgatgagaaatcaaaccttgttctgccttgt

SEQ ID NO: 158 - DNA, 1465 bp, Vitis vinifera
gcgaaacgtcattttatatacagagatacaacaaattctagagagaaaggtgggattctagagagagaaaggcagggagcgatgtgggaatcgatctgcctaacgttagctgccaccgctggcaacaatatcggcaaagtccttcagaaaaagggcaccgtgattcttccaccgctctccttcaagctcaaggtgattagagcttatgctttcaataaaacttggattgtaggttttttgatggatataattggagctctattgatgttaaaagctttgtctcaagcccctgtatctgtaatccaacctgtttctggctctggtcttgctattctttctatcttttcccatttttatctaaaggagatcatgaatcctattgactggatggggattgctatggcagggattggcaccataggagttggaactggaggggaggagcaaaaggcttattcgatatcaattttccacttgccttggctagcattcagtgttgccatcttgtttgtacttcttaatggatggcttcgtatctacaggcgtcaacgaaaagtacaggagatgatgcaatctgaagttgttgaggaaatcatatacggcttggaatctggcattttgtttgggatggcttccgtcatatcaaagatgggatttgtattcttggagcaaggcttttccaagattctggttcccatatgcatttcgatcagcatatgctgtagtgccacaggatttatttaccagacgagaggcttgaaggatgggagggcaattgtagtgtccacatgtgctgctgtggcatcaatcttgactggtgtacttgctgggatgcttgctctgggcgaacaacttccttcagctccagatgctcgtctttcgcttttatttggatggctacttatcattataggagtgatcctactagtaagttcgacatggctagtaagacaccttccacgaccattacgacattatgttcaaagtggtgttgagaggaattttggcgtcaagcattctggattgcgttctggaacacgtgttagggattcaagtccaagtgcagttatccaggcaagcacattgcatcatttgataacgtctcctgctaaagcgaaggcttgaactgaaactattgggaagagtgttgcatttgcttagacattgaggatgtcattgtcctgattgcctgtatatcgtgacggctagctggtcttgttgatgacggtggtgtgtacagtagtgcaccttcttacaggttgatagaagggcatgaagtttttgagatcattccttcaatgatacattttttacaccctggattgcagtatctttatgttccaagtgtgttattggcactttcattccattctataatttttcccacttaaatttgttatggaacctttcatgaaagtttttgcatgttatacctagacccagttgatttgtttcacttaatgcc

SEQ ID NO: 159 - DNA, 935 bp, Sorghum bicolor
gagcaccctgcaagcgtcatgggcagcgagtgcaaggaccaccttcagcttcacgccgccggctacggcgtcggcgtcgccagcccgcaggaggaggaggaggaggagcaggcgggcgccatcgcaccgttcgtggcgaagacgttccacatggtgagcgacccggccacggacgccgtcgtgcgctggggcggcgccagcaacaccttcctcgtcctcgacccggccaccttctccgactacctgctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggccggcggctgccgggagcagctgtgcgaggagggggaggaggtgcgcgggaccatccgggccgtgcagcgcctgcgggatcagcagcgcgggatggaggaggagctgcaggccatggaccgccgcctgcgcgccgccgagagccgcccgggccagatgatggcgttcctcgccaagctcgcggacgaaccgggcgtcgtgctgcgcgctatgctcgccaagaaggaggagctggccctggccggtaaggggtcgacgacgccggcgcccggcaaaaggcggcggatcggggccgaggccggcgtgggcgacgtcgcggacatggcgcagagcaggggcgccgtgccgttcccgttctctgttctcggccaagtgttctactagggtagatagggacaggtccgtgtagtggtgtatatatgacttgtagcatagcttccgtttgatcagctactgcctactatagtgctactatgtaaacggtgaatagtttgtttgcagaaaatttaagtgtgtcg

SEQ ID NO: 160 - DNA, 2025 bp, Hordeum vulgare
tggctggcagtccttccttcctccccctgtctgtctatggaaaggacgcagggcttcttcgcggcgctcaaacaggaggtggcgcgcgggctgtcgccggcgagggcgcgccggaggtccgcagaggcggccgacctcgacgccgcgctcaggttctccggcccgggggccggcggcgagatgctagcgccgctcatggaggggcccgatccggagtccggcgacggcgacgcccgcggcgccggcggcgccaggagggagggctggggccgctgggtgcgcggccagctcgcgcggacgccgtcctcggtcgccgccgccgcggccggcgccggcgccgcccgcaacgacctccgcctgctcctcggcgtcatgggcgcgccgctcgcgcccgtgcatgtctgcgccgccgagccgctcccccacctcagcattaaggacacccccatcgagacctcgtcggcgcagtacattctgcagcagtacctggcggcctctggtgggcacaagctcctcgcctccgtgcgaaactcctacgccatgggcaaggtgcgcatggtggccactgagtttgagaacgcgggccgcctggtcaagaatcgtaatgcggctcgctgcgccgagccaggccgcttcgtgctctggcagatggctcctgagaagtggtacatcgagttggctgtcggtgggagcaaggtgcatgctggctgcaatggcaagcttgtgtggcgccataccccgtggctcggctcccatgccgccaaaggccctgttcgcccccttcgccgtgcccttcagggcttggatccactgactgcagcaagcatgtttgccggtgcacggtgcattggggagaggaaggtgaacggggaggattgcttcatcctgaagctgtgcactgaccctgagaccctcaaggcacggacagagggcctcgccgagatcatcaggcatgtcatgttcgggtacttcagccagaggaccggccttcttgtccacatcgaggactcgcatctcacgcggattcagtcaacaaccggtggggatgcggtctactgggagaccaccatcaactcattcatcgaggactaccggccggtggatggcatcatgattgcgcactctgggcgctcggcggtgaccctgttccgtttcggcgaggtggccatgagccacaccaagactcggatggaggaggcatggagcatcgaggaggtggcgttcaatgtccctggtctgtccatggattgtttcatcccacccaccgacatcaagtctggatctgttagtgaaaccgtggagctccctcatggcgagaagaacaagtttggtcctccccatggccatcgcgccaaagttgccgcgctggagaagacggatggcgacgagctagcatggaggggaactcgtacctgaaaaccgcaattcgttttcagcccaattcatacttgcttcttttcattgcaactgactgatgatgagtagtgtaggagagaaacaggtcgagggaggatttcgcttttggaaattcgaaatgacctctgtgtacaggaaggaagcagcatgaggcattcacaaggtcctgacctgaatatccttgagggaggcctcctgtgatgaagaatggtttctaatctcttcaagtgggagcccgtagtaggtaaccttgtttgctatttcaggcttctttgtcagtatcatgtggtgcgttcgttccccgttccagctacctgagaaaggccatcttggtggcgctgtttgtttacctttagaaacaaacactaattggtcactggcatcaatcaagggaagaaggaccgattccaactggatgttcagcttggtatacgcttggtgaagccaaccctgtcagacaagtgtaacctctgtaactgccgttgattttcctgaaccttccttggcatctctctcgtttttcctgagatgaaggttgttgttgtagtactactgctcgttaacagaagctttgcttgtttccttgtaatccaaaacatctaatgagtg

SEQ ID NO: 161 - DNA, 2415 bp, Hordeum vulgare
ggccccccctccacagcccccaaccctaccgccacgggcaaccctccccccgccgccgtcgccaacaacctcctccaccgcgaatcgacctccgtctccgtcctcctccgccgcgccccacttatccgcccgccatccccgacggccggagcacgcaggctgcgccgcttccctgcttctcccaccatcgctccttgtcccagggcagaagctcaaagatgggaaggggcgacggggagaaggaagcgaagcgccgacgacgcggccgcagcagcaagagatcgcgccacgccacgccctcctcggactccgattcttccccttcctcggcctcctcctctccgagccgcagccctgggccccggagtcgcagcggcagcaagcccgagaagtcgtcctcgtctcgtcgccgccgccatcaccgcaagagcagcggccgctcacgcagttcccgtgacgacgataggcgtcgtcaccggcggaggcgccgggatgagcgtgcccgtcacggcagcgatgccagcgacctgtcggggtcgggctcagatgattcaggttggatggaggaggcgcaggaaatcgtccgtggcattctcagtgagttccctgccatcaccagcgagcttcgtcagcttctccaaatgatagatagtggtgaaggcattgatatttctggtatttctgacaagccattggtaaagcggttgaagaaacttttcagatccctgaaattgaaagaaagtgcaaatggagcttacttgctggcaccaaaaggtgttcctacccttgatgttgttggaccagtattagaaggaagcgccaaacttggaaatgatccaaatgaaactgtggcatcacgaaatagacaacaagtaccgtcgcctaactttgacgtacaaaataaggatgacattcctcctgaagatggaggaaaagttgatcgggaagaggacacccctataaagagggtaattggtcctgcaatgccatcacgtgaattactagctgcagcagctgaaatgacagaggctcttaggtgccgggatgctgaattggaagctgatgatggttttcttataggtcctccaccaccagccatggtcgctgaagctgcatctgcaaatgaagctgagcgatttgaagaggttactcgaatattgggtgctgatgcagatgcactctatgatgttctgggcataaattggaagatgtcgcctgataacatcaagaaaaggtattggaagctatctcttttagtgcatccggacaagtgccctcatccttcagcacaggaggcttttgtgaaattgaacaatgcttttaaagacttacaagaccctcaaaagagaggcgcaatagatgagaagatacaaaagaaagaagagatggaacaattcgaggttgagcttaaagcaatgcgtgaggctgcagaatggagacgattacaaggtatatctcttgagggcgatgaagaacttttggcagttccgaaacagccagaggcaccacctacacgcgatgaatggatgactacattgccacctgaaagaaaagcaggagtaccaatgcattcaactacggcctttagcatgaatggcaaagaaggacgtggtgacacaagtgcatggacagatagtcctcttgatagagcccagaaagcacaacaaaactacttagaagcctacaacaaagcaaaggcaattgcagatggacatgaagagaagggcaaaagctcagatgcttctcttgtggataaatacaactcctccaagcggtcagtatctctcgtgcagaagcatcgagaaagcaaaaaggagaaaaagaagcagaagcaacagcgagggaaggaagaatgggaggagaaccacccatggaagccgtgggatcgtgagaaagatttaactgccgggcggcaaaatgtcgctttggatccagagaacacggcacaagggttgtcgtcccgtttctcatccggagctgtgcagaggaacttcctgtgaggaatttgagtctgactgctcgaggcatgccaagggagagcatggcctaattggcggccagtaccgccggatgtcgaaattgctaggggcacagaaaccatagagaatgtgaggtttgtgacattgctagtttgcatgttgttttctggagagagctgaagttatctgagacatgtaaaaaaagggtttttcttgtgagttgtttcatactgtgtaacacagctccaggtaggtcttcgtacctggctcatttttactgaatgcgaaggccaatgctttgagacttaaaatgatggaataatgctgtatactatcctgctatgctaccagtcattggctgatcatgctagcctaccgatacttattgcaagtacaatgagcttttgcaagtgaaaggtgtcttgcaagtttgctg

SEQ ID NO: 162 - DNA, 1633 bp, Solanum lycopersicum
cacccgacccctaaaatccattaattatattttcaccccttgagttttcctctctccataccaatttcacagttcccaagaaaaaaaatcataatttttacaaaaccctagaaataataaaagaaaaaaagaaaagaagaagagagagagagtctctctctttctttctctctattttttctatcaaccaaacagaccacaaacagtagagagagaaactgagatttatagagagagaaagtgtgaagcttttgcagataagaatcctcatctctgcttccatggctttaacgtttcatattttcccctaatttctcttcggatctcaaaaaaaaaaaaaaaaaattaaaaaaaaaatcaaacaaaaaaactttttttaaaaaatcttcggtcatgcggagaagcagagcagccgctgcggcgagacaagttccggcgacggaagttccggtaccggcaccggtggccggagaacacaacggatctggaggatctaaggagataaggttccgtggagttcgaaagagaccatggggaagatttgcagcagagattagagatccatggaagaaaactagggtttggttgggtacttttgattctgctgaagatgctgctcgtgcttatgatgcagcagctcgtactcttcgtggacctaaagctaaaactaatttccctttaccttcttctcatcatctacctccatatcctcaccatcatcagttcaaccaaagcatcaaccctaacgatccctttgtcgattcccggttatactctcaggaccacccattagtttcacagagacctacttcaagcagcatgagtagtacggtggagtccttcagtggaccacggcagccgccgcggcagcagacggcagcttccgtgccttccagaaagtatccccggtcaccgcctgttgtcccggacgattgccatagcgactgtgactcatcgtcttctgtcgttgaagacggtgaatgtgataacgacaacatcgcttcttcctctttcagaaagccgttgcctttcgatctaaacttaccggcaccgatggatgacttcagcgccgacgcatatgccgatgatcttcactgcacagcactatgtctttgacgaaatgatggtttgtgacccacctgtcatttgataccactgcttacctagtttttctttcttttttgggtgaccggaaaaaaaaacaaaaaaaaagaagaggaaggagccatagaagataagctaaactatgtctgctatgagtcaatctgttgttgtaagagtattcacttgtttaatttaattctcatattttatatcatgggatttcttgataggtggatggatcagtgtatgtcaaatttgttctgattgtgtatcttaaaactatatgtgacttctcagctgaaggtgccctttgttgttcgaagtcgaatttatatatattatcgcggaagattagagggtaacttgtgttcttccattgctgttatcatgtgtgtatgatgttatcttctgtcctttcagtttatgtaactattgagactgtatctgatcatatatcagttgagaagtattcatattttgggctactcgtttagtgtttcttcgaataatacttgcttgtttttctgta

SEQ ID NO: 163 - DNA, 2408 bp, Zea mays
atagacactggatgtctggatggcatagcgctaaatttgagaccggcaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgaggaccgccggcggcggagaagacggggccaggagagaaagcggcacggtggggatggtggcaggtcctccgactcccaatcgtcggaggaggatagggcggaggaggcgcgggagatcgtccgagatatactcatcgaattgccggccatagccgaagagcttcgccagcttctccaaattatagacagtggtgaaagcattgatatttctggaatttctgacaaactattggtgaagcgcttgaagaaacttttccgatctctgagattgaaagaaagtgcaagtggggcttacttgttgccttcaaaaaatgttcctacgcttgatattgttggatcattactattagcaagttccaaacttgcagacaacaaaagtggaaagccagtgtcaccaaatagagaagcactacaacaggctaactttgatgtgcaaaataaagataaagattatattgtttccgaagagccaaaaattgttgatgtggaagaggaacctcctaaaagaaggataattggtcctgcaatgccatctcgtgaattattggctgcagcagctgaaatgacagaggctcttaggtgccgggatgctgaactggaagccaatgatgatttgctcataggccctccaccgcctgccgtagttgctgaagctgcatctgcaaatgaagctgagcgatttgaagaggttactagaatattggcagctgacacaaattcaccttatgaggttttgggggtaaattggaagatgtcaactgataacatgaagaaaaggtattggaagttgtctcttttagtgcacccggacaaatgtccacatccttccgcacaagaggcattcgtgaaattaaataatgccttcaaagacttacaagaccctgataagagaggtgcaatagacgagaagataaaaaagaaagaggagatggaacaatttgaggttgagcttaaagcaatgcgtgaggctgcggaatggagacgaatacaaggtgtatcactcgcaggtgatgatgaacttttagcaggtccaaaagagtcacagagacctacgagagatgaatggatgaccacattgccacctgagagaaaagcaggagtgccaatgcattcaactacatcatttagtatgaatggtaaagaaggacgtggagacacaagtgtctggactgatacccctcttgatagagcacaaaaagcacaacaaagctatctagaagcctacaataagacaaaggcaattgcagaaggcgacgacgtgaagagcaagaacccggatgcttcaatcgtagataaatacaacacctccaaacgatcagtgtcccttgtgcagaagcaccgagagagtaaaaaggagaaaaagaagcaaaagcagcaggagaaagaggaatgggagggaagccacccatggaagccatgggaccgggagaaggatctgtctgctgggcgccagaatgtggccttagacgcagagaacatgtcgcaaggattatcttcccgtttcgcatctggtgctgttcagcggaacttcctgtgagctgtgtggaaagatactcctggagcttggtctaatcgatgattaatgtccagttattacatcctggtcggcagatggcaaagataatgctgacatataaaaacgagttatgttaccaaggaccatcgtcctgtaatatcgatcgtgcttgttgtgcttattttctcagtgtattatcgggtgagctaaaatggtgccatagtttgttcgtacgatacaattactttttttttcaacatgtattaggattgtaatttctttttactgatgctaaaatgtctagctcatggggttgggtta

SEQ ID NO: 164 - DNA, 1484 bp, Hordeum vulgare
ccggctcccgggacaccacacagcgcacagacagcacacggcccatcaccgctctcgttgtctcgtacctgccagcgatcgaatcgaaccaagccgacgcgcgcgcgagggcttgtgcatgataaggaggaggatgggggcactgcacgtcggcgagccgcgggtcagcttccagcagcaggtcggcaagaacggcggcgggcacggcgccgtcgtcgaggagatacacgggctcatccgcgtgtacaaggacgggcacgtggagcgcctcccggccatccccgacgtgccctgcacgtggggctcgacggccgccgcgagcggcgtcctcgcgcgcgacgtggcggtcgaccgcgccacgggggtgtgggcgcgcctatacgcgccggccgccgcggcggggaaggtccccgtggtggtgtacttgcatggcggcgggttcagcgtcggcccggccgcgtggagctgctaccacgagttcctcgcccagctgcccgcgcgggcgggctgcgccgtcatgtccgtcgactaccgcctcgcgccggagaaccgcctgcccgccgcgttcgacgacgggctcacggctctgcgctggctgcggcagcaggcgagcagaggcgccgccgcctccgacgaggtctcgtggtggcgcagccggtgcaggttcgaccgcgtgttcctcatgggcgacagcgcgggcgccgccatcgccttccacgtggccgcgcgggcccccgccccgctcgccgtgaagggggccgtgctgatccagcccttcttcggcggggaggcccgcacggcgtcggagaagagcatgccgcagccgccggggtcggcgctgagcctgtcgacgtcggacagctactggcgcatggcgctcccggccggcgccggccgcgaccacccctggtgcaacccgctggcccgcggcgcgccccggctggagagcctggcgctgccgcccatgctggtgtgcatctcggaggcggacatcctgcgcgaccggaacctggagctgtgcagagcgctgcgcaaggccggcaagagcgtggagcaggcgacgtacggcggcgtggggcacgccttccaggtgctccacaactgccacctgtcccggccgcggacgcaggagatgctcgcgcacatccgggccttcgtcagcgccaggtccagctgacagacactcgcccgccgacgtgtcatgtcagtgtcagccgtcagttaattacttcaaatccagtgtaatccactaccagttccagagtagatgccgtgtaagcagtagtagcaacttgtggtacacgtccaagtgaaggaaaagacaagaaatgggtccaatgccgaagttggatcgtggtagctagtgctgtcggaaagcaaaagtgtggcggaaaaaataatgatccatctccatgtatgtatgtatgtatatcgtgttgttcattgtactcctacttacttgcaaaggcagatcaatatattat

SEQ ID NO: 165 - DNA, 1154 bp, Zea mays
cccttccctcttcgcacgcagtcgcagactcgcagccccccttctgatcctcttcctctaccacgcggccacgcccccgccccccgctgactcacgcaacgcgcgcgacgacgcggaggagaaaaccaggaatcccataaaggtttcagtttcggaagccaagccactcccacaccctccacgctcgagcgaagggaaccagcaatggcgcgtcgcgggccgtgagagacgggaacaagaatggctgccatggtgcgcgggcccgcgatggcctctgcggctgggccgggtgcgacgtcggcggctgctgcggccgcggccgcggcggcggaggagatgcggtggcggcagctagacagcggcgtgagcgcggtgtcgttcgggttcgtggccaccgccatactcgtgtccatgttcctcgccatggccatcctcgagcacttcctccgccccacgacgtcgacccacgcgccgccccggggccggggcgtcctccgccgcctccgcctcttcctcctcggccgcggtggcggcgcccccggcgggacggatctcgaggcggcgaggaagctccacggtcacgcgcccctcgagatgcctgtttaccccagaggcgtgtcagttctgatgccagggcaagacgtgccaacgttcatcgcgcatcctgcccctgcaccgtgccccccagagaggatccggtggccgtcacaccagccgcctcctttcactggctcctcgccaaaccctagctagggctgatgtagcgcacacccaccacactgagaacgctggctgttgtcagccagtcaaccatcaatgtctgtagaggaggcgaggagcagccgtgcgctttgtgggcgtgttggtgttgccgatgaatcgatgatccactccgtctccggggcatgacagccaggacaggcgggctctctctcctctttgtgactctgtatctgtacaggtttaggtcttgttctgaagcattgcaaccttgtactgctgccccctgctgcgttgtggctggcgagcggcggctggtggatccgtcgtggagttgttgctgctgatccctgttgatgtgtgtcagtagatgcctgatggagcatgtaaactacttgtaaactcgcttggcaaatgtggtttgatttcaggaa

SEQ ID NO: 166 - DNA, 695 bp, Hordeum vulgare
cgccgatcgcgccgtacgcgcgaacgcccgcccgccggaccggaccagccggcgccgccgtgaacagggtaaggcgatgttctccggcgactggacgccgccgtgcggcagctgctgcaccaagaagtacgcgaccctcgtccaaatcccatggagggtgttctgcaagaaggggtgcaacgcggacggcgacacctgggaggagtgcataggtaaatgcactgaaatatgctacaaggatccggtgttggaagatcgccagtggagtgcttatatcgatcggtcgccaggagaggacagttactccttggagtgcttcaacgcgtgcatctctgggtgtggatacaggtttgacataccggcggagaaagtagggctcatcaagccgaacaggccatccaagccgccgccaccgctaccccccgtggtcgaacgggccaaacctagctccgggtctcccgccgcggccggcgaagatgtgcccggcacatcggcatagcccatgatgatgccaaattttcgtgtaaactgttagtaactgtcgtcctcgaattacccaccgttgttcaccttggttgtgatggatgtatgtttgggaagtttggtcaactccaacctcaccctgatgggtgaggagtagatgctaactatggcatggcaagcaagcgtatatggaacggaacggatgttccacc

SEQ ID NO: 167 - DNA, 2313 bp, Sorghum bicolor
aacgccacggccggctctagtggcaaatcgttatctgtttcctcgtcttctccatttcatcccagccaccacttcccgccatgccgccaccgccgccgcagggtccagctccctcccacgctggccgcgccaacctcttctccgccccgccgcctgccctctccaaccgccgctaccccagtcagcggtccctgcccctcccgcccgtcccccctcgccgccgcgaccccaagaaccaccgcccgcagccttcccaagaggaagaacgaccgacagacagcggtccaaggagaacggctgccaccaacccggccttccgcgcgtcccacctccgtaccgcgtaccgcaagcccgtgcccccagccgcagccgccggcgaaggcgaggccctcctcgccgccgacccaaccgacgccgcctcggggcgcgccgtcgtcgtgggtccctcgggcctctccttccgcctccccggcgcgccgttcgacttccagttcagctactccgaggggccccgagccccgccgctcgccatccgggagccggccttcgtgcccttcgcgccgccgaccatgccgcggccctggacgggcaaggcgccgctgctgactaaggaggagaaggcgcgccgccggggcgtgcggctgcacacgccgctcgggcaggagccgccgcaaacggtgagcgcgcacgggatcatgatggaggtcagggacaggaggcaaatggacctggccagggtcagccccggtgatggcagaagcagggaggaggtgctcggtgagccgctcaccccatctgaggtgcgcgcgctcgtcaagccgcacatttcacacaaccggcagctcaacattggaagagatggcttgactcacaacatgttggaaatgatacattgtcattggaggcgccaggaaatctgcaaagttagatgccgaggcgttccaactgttgatatgaagaatctctgttatcatcttgaggaaaagtcaggtggaaaagtcattcaccgagtaggtggcgttgtttttgtgtatagaggaagacattatgatccgaagacccgtcctcactatccactaatgctctggaaacctgcgactcctgtgtatccaaaactcatcaaagaagttccagaagggcttacaaaagaagaagcagatgaaatgagaaggaaagggcgtgatcttctgccaatctgtaaattagccaaaaatggaatatacatcactcttgtcaaggatgtgcgagatgcttttgaaggaaatgaccttgtgaagattgactgtgagggtttgaatccaagtgactacaaaaagattggagcgaaactaagggatcttgttccctgtgttcttttatcatttgatgatgaacagatattaatgtacagaggcaaagaatggaaatccagatactcgaagcctcttactctcattccgaaagttccaaagaataatctggcaatgtcatctgacatgaatagttcagatgaagttagtgatgccaacactcaagttgcgataagagaagtattgagacccaaaatgtttaaattatggaagagtgcagtggactcatctctagcattgctgctggatgacgctgaagcaaatgatctcacacccgattcactgctgactttggttgaggagttcagcgtgacatctcaggcagtcgagcactcattccctgctctgcttgtgaccaatggtgaggtgaacaccgaatctctaagtgcagaatacataaatgatgatgagtctgaaacaagcattgctggaaacgaagagggccagctcgagcagtcacctgatctctctggcgatgaacattttgagcttgacatgcttgagcgtctggagtcatctgtgccattgggatcgctgccgattgacggcatgatagagcagctgaacagtgagtgaactacgatgagcagttcattctgtccattggggtaactactgatgatcagattgcaacctctgattgcaacctcagtctgatgatgatctcaatagctgagaattttcagcgatttggtagcaaacatgatgtaaagaaaataattgtagcggatgggcatgtggcccagtggtgaaggctccaagagaggagccggcccgtgggggtttgatcctccgtcccgcatctgccctcctgtgaagggcgcaccaggtggtgctttctaaaaataataataatataattgtagtataaaaatgcactaactgatcacacgtatcattgtcaccatcaatgagtgtgcttgcatgtatatgaatattttaaattttttatacgttgtttacc

SEQ ID NO: 168 - DNA, 1166 bp, Glycine max
tttaacctcaccctctttacccacaccctctctctctctctctctgtcacgcacagagaaaaactcagacacccacgttcacacttcgcacacaccatctctcactgttctttcttcttcctctttttctttttttttcttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctccaactccctcctccccactttcttcaagcacaacaacttctccagcttcgttcgccaactcaacacctatggtttcagaaaggtggatccggatcggtgggtgttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttcatgaaatgaacaagaggttagagacaacagaaaaacgaccacaacaaatgatggcttttctgtgtaaggttgtcgaggacccgcagattctttctcggattctccgagaaagagaaaagaaacacctgggagagaaaaagcgacgcctcattccgcctccgccgccgacggcagcgacgtcgtcgtcgtcgtcctccggcatcaagacagagttcgaagaagacgaaggtaattataatatcaagtcttcgtcgccggagacagggttggaaatcgacaacaatagtaacaatatttgttcgccgccgccgctggggtgttggggtgaacagggttgttatgggtacaattgcgcctccgtgccggcacctttgacggtggtagcgccggcgtttccgacgatgggaggagggtatttgaggcgtggggggttttggggggaaatggcggcggaggggaatgcggtgccgccttatccgttttcgttgttggaagggggcttttagatttagttttaggttatgaaatgaatgaattattactgccacaaaatttcat

SEQ ID NO: 169 - DNA, 1379 bp, Zea mays
actcccccacactacaccacactcgagagccatctcccagcacacgagcgggatggcttccaccaccaccaccttcctcgccgtcttgctggtcgtggccgcgtccgcggcgccggcacggtcctgctcaccgcgcgacatccacgcgctgctgagcgtgaagcaggcgctgggcaacccggcgtcgctgtcgacgtggacgccggcgtcgcccaactgctgcgcgtgggaccacctccgatgcaacgacgccgggcgcgtgaacaacgtcttcatcgacggcgcggacgacgtgcgcggccagatcccgtcggcggtgggcgggctgacggagctcatgtcgctgacgctgttccggctgccggggctgacgggcgccatcccggcctgcctcacggcgctgtcgaacctccagttcctcaccgtctcccacaccaacgtgtccggcgccatcccggagtcgctggcgcggctgcgcggcctcgactccgtggacctctccagcaaccggctgacgggcggcatcccggcggcgttcgccgacctgcccagcctccggtcgctggacctccggcacaaccagctgacgggccccatcccggcggggctggtgcaggggcagttccggtcgctggtcctgtcctacaaccagctcacgggccccatcccgcgcgacgacgcgcgcgacgagatcaacaccgtcgacctctcccacaacaggctcaccggcgacccctcccacctgttcgccgccggccggcccatcggcaaggtggacctgtcgtggaactacctcaacttcgacctcagcaggctggtgttcccgccggagctcacgtacctggacctgtcccacaacctcatccgcggcaccgtgccgctgtcgctggagcgcctgtccacgctgcagaagctggacctcagctacaaccgcctgtgcggcccgctccccaagggccacggcgtcatcaagcacgggtgcaagccgtacgcgcacaaccagtgcagcaaagggaccccgctcgcgggatgccaggacctggagtgagtgagccggtggccatggttttctatactctgctctgctctccctcgccggcgttcttttcgtgtcccaatcttgaaggacgacggtacggtgcctggtttagctatagacaaaaaaaggtacggccgcgtggtggcggtgctaatatgcttagccacgcccacgcgcggttgatctttgagcagttaagcgtgtacgaaatgacagctgtgtacgtgtactgtctggtggagtgtgctgtgtatctggtctcgatccgatcggcctaatgtatgaaaaaaaaaggatgtttacgtactaaatggaaaatcattttttccctcttctttta

SEQ ID NO: 170 - DNA, 2070 bp, Sorghum bicolor
cccggtccaccacctgccctgctcgggtgctctctttcttcccattctccagccgccgcggcgacgcgcagacctagcactaccagagaaacacccgagatggcgatggctctgcgccgcctcgcgggcgtgtccggctcgccgtcggcctccgctgccgcggccgcgctgctactccggccggcgctgacccgcccgatctccaccggcttccgcgaggagcgcgacaccttcggtcccatccaagtccccaacgacaagctgtggggcgcgcagacgcagaggtcgctgcagaacttcgacattggcggggagcgcgagaggatgcccgtgcccatcatccgcgcttttggcgtgctaaaaaaatgcgccgctaaggtgaatatggagtatggtctggatccaacaatagggaaggccataatgcaggcagctgaggaggtcgcagagggaaagttggatgatcacttcccacttgttatctggcaaactggcagtggcacgcaaagcaacatgaatgccaatgaggtaattgcaaatagggcagccgagatccttggacacaagcgcggtgagaagtttgtgcacccaaatgatcatgtgaataggtcacaatcttcaaatgatacatttcccactgtaatgcatatagcagcggccgttgagataaattcgaggtttatcccaagtttgcaacagttgcatgattcacttcattcaaaaactgttgagtttaaagacataattaaaattggacgtacacatacccaagatgccaccccgttgactcttggccaagaattcagtggttacactacacaggtcaaatatggaattgaccgtattaattgtacattacctcggatgtaccagcttgctcaaggtggaactgcagttggaactggcttgaacactaagaaaggatttgatgtcaaaatagctgctgcagtggctgaggaaacaaacctaccctttgtgacagcagagaacaagtttgaagctttggcagcgcatgacgcttttgtcgagagcagtggcgcggtaaatacaatttctgcatctcttatgaagatagcaaatgacatacgcttgctaggaagtggtcctcgatgtggtcttggtgaactaatcctaccagaaaatgagcctgggagcagcattatgcctggaaaagttaatccaacccagtgcgaagctctgacaatggtttgtgctcaggttatgggtaatcatgttggtgttacagttggtggtgcaaatgggcattttgaactgaatgtttttaagccaatgatagcagccggattgcttcgatcattgaggttgttaggggatgcatctgtgtccttcgagaaaaattgtgtcaggggaattcaagcaaaccataagagaatttcacaacttttgcatgagtctctgatgttggtgacatctttgaaccctaaaattggctatgacaatgctgcagctgttgctaagaaagcccacaaagaaggaaccacgttgaagaaagctgcattagaccttggagtattaacggagcaagaattccatgaacttgttgtcccagagaaaatgatcggtccttctgattgataaccccatgttcattatgtttctttaaagcattcaggttgccacatccggagttctggtggtttcctgtgatgccaacttaatgattctagtgcacccgtaaataaaccaaataatttttcatatggtcattaggtcctctccacactggagaaatgatttttgcatggcggatggtacctgagaaaacaattgtacgcttgttccaataggacaatagggcactttgatggatgaggcaccttccattctcctggcatcggtcaagcttttgttgccaggtagctaatgctatgtaataagtgacatggcaaccatgtctagaaactatttgcattggtctttgacaagtggaagtagaaatatacccgagttctagttctttttaccgattttgagctagtttttatccatcgctgaattcaatgtcccagaggactcggaccttaattttcccttcgaccatttctgaac

SEQ ID NO: 171 - DNA, 1785 bp, Sorghum bicolor
cgcctcccccgcgccgagcccccattcctgccacaaatcgccgctaaaaccctagccttccgccatggccacctccccagccgcctcgtcctcttccgctccgaccgcctccgccgccgctgcggccacgatggctgccgaggccaccgacgggccggtgctcagcgtagtatcgaagcgtctccgcgcgctgcggaagaagtacaaccgcatcacgcagatggaggagtcgctcgccgccggcaagacgctcaaccgagagcaggaggaggttctccgctccaagcccgtcgtcgccgccctgatcgacgagcttgagcgcctccgccccccgctcgcatccgccgtcgcggaggagctctcctcccgccccgcccccgcccctgcccctgcccccgccgccgccgcttcctcctccgactcagattcgtcagtccaggacctcctcgcgctcatctacttcggctccctcttcgacgtcaagcagcaaagcgacttcgtctctttggtttacgcgagcgagctcgagcggagcagctgcatcacttatgactacgtcggggatgatccggaggacagtctcgcggagaccgatctgaacgcggtttctgcccttgcctccctcgccgcgtcgcgccctccagctgcagccggagtctcgcaccgtgacgcccttcaggcttgtgcccatcacgcccgcctctggctccgccgtgcggatgaacccatccaccctgactccaccgtcacatatgctggggtgagggcaaagctggataggatcatggcatcgggctactacacagctcagctagaaatgaggccaccattggatctggctgctgcagtggcaagctttggagctggaggtgctcagatgcaggagagtatggttgtgtcgcctcaggcaccggaagcagttgaggagaacccagctgttgaaggacacaaggatgagaaggatgattcgcaggctactgaaatctacagtgaccatcaggctcctgttgttgatgctgaacatgtggaggatgaaggcctggtgaatccaactgatgaggttccttcagctgaggcagagcaggagacatttgatgctgatgtggaggatcaggaacaaaaagaccaacaattcacccagcggcggtcttaccagaaccagcgtgggggtggtggtcgtggtggcggcaggaggggctatcctaatggtcgtggagggcgtggtggccgaggcggtgggtaccagaacggccgtggcggtggtggataccagaacggccgtggcggaggcggtgggtactactatgaatctggatactaccagccgaggaactacaacaacaacagaggccggggtggtcgctctggcggtggcaactcttactacaacaaccatggtggaggtgcacagggaggcggccatggcaatcctgggagggttgagcttggtgcaaacgcctagctcgctgactgttttgtttgaggatgtggagcgagggagaagagccattttgttattatagaactaacttagcctgttattacgccaccgttggccccatctgtgagttctttttgctactcgagtgactgcacatggtcggtcggtaatgtggaaaaactctgggaaagtagtttcaggtcatattcgttctcctaagttacgccttttatgtgttaatatgccccttatatttcttcattattatactctgtgctggaggagtggaggtgtcgatgttgggaccggattttgtcgttacatcaggttgctatggtctatcg

SEQ ID NO: 172 - DNA, 2249 bp, Sorghum bicolor
gactagttcgaaccaaaccctccagagtccccccgcagcaggagcgagcagccatggcgccggtcgatccccactcctacaccgacggcgcgcacccggtggtgtcgcgcgccgcgctcgccttctacctcgacttcgccgcctccaccatacacgcctccgcgctgctcaccctctccgcgccgcactctggggatctcctcctcgacacccgtgccctcaccgtccactccgcctccaccgatgccgacacgccggagcccatccccttctccctcgccgcggcgcccgacccggtcctcggcacggcgctcaccctcaccctgccccccgacaccacctccttccggctcaccttctccacctcccccgccgcctccgcgctgcagtggctggccccgccgcagaccgcctccgggcagcccttcgtcttctcgcagtgccagtccatccacgcccgctccatcttcccctgccacgacacccccgccgcgcgcatcaccttctcgctcctcctcaacgtgcccgagcagctctccgccgtcgcctccgcgcgccacgtcgcgcgacgggacccgctgccctccgaccaccgcggggcctgcgacgacgagctgtggtgcgcgcccggccgcatcgttgaggagttccagatggagcagtccgtgccgccctacctcttcgcgttcgccgccggcgggattgggtccagggacctcggcccgaggacgcgggtgtacgcggagggaggggacaaggtgctggacgaggcggctagggagttcgcgggggtggaggagatggtcaaggttggggagggcctctttgggccgtatgaatgggagaggttcgatctgctcgtgctgccaccgagcttcccctatggaggcatggagaaccccaggatggtgttcctcacccccacggtcatcaaaggggatgctgcaggggctcaggtcgtggcgcatgagctcgcacatagctggactggcaatctgattactaacaagaccaatgaagatttctggctaaatgagggattcacaacatatgctgagaggaggattgttgaggttgtgcaaggggaggagcgggcagccttaaacatggggattggatggagggggttgaacaggatgatggagaggtttaaggataacatggagttcaccaagttgaagccgaatatggcagggattgaccctgatgatgtgtactctgaagtgccctatgagaaaggtttccagtttctttggagaatcgagcgtgagattggcaggcctgcttttgatgaattcttaaagaagtacattgcaaccttcaagttccaatcaatagatacagagacatttcttgaattcctcaaaaccaatgtacctgggatagaaaaccaaattgaccttaacctgtgggttgaggggaccggtatccctcctgatgccatggaaccagattcagctacttacaaaaagatctgctccttagctgcagaattcaaatctggaaaacttccaagtgaagatgaggtggcaaactggagtgggcaagaatgggaactttacttagaaaatctaccaacagatgttgaagcctcacaggtcactgctcttgacgagcggtacaagctatctgaaagccgtgactacgaggtcaaagtcgcattcctccagctggcgatccccaccgggtgcaagtgctacttcaacgaggttgagaaatgcttgaagcaggtgggaaggatgaagtacctccgcccgctctacagctcactggccaagtgctccagcgaggagaagatgctggcccagaggatcttctccgaggctcaagagttctaccacccaatagctcgcagtgtcgcggagtccattttgtcgaagcatagctaagcaggccaagactcttgtttagcaaatccatcgtccacggcctcacccgactcacggttgggagcaactgagatctggtgattgctcagttgcttctttctcataaaatttatcgtctgctggatctaacttaggaaaaacttgggacttgcactgcatcttgtcttgataatatgtggagacagaaccgtagtacctgagtaatgtatgttctgggattttgcttatgcttaaaaatgttctgggactgcaaggccactccttccatgcagcttgggaatgatgtgtgggctcatgacgaagtgagcattgtgtactgtggttcaccctgcaatgctgcacaggccttgtttagtttct

SEQ ID NO: 173 - DNA, 1336 bp, Sorghum bicolor
actaccctgtcctgtgtctctcgagtgtcaaccaacaccgctccagctgcggcgtgcgcagctataaaaaccagagtgccaaacatagtactccttgctaccgcatgaccacgccacatatcatcgtctagctccgtttattcgtttccgggaagcaaccaaccaaccaactctcgtttccaggcagccgacgaccttgggccgtgttcgtctgctgccaagagtacagtttgatgcgagcagctagctagttgttcctttcaattcgtgtgcttttgctagtagcttgagatcaagccagccggcgaacgaggatcggaacatcatccatcgcatcatggccgccgagcagcagcagcagcctgccaaggccgccgcggccggcagcaggttcgcggtgacgtgcggcctgctgaggcagtacatgaaggagcagggcggcagcggcgccaccaggtgcctcgcgccggccgtcgccatgggcctcatgccggaagccgacgctgcggcggctgcgaccgaggagaggaccaccgtgctggagctcttcccgcagcaggctggcacgctcaaagacgagcagcaaaggaagaggaaggagcctgcggacgggagagcgccgctgaccatcttctacggcggaaagatggtggtgttcgacgacttccccgcggagaaggccgaggagctcatgcagctcgccggctccggcggcaacgccgcgcccgccgccgagaacgcgctgggacagcccagcctcacagacatgcccctcgcgaggaaggtgtcgctcaagaggttcctcgagaagaggaagaacaggctcaccgcggcggatccatacccggcggcggcaagtgagtcgtcgaccaagcagcctcctgctgttaaggaggagggcgcgccgtggctcggcgtgagctccgcgctcagcctcagctgaagaatctgatggaggacagcaagacacctactccatgggaaactacaaattactccagtaattgctactgcgtactactagtatttttttttcaggccgtaaaaatatgtacgtgtttcaacccttgacatttacaccagttactggttgcttcaggggaattagctagccagctaattagtgtattatgattggttaattagttgtctgtttgagaattctttggcgacaaaagaattctttccttccttgctgatattcatctgcaaggatatgaactaattaattaaatctagatgatcgatttcatacatatacagtttgtaaattcaaataagctgatggaacaggttatatgctattcttttgcttcattgtttcagtctcgtgtca

SEQ ID NO: 174 - DNA, 1204 bp, Gossypium hirsutum
taagttcaaaaggtgtttgtttgtatcttctgatcggttcaatttcatgtgtcactcactttccttcccatcttaaacatgctccctcctctgtaaatcctattagacgtcaatttcccctttcataaatctttgggttttcatggaggaaatcaattgggatacccttctgctcgaggttgacttacccgatttcggggatatcttagataatgaaccggaaccggtaacggaacctcctcctcaaccttgttcgacccagaattccgatgaagaaccggcggtgtcttcgtggatcggggagatcgagaaggttttgatggaggatgataattttgatcatagggttgagactcaacctgtctccgatgatgatttcttggccgatttactggttgattcacctcctagtagcggcggcgatgtggctggcgtcgacggtgctgatttgcacaaacagagccagacccacaccgacgtcgataaagacgatcccattgctaagaaacagagaaggcagttgagaaacagagatgcagctgtgagatcaagggagaggaagaagatgtatgtcaaggatcttgagatgaagagtaggtatttagaaggggaatgtagacgactgagccgtgtgcttcagtgcttcattgctgagaatcaagctcttcgtcttactttgcataagggttgtgcatttgatgcatcctcggccaagcaggagtctgccgtgctcttgttggaatccctgctgttgggttccctgctttggttcctgggcatcatgtgcctcttcaccctgccaatactgcccaagtcagttctggaggcagttccaatggcaaacgaggaaacacaaggtcccgaaagagtggctccaagaggggcagggagtaaccgggtcggaccatcttttgtgaagagtaggagatgcaaggcgtctaggggaaagatgaaagaaatttcatgttttatgggaattttagttccattttaggtttaatgtgatgggggtgtggctgtcgtgttatttaatgatccttgtagtttgaataaaaatcactctttgatctttgtttttggcatgtaactcttttagtgtacatttagtttgttcggagtactagaaatttagtagttttagtttttgtaaattcttgcagttacattttaatagaaagtccggtctagacccgtttaaagtcga

SEQ ID NO: 175 - DNA, 1483 bp, Oryza sativa
cgagtgcaagtgagctgcatagatttttagaggttttttgtggaatcatcttttgtgctgggagatttcttctgtttgttcttttgtttcgtcgtgccggagatggcggtggagtcgtcggacgaacggaaggccgacgaagacggagctcacgaggagctcgaggggcagttgctgtaccgcgttccggtctttgacccctccctcgccgagttctgctcgccgcccccgatcgatgacgcggcggccgcatcctcatcgtgcttcaaggaggacgccgccgacggcgccgtggaagacgcaaagtatccggcagctgcggcgtcgtcgcccgtgcagcagctcccggatagctttgtcaacttcgaaccgacggacgccgagctgagggagttcgccgccgacatggaagccctactcggacaaggcctggacgacagcaacgagctgcaggactcgttctacatggagaccctagggctaataacgccgccggtagaagaatccggccgggtgaagatggagctcgacggcggtgttgcctccaacagcagggtatctctcccatcatgccgcgctcatccgaagccggaggacgtcgaatccgccgacgtgctggacatcgatttcaactgcacctcgccggacgaacagaagtcgtcggcgagcaacggcgccgcagccgattcgcagttcttccacaggagcctggatctcaggctcaactacgaggcgatcatcgagagctggggcaactcgccgtggaccgacggccggccgccgcacggccagctcgacgacttctggcccaacgaccaccattactcggggttgtgggctgcgggagggggcgggcatggcgcggaggtggggatgatgacggtgaggccgcggatggacggcccggggcgggaggcgcgggtgacgaggtacagggagaagcggcgtacgcggctgttctccaagaagatacggtacgaggtgcggaagctgaacgccgagaaacggccgcggatgaagggccggttcgtcaagcgcccctccgccgccgccgccccgtgcgccgtcacctagacgtacgatcgcgcacggcccggcgcgcggcaccatgcgtacgtgtccggtgtcgagacttgcctgcgttcgatcgtatgcctcatggactcgattggcacaaaagttcacgcaaaatttgtcgaagctgcacgattcaagtagtataacgttgttcaattcaaaagtttttctcttccttttttttttcggttttgttggtgtttggctcggtgcttttggatctcttttatctctgttccatcgaccggagagaaagtaggcgattgtacttgtgtaaacattggtgttcatggttttgtagaaacactccataaaggaaacaaaatgacttgtatatgtaaactgggttgtgcctgcgccacacccatgtacattgagtaatcagtacatacttaattattttctt

SEQ ID NO: 176 - DNA, 2922 bp, Oryza sativa
aggccacacctcggagccccacacacgcactcccctcgccctcgccctcgccggcgcgccgcccctctccggccctgcgccgccgtggtcgccctagacccccctcccccctccggcatccactgtcggcgggcggacgcgaaaaaggtgcgtttcctatcgctcgccgttttgcccgccaatagcaagcggaagctgggggaatctgcggtggatttttcgcctcgttgtgccgtgtcatctcctcctcctcctcctgccgatgatgatgctgctgatgccgagatcctcctcatcctgctgcagacgcagccccggagggaagaaacaaggagctcaacccagagtgatggcgcctcgtcgtggggtcaccagagtatatattgagaagagattgggagtaggagggggaaatgcatcaagcctgcaagacatgcacaggaaggagctccaggcaaggacaagggaccagctccagacattggagttatctacgtctttgtacgacacggcgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggactagattttattggaaggaatttctccattgccatggatgagcagattgctgctcctgttggtttcaacatcacttttcctggtatgcttagccttgccatggggatggatttagaattccctgtcagacagacggatgttgatagacttcttcacctccgggagatagaactggaaagagaggctggagaccattcttatggaagaaaggcatatatggcttatgtcacagaaggattaggaaacctgttggagtgggatgagattatgatgttccagaggaagaatggatcatttttcaactgtccttccacaactgctgccacattagtcaaccactataacgataaagccctccagtacttaaattgtctggttagtaaatttggcagtgcagtaccaacagtgtatccactaaacatatattgtcagctttcatgggtggatgcacttgaaaagatgggaatttctcagtattttgtcagtgagataaagagcatcctagacacaacatacgtttcatggttagaaagagatgaggaaattatgctggacataacaacatgtgcaatggcttttcgcctgttaaggatgaatgggtatcatgtttcctcagtcgagttatctcctgttgctgaagcttccagtttccgtgaatcacttcaaggatatttaaatgataagaaatctctaatcgaattatacaaggcttcaaaagtcagtaaatcagaaaatgaatcaatcttagatagcataggctcttggtcaggtagcttattgaaggaaagtgtgtgctctaatggggtgaaaaaagctccaatctttgaagagatgaagtatgctcttaagtttcccttctacaccacactggaccgtctagatcacaagaggaacattgaacgttttgatgcaaaggattcccagatgttaaagacggaatacttgcttcctcatgccaatcaagatattctagctttggctgttgaagatttcagtagttctcaatctatataccaggatgaacttaattatcttgagtgttgggtgaaagatgaaaagctcgatcagctgccatttgcacgccagaagttgacatattgctacctttctgctgctgctaccatattcccccgtgaattgtctgaagcccgcattgcatgggctaaaaatggtgtactgacaactgttgttgatgacttctttgatcttgggggatcaaaagaagaactagaaaacctcattgctttagttgagaagtgggatggacatcaagaggagttctactcagaacaagtaagaatagttttttctgctatttatactacagtgaaccagcttggagcaaaggcttctgcattacaaggccgtgatgttacaaaacacctaacagaaatatggttatgtctgatgaggtctatgatgaccgaagctgaatggcagaggacaaaatatgtgccgacaatggaagaatatatggcaaatgctgttgtctcatttgcactgggacctattgtgctcccgactctgtatttcgtaggaccgaagctccaagaggatgtcgtcagggatcatgagtacaatgaattatttagactgatgagcacttgtgggcgtctcctgaatgacagccaaggctttgagagggagagcctggagggaaagctgaacagtgtctcactgcttgttcatcacagtggtggttctatctccatagacgaggctaaaatgaaagcccagaaatccatagacacttccaggaggaacttgttaagattggtccttggagaacagggtgctgttcctaggccatgcaagcagctgttctggaagatgtgcaagattgttcacatgttctactctcggactgatgggtttagctcgccgaaggaaatggttagtgcagtgaatgcagtcgtcaaggagccacttaaactcaaagtgagtgatccatatggctctattttgtcgggcaattgagtgcttctccgttctgttttatcagggatatcagcaacgagctttatacaggttgatatttcttttctttttctttacgataagggtttaaatcctagtacccacgattatagctgctgtgtgctttaagtataataaattttacactcttaccatttttttttaatgtaaatgttggtatatattggtacctgacataatcagaagcaccaaattataca

SEQ ID NO: 177 - DNA, 2122 bp, Oryza sativa
ccactccatcagctagcttagctcagctcaaccacatctcgaactaaccaactaagctaaagctaagctagcttcaccgtcatcctccactgacacatggggagcttggacgccaacccggccgccgcctacgccgcgttcgccgccgacgtcgagcccttccgcccgctcgacgccgacgacgtccgctcctacctccacaaggccgtcgacttcgtctacgactactacaagtcggtggagtcgctcccggtgctccctggcgtcgagccgggctacctcctgcggctgctgcagtcggcgccgccgtcgtcgtcggcgccgttcgatattgctatgaaggagctcagggaggcggttgtccccgggatgacccactgggcgagcccgaatttcttcgcgttctttccggcgacgaatagcgccgccgcgatcgccggtgagctcatcgcgtcggcgatgaacaccgtcggattcacgtggcaggcggcgccggcggcgaccgagctggaggtgctcgcgctggattggctcgcgcagctgctcgggttgccggcgagtttcatgaaccgcaccgtcgccggtgggcgcggcaccggcgggggcgtcattctggggaccaccagcgaggcgatgctcgtcacgctcgtcgccgcgcgcgacgccgcgctgcggcggagcgggtccaatggcgtggcgggcatcacgcggctgacggtgtacgccgccgaccagacgcactccacgttcttcaaggcgtgccgcctcgccgggttcgatccggcgaacatccggtcgatccccaccggggccgagaccgactacggcctcgacccggcgaggctgctggaggcgatgcaggccgacgccgacgccgggctggtgcccacctacgtgtgcgccacggtgggaaccacgtcgtccaacgccgtcgacccggtgggcgccgtggccgacgtcgcggcgaggttcgcggcgtgggtgcacgtcgacgcggcgtacgccggcagcgcgtgcatctgcccggagttccggcaccacctcgacggcgtggagcgtgtcgactccatcagcatgagcccccacaagtggctgatgacctgcctcgactgcacctgcctctacgtccgcgacacccaccgcctcaccggctccctcgagaccaacccggagtacctcaagaaccacgccagcgactccggcgaggtcaccgacctcaaggacatgcaggtcggcgtcggccgccgcttccgggggctcaagctctggatggtcatgcgcacctacggcgccggcaagctgcaggagcacatccggagcgacgtcgccatggccaagacgttcgaggacctcgtccgcggcgacgaccggttcgaggtcgtggtgccgaggaacttcgcgctcgtctgcttcaggatcaggccgaggaaatccggcgccgccatcgccgccggcgaggcggaggccgagaaggcgaaccgcgagctgatggagcggctgaacaagaccggaaaggcttacgtggcgcacacggtggtcggcggcaggttcgtgctgcgcttcgcggtggggtcgtcgctgcaggaggagcggcacgtgcgaagcgcgtgggagctcatcaagaagacgaccaccgagatcgtcgccgacgccggagaagacaagtagatcgagctcgacggcgacagtgtaaagccactgttatttgctgtgtcgtgtccgttcgatacatggattgattaattgtttactggtcgcagttggtagaagtaattaatggcgacaacgagaggtgcgtggaataataaatactctctccacgtaggcagtgtgtgtgtgtgattatattcatactgtgcattcaaaattactatggtccatcatataaatgttgggctttcatcttcttcttttttttgggtaaggttctttttcttttttgttacttgtataccagcaagaaacatgtcataagtcatgtgtagtacgggtaaaaaggaacaggtgatttgtttggccttaattgtatatcaaacttttgagtaagctggttgttggtgtgttgagctatatatgtactgttccctgaaaaaaaaaacactatacatttacagttgtacaa

SEQ ID NO: 178 - DNA, 2080 bp, Solanum lycopersicum
attttcgccgatctaattactcttctttgacaaagttgttttttttttttaaaaaaaattgggcttatattttcggtggaattcaattcctttcatttggtttctcctttttctggcttacttttttaaaatcttattcacacttccactggaatgttcctctgaacctctgttttgtaattttgacaagtttttattcttgtttagaatggtggggatatgggtatctttagtgtcatctccggttcttggtgtttattgcttaccagttttggattcatatagccaacttcaacttgtttgggattgaggcgtagttgttgtacaccagggacaggaaattgtgttatgggttggttagaaaagatatttggaggttccacacacaggatctccggtggacaataccatagtgggtatgagggtgcgcaatatcatgggggctacgatggagggcaatatcattcggggcatgaaggagaacaatatcatggagggtatcaggacagtactacttgggacggaccaactacatcagtggatgaatcgtcagattttgataaagaagaaattgatcgtgccattgcactttctctagcagaagaggatcagaaggggaaaaaagtaattgagagtgaaccccatttggaggaagacgaggctctcgccaaggcccttcaggaaagtttgaatgtggagtcgtctccaccaccaccaccacctcgatatgattatggaagtccctttccctcactctcatactcgtttccgtatgggtatagggtctgtgccggttgcaatgctgaaattggacatggaagatatttaagttgcatgggagctgtttggcatccagaatgtttccgttgccatggttgcaatcaaccaatttccgactatgagttttcaatgtcagataaccgtccataccataaatcatgctacaaggaacagcatcacccaaaatgtgatgtatgcaagagctttattccaacaaatccggctggtctaattgaatatagggctcatcctttctggcttcagaagtattgcccatcacatgaaactgatgggacgcctcgttgttgcagttgtgagagaatggagcccgtagatgccagatatctgatacttgaagatggtaggaagctgtgtctagagtgcttggactcttcaataatggacactcatgaatgtcaacccctttatcttgagatacaagaattttatgaaggtttaaatatgaaagtagagcagcaaattcctttgcttctagttgaaagacaagcattaaatgaagcaatggaaggagaaaagaacggtcatcatcacatgcctgagactcgaggactctgcctgtccgaggaacagaccattagcagtatttcaaggagaccacggattggtggttatcggattttagatatgtttacagagccttacaggttaattcgacactgtgaagtgacagctattctaattttgtatggtcttcctaggttattgactggttcaattctggctcatgaaatgatgcatgcatggttgcggcttaaaggttatccgagtttaagtccagaagtggaagaaggtatctgccaagttttagctcacatgtggttggactcggaaattatagctggttctggcagtacttcaacttctgcatctacctctgcatcctcatcatcatcttcatcaccatctacttcatcaaagaaagggaagcgctccgactttgagaagaaactgggtgatttttttaagcaccaaattgaatcagatacatcagcagcttatggggatggattcagagaaggtaacaaggcagtgctcaagtatggccttaagacgacacttgatcacatccggcttacaggaacctacccgtgttaaaattttcagtcattccgagtgtttccacttccacgcggatgttgtaacaaaccttctatactagttttgtaggaccacatagcacatacaattataatcattacacaataattaaaagataaagagtaaatgcagcaataagatctgcgtttaatacacttgtgtctgcttcaacttgtatact

SEQ ID NO: 179 - DNA, 4308 bp, Populus trichocarpa
ttttttacattttcttttccgttggtgaaaaattcaaaattctctcattttcccgatcatccatctttttaattttctcgacaaccaaacagaaatttttttcgatttctctcggttatttgcctcacctgttgcctgcctccgacttagcttttttttttttcctgctttgatttcgattgcttgtctcagtgaggcatttcaatttcgaatcagtgaaaccactaggaggagaagaatattagggtttcggatcgaggtttttggtcacttctagggtttaacattggaatttttaaattttgtgtttgtagcagggtttcctttaatgatctgatttggagagagatatatatagttttatgatggtagatagaaaatggtgaggctattaggattaactcgcggagaatcggatgattctccgcgagagattacctcgaggacgactcctttaactagtgagtcaggtgagagtgggtggttgattaggttctttgactcatctttcttttgtgagtggattgcagttagttatctatacaagcacgatcatgccggggttcgggattatctgtgtaatagaatgtatacattgcccttatcgggtattgagagttatttgtttcaaatttgttatatgatgatacataagccaagtccgtcacttgataggtttgttattgatatgtgttctaagtctttgttaatagctttgaaagtgcattggtttttgttggcggagcttgaggattcggatgataatgatgggattagtaggattcaggagaagtgtcagattgctgccactttgatgggagagtggccgccattgttgaggccacggaatgagtcttcgagtcctgggagtaagaatcaggttttgaatagaatcttgtcatcaaaacagaagttgttgtcattgacttcttctccacctctacagaagtctacgcaattatcggggaatagtttgcaggaggatgggactgggagtcagttgtcaccggatgagaataagatttttaagaagtttattcctggtccaaagtttagagatgctttgttgtttaggaagaaatcagttgataaagatgaggatgagggtggaaaggatggatttttcaagagacttttgagggatagtagtagacgcgaggatgaggagttgacaacaagttcagatggttttttcaagaggcttagagatagcattaaaagcgaggatgaggagttgacgtccagctcagatgggtttttcaagaggcttctcagggacaatagtagagtcgaggatgaggaagtaatgtcaagctccgatggctttttcaagaaactgtttcgtgatagtaagagtgatggtgatgaaaagctggtttctaaatctgctgaagacgatgaaaaagaggggttccttaagaggttttttaaggagaagtttgaagacaagaaagatggaaatgatcagaacgaggatgaagaaaggttgaagcttgaagagaaaggttcaaaatctgcagaggatgatgaaaaagaggggttcttctggaagttgttcaaggataagtttgaggacaagaaagatggggctgataaacctgatgaggggactgtcaatggtgaggaagaagaaccttctgacttttcgttgtttcgaagactgtttcgtgtgcatcctgaagaggtccaaagttctcctgtgaatgaaaataacagtagtggtagcttgcttgaaagcagcctgggtactgagaatttttttcgcaaattgtttagagatcgtgagcgctcatttgaagactctgagttatttagttttaagaagaacaatgagaagcatcctggatcacctaagcaacagaatgagaaatcaaacacaaagcccccactttcaaatactgcagcactgttccggaaaggggcttatcatgagtcattggactttgtgatgacattatgtgaaacttcgtatggtttggtggatgtatttcctgttgaagatcgtaaaagtgctctttgtgagtcacttgcagagatcaacatgcatttagctgaggctcaaaacagtggaggggtttgctttccaatgggaaaggggatgtatcgcattgttcatatacccgaagatgaagctgttctcttgaattcgagggaaaaggcaccttatctgatttgtgttgaagtattgaaaagtgaaatgccaagtaatagcaaggagacatctggtactcaaaagctttccagaggaggaattcctctagcaaatggcgatgcattcttgcagaagccacctccttgggcttatcctttgtggactgcccaggaagtttatcggaatagtagtgataggatgtctcgatcaaccgctgaggcgattgaccaggcaatgtcccattcatcagaaatgaaaatgaaatttgttagtgtgagtctttcagtggagaagcaattccctagccagtcaactatcattgaagcacctaaattgaattctggcatcaattgtatgcatcaaaatgcttcacattgtaatgatttggaatgggtaagggtagtgttgacagcagatcctggagttagaatggaagacacagggtatgcaggggcaccacgacgcaaggagcatcgtcgggttcctagtacaattgccatggaagaagtaaaggctgctgcagccaaaggggaagcacctcctggactccctctgaaaggggctggtcaagattcctcggatgcacacccaaaggttgatggcaatcccaaggccagtgatgccttatctggtgaactctgggaggtcaagaaagagagaatacgcaaagcttcattatatgggaaattacctggttgggacctgcgctctgttattgtgaagagtggtgatgattgtaggcaggagcatcttgctgtgcaactcatttctcacttttatgatatatttcaagaagctggtctccctctttggttgcgtccctatgaagttctatgtacttcatcttacacagctctcattgaaacaattccagatacggcatcaatccattctattaagagcagatatccaaatgtcacgagtttgcgtgacttttttgttgccaagtatggagagaactccccaagttttaagcttgcacagaggaactttgttgaaagcatggctggatattctcttgtgtgctaccttttacaggtgaaggacaggcacaatgggaacttgttaatggatgaagatggccacattatacacattgattttggcttcatgctctctaactctcctggtggtgtaaattttgaaagcgcacctttcaaactaacccgggaacttcttgaggtcatggattctgacgctgagggaattccaagcgagttctttgactattttaaggttttatgtattcaaggcttcttgacatgtcgtaagcatgcagagcgtattattctccttgttgagatgttgcaggattctggtttcccttgctttaaaggtggtccacggacaatacagaacctaagaaagcgataccatctaagtttgacagaagagcaatgcgtgtccttggtgctctctctgatcagcagcagcttagatgcatggcggacacggcagtacgattattatcaaagggttttaaatggaatattgtgaggtgagatttgtttggtgactgccttctttgctccctttgaccaaaccagtctgtccagtgaagcattttgattggagctgtttgtaaaatgatgtcatataatggcaattggttcactgcactgtggttttggcaactaagcagaatagtgatgacagtttgtgacctgttttcgcttggtgtgaggaaattgtaattgtatcggctgaaataccttttaaaagtcctgcaggctgcatttacctcagcaaggttttctttttttcatcatttcccttgtcatttgtcatagaattctgctggctgctgggggaatttagttacacgacaagagaaatactgcactgtttacgcatcttcagatagaacatacttgtacatagtgattcctcgggggacaacgttccaggcatgaaatggtgtctgaggctgtaattgttggttcccattgcagctacttcatattccacactggttagtgatcagaagcagctgagcattcccgattttgtatctattcatatttcgaagtctattattttcttccgatgtatattggataggcggccctgtcagtcagtaactgttctccgtttgatgtctattcttccaagagtatgattcttccatgctttctaccaaaggcttgctagtaaca

SEQ ID NO: 180 - DNA, 641 bp, Sorghum bicolor
cttcaagctcacattggtcctcttaccagtgacgatggccggcggacagcggcagcgtcggtggggggcgacggacgtggcgtcgtggtgcgccctgctggcgctcgtgatggtcgttggatcgctcgccgggtcgggggacgacgaggagcagtacgacagaggcgggcgccgcttggtggtgcgcggggcgcggctggcggcggcgcggccgtgcgacgagctgtacgtggtggcggagggggagacgctgcacagcatcagcgccaggtgcggcgacccctacatcctggagcacaacccgcacgtccacgaccccgacgacgtcttccccggccttgtcatcaagatcacgccgcgcgccgccgactccaactccaactccaactccggcgacggcggtggcgccaagaagtgaagtgaaacggcaccagaccacgcgcagacctgtatgtgtatatgtatcgccgggaacctctcctgccgatggagcgcgacggcgacgacgcgccgacgacgtgagcggtcgggcacggacaggaacgctctcgttgtgttccagtcgtgtcctctgccttgtacatcctgcatctgaagagagctcgactacgagcagaaataagaggtggcactgctgtaaa

SEQ ID NO: 181 - DNA, 3478 bp, Oryza sativa
ctcgtcttcacgtgtccatggtctcagcgtcagcgacgagacgagagacgagaggcttcttcttctcccagccacacaaccacaaccaaacagaggaggctctctcaaatttaggagatcggcccagcgtctcgtccggatccggaggaggagcaaaagctcccttttttatgccgtctctcgtcccagctgcaggtggcgctttcccaccctcgccactccgctcgctccccgtcgtagacgtcgccttcgccgtcgctctcctcgtccacccttttctgctccatgttttcatcatcatcttcttcttcttcttccacccgttgctgattccctcactgctgctcgtttctcgccattgcggccgttcttggctactgacagaagaggaatgacgaatttgtccgggaagaaatctctgaatacagtgaccttggtcttcaaattaccctactacacacaatgggggcagagtcttctcatcgccggctcagagccagcacttggatcttggaatgttaagcaaggattgtctctcagtccagttcatcagggaaatgagctaatctggtccggcagagtttccgtcgctactggttttacctgccagtacaattactatgtagtggacgacaacaagaatgttttgagatcggagtccggggagaaaaggaaattagtacttccagagggtgttcaggatggagatgtagttgagatacgcgactggtggcaggatgcttctgaagctcttttccttcgaagtgcattcaagaatgtcattttcaatgggtctgaaaatgctaaaagagaattgaagactacatccctcaacaaaagtttggagcctgaagatattgttgttcagtttattgttagctgtccccgacttggagctggctctactgtcgtggtcacaggaagtaatcctcaattaggaaggtggcaaacacaagatggcctcaagcttaattatgtcggagattccatctggaaagcaaactgtctgttgcgaaagtctgagttcccaataaaatataaatactgtaaaattagtgaagcaggagtctcttcattggagttcggtccgaacagggaggctgatgtggatctatcatcacccaagccatccagatacgtcctcttgtctgatggtgcccttcgggaatcaccatggaggggtgcaggtgttgctgtacctatattctcgatcaggtcaaatgaggaccttggtgttggagaattccttgatcttaaacttcttgttgactgggcagtcaactcaggctttcatcttgttcagcttcttcctatcaatgatacttcagttcacgggatgtggtgggattcatacccatacagctcgctctctgtgtttgcattgcaccccttgtacctgagagtacaagcactttcagatgcaattccaggggatattaaggacgagatttcacaggcaaagaagcagttggacaaaaaggatgttgactatgaggcatcactggcctcaaaactctcgatagcaagaaaaatattcaaattagagaaagacaaagtactaaattccagttcgttcaagcagtttttatctgaaaacgaggagtggttgaaaccatatgctgcattttgttttctgcgggacttctttgagacatcagatcacagccaatggggccgtttttctcagttttccaaggagaagctagataagcttgtttctgaaggtaccttgcaccatgacgttatatgtttccattactacatccagtaccatctatatatgcaattatcagaggcagctgcctatgcaaggaagaaaaaggttattctgaaaggagatttacctattggtgttgataggaatagtgtggatacttgggtataccccactttatttcgcatgaatacagctactggtgcacctccagattatttcgacaaaaatggacaaaattggggttttcctacatataactgggaggaaatgtcaaaggataattatgggtggtggcgagctcgtctgacacagatggcaaaatacttcactgcatataggatagaccatatcttgggtttctttaggatatgggagcttccagatcatgcagccacaggtctagttgggaaatttaggccttcaattgctctcagtcaggaggagcttcttagtgaaggcctatgggatttcgatagaatgagccgcccttatattcttcaggaaacactggaggagaagtttgggtccttttggacagtaattgcagctaactttctaaatgagtacaagaaacaacattacgagttcaaagaggactgcaatacagagaaaaagataattgcaaagcttaagaacagttctgaaaaatcattatggctggagaaagaagacagcattcggcgtggtttgtttgatctactacagaatatagtccttattagagatccagaggacagcacaaaattttatccccgcttcaaccaggaggatacttcaagttttaacgatctagatgaacatagcaaaaatatcctcagaagattgtactatgactattattttgctcgccaagagaatctctggcgtcaaaatgcgctcaagactctgcctgtgcttttgaactcatcggatatgttggcatgtggggaagatcttggccttatccctgcctgtgttcaccctgttatgcaagaacttggattgattggattgcgtatccagagaatgcccagtgaaccaaacttggaatttggtattccatctcagtatagctacatgacggtttgtgctccgtcatgtcatgattgctccacattacgtgcttggtgggaagaagatggaggaagaagaagccgtttctaccagactgtaattggtagtgatgacgagccgccatctcgctgcaccccagaagtagcgaactttattgttaagcagcattttgatgctccatcaatgtgggcaatcttcccactacaggacctgcttgcacttaaagacaagtacaccacaagaccagcaaaagaggaaacaatcaatgacccaactaacccgaagcattattggagattccggctacatgtgacattggattcgctgttggacgataaggacatccaagcaaccatcaaggaacttgtcacaagtagtgggaggtcatttcctggtaaggtggatggcgccgaagaaagcggagagaagctagctaaagtccagttgaatggtaaaccatagaaaattatcccaagaacagccgaagggtatcacggtcaaaagtaaatagaataaggcagcgtactgccaattggcatgccagttcagctggtgttgtttcagctagaattttttttacgccaacttaattccatttaacactggaaataattagtatcattcatcaagtcggcatgtggaataatttatcccctgttctttgctaataaaatctttttctgatgaatcatctgtttgctagtactg

SEQ ID NO: 182 - DNA, 1561 bp, Oryza sativa
agactggcagttggggaggtagccgaagcgccgagaaaaatggccacgcggccactcgctgcctccactcttcttcctcccctccgcttctgctcccctctcaaaaccccacctccctctcctcctcctcctcacctccgccgcctccaaaccctaacccgcgcgctcgcctcctcctcctcagccatggcgtcgccgcccgcgaagaaggtgctggtgccgatcgcgagcgggacggagccgatggaggccgtcatcaccgtcgacgtgctccgccgcgccggggccgacgtctccgtcgcctccgtcgaccccggctccgcgcaggtcggcggagcctggggcgtcaagctggccgcggacgcgctgctcgacgacctcgccgacgccgaattcgacctcatctcgctcccgggaggtatgccagggtcttccaatcttagagactgcaaacttctggagaacatggttaaaaagcacgcaggaaagggcaaactttatgctgcaatatgtgctgcaccagctgtcgctctaggatcatggggtttgctgaatggattgaaggcaacttgttatccttcattcatggataaacttccttcagaggtcaatgctgtagaatcgagggtgcagattgatgggaactgtgtgaccagtcgaggaccaggaacggccatggagtattctgttgttttggtcgaacaattatatggcaaagaaaaagctgatgaagttgctggtccaatggtcatgcgcccccagcatggtgtggagttctcattgaaagagttgaattcaactagttggaatgttggtgaaacacctcagattcttgtaccaattgctaatgggacagaggagatggaagcaactatgataatcgacatcctcagaagggcgaaagcaaatgttgtcgttgcgtccttggaggaaactttggagattgttgcatccaggaaagtgaagatggttgctgatgttctgttggatgatgctcttaagcagcaatatgatctcattttgttaccaggtggtcttggtggtgcccaagcatatgcaaagtcagataaactgattggtctgatcaagaagcaagctgaggcaaacaagctatatggagctatatgtgcctcgccagcaatcgcccttgaaccacatggcctgctgaagggaaagaaggctacatcctttcctggtatgtggaacaagctctcggaccaaagcgaatgcaagaacagggttgtcgttgatggcaacctaatcaccagccaaggtccaggcacatccatggagttctctctcgccatcgtggagaagctgtttggtcgggagagggccgtcgagctcgccaaaaccatggtcttcatgtgagttgtgttgttacatactacgtgtaagacaacaccatagtcagactctgaatatgaggcatccttttgctcgtagctggtgtggtggaaagcacttcgtaatccttttttttggctttctcttccacaataacacgacgtcttgttatgtgtacaaccgtacaaatgcaataaaaagagatggatattgc

SEQ ID NO: 183 - DNA, 1303 bp, Zea mays
gaaagactattcccctcaaccctccaaaagaagagaggactgttgaaacttggatgccatggcatacgtccacacgccaccgtaccagtcgagatcaagacggcaataatagacaagaacaaggtgcgtggcagtgcactcgacgatattaatggagctgctttgcacgggcggcagacagccgtagacagagcagtgacggtcgtcgtacacagatcacgatgctgctcccacactcttcgtcagcctctgcaactgctaccactcgtgggctagcactagcagcagcagcaccgccgccgcgtccgaccgctcgcccccggcgcgcacgcctcctgcctccacgcgcgcgggccgagacgcatgcgacgggcgttggcgccgaccgcgcggccgaggcgcttctccagagcgggctgcgccgtgagtcgctgccgcggcacgtcgcggtggtgatggacgggaactcgcggtgggcgcgcgagcgggggctgacgcccgcggacggccacaaggccgggggccgcaacctggagcgggtcgttgcgctgtcgcgcgcctggggcatccgcgcgctcaccgccttcgtctgctcccgcgagaacttgagccgccccaaggccgaggtcgactacatgatgggcttgtccgagtggctgataggcgacaacatcgacaagctctcgaggcaggggatccgactgcaggtgatcggcgacgccgcgaagatgccagcctctctgcggagcgcagcggcgcaggccgacgaggccacgaggcaaaactcgcagctgcacgtgatgctggccatctgctacagcgggcgatgggacatggtccaggcgtgccgggagctggcccgggaggcgcaggcgaaccggctcagtccggacgacatcgacgagtcgatcatcgccggcaagctcgcgacgagcgccgccggcgagttctcctgtcccgacctggtcatcagaaccagcggcgagatgaggctcagcaacttcttgctatggcagtcggcgtactcggagttgttcttcaccgccaagatgtggcctgactttggggaggctgagtacctggaagcgttgcgctccttccagggcagagaccgccgcttcggccaatcaaaattactctaaggcctcgtttggtttaagagtccctctattttagttttatttagttcctaaattgtcaaacagtaggattaaaacagagactaaactgatttagtctctagtctctcaagatgtggttaaaaagactaaatcatattaattctacatttgtccttcattta

SEQ ID NO: 184 - DNA, 1763 bp, Sorghum bicolor
cccgcccgcccgcatcgccatggctctcgccgtccgcacgccccgcttccagcctcgacggacctccatttctgcgcccgcaccacccgcctcgacatccctcgccgccgcgaacgcgagggcccgtgcctgcgcacgcgccgccgtccgagcctcgcccttcaccgagggcacctcctcctcgcgctaccgccgagacgcctggtcctacgccgccgccgatggctcctccagctccgcatccccgtcctcttccgatgctgccgctgccgccgccgctgcggcggcggcggcggcccgccgggacgacgagatcgcgctgcagctgccggagctgcggaggctcctggacgcgctgagggcgtccagggggaaaggcgccgagggggcagacggcggcggcgggcccgggagggtggcgctggtggggacagggcccggggaccccgagctgctcacgctcaaggcggtccgggccatcgaagcggcggacctggtgctctacgacaggctggtgtctaacgacgtgttggacttggtcggggagggcgccaggctgctctacgtcggcaagacggcgggataccacagccgcacccaggaggagattcacgagctgctgctgagctttgccgaggctggtgccaatgttgtccgcttgaaaggtggcgatcctctggtttttggaaggggcggagaagagatggatttcttacagcaacagggaatcaaagtcgaagttatcccaggaattacttctgcttcaggaattgcagcagaactaggcattccgctaacccatagaggtgttgctaccagtgtcagatttttaaccggacactccagaaatggtgggacagatccactacatgtagctggaagtgcagctgatccagacactactttggttgtgtacatgggtttgtcaacacttccatcactcgctccaaagttaatgaagcacggcctgccgccagatacccctgctgttgcagtagagcgcgggactacacctcaacaacgaacggtgttctccttgttaaaggatcttgtggatgaagtcaagtcagctgatctagtttctccaactctaataattatcgggaaagtggtatccttgtcgcccttctgggtggagtcatctgaacattatgcactgaaaattgagagctcttatacaaatgaaaccagatgatagcacgttttcctgattttagtgattggacaatacttaagtaatgaaatatcccagatacgagcagttccaattgagatccatttaggaaatgcaagcacaggttcgacctggtgtacacaaaacatttcaggaagcatggattctgaatgatggatggcttaagcccataacagcattgggacagaagcgcacttcgactgatcatgctttgactctttggcctatctacctgagatccacaaatttttgatttagttgttcgacaataattgtgtgcttctgtattgctttggtgggaattgctttgatcccctttcttctgttgatgaagaggtcatgtctggaggcttgagcttcagtatatagacgcatttcaattcagtgtggtctttgtcagagaagtctcggtagatgtatgttttcattctgacttgtggcccattcggagcgcaggattttacagaattcgacaataagtagttatattttttgtggaaaataggaaaattcctgctccccaaattcctgactgtaaggattttttggtcatctttaaaataaatat

SEQ ID NO: 185 - DNA, 1793 bp, Triticum aestivum
ccacgcgtccgcgccttcgcccattccaacctcctccggctcgctctcgccgccgccggagtcgggcggaccgcggcgagtttcccgccagcttcgtgggatcggagtatctccgcgtcgggctgttgtttcgccggtgctccggtggagtggaacccccgtcgggggcggcgcctcgctgagaccgccggtttcggcgctccctctcctgccgcggttcaggatataatctctgctgttgaaggctgatgattgctgttattgaacatgaaggatgatgtgtctgtgattagatcgatattaaattgatatctctaacaagtgaatcacagtacagaggtttgtattgtagctcgagaattgaaacaacttggtaatgagttgtttttctcgcattttcaagaggacgagcgggggtcagcaacaaactggtccactcaatgaggacctcccgggtgttgagaacataacaagatttagctataaggagttggatagggcaactgcaagatttgaccaatccaataagattggtgagggaggttatggaccagtttataagggaacactcagggatggaacagccgttgcagtaaaggtgctctctttgcagtctaggcaaggcgcgagggaatttcttagtgaacttattacgatctctgatatttcccatgagaatcttgtcaagctttatggctgttgtgtggaaggaagccacaagatccttgtctataattatcttgaaaataatagccttgcacaaacccttctaggttctcagcagcataacagcatccagtttaactggagaactcgagtgaatatttgcattggtgttgcccagggactagcatacctccatgacggtgtccgacctcatgttgtccaccgggacatcaaagctagcaatatacttctggaccaggatcttaccccgaaaatttccgatttcggcttagcgaagcttctaccttcagatgtatcacatattagcacaagagtcgcaggaacgctaggttacctagctcccgaatacgccatacgaggacaagtgacccggaaatcagatgtctacagcttcggcgttctgctgatagaaatagtcagcggaagatgcaacactgacacaaaactaccctacgaagatcagattcttcttgagaagacgtgggcatactacgaccaagggcagctggacgagatcatcgacagctccctgggcgacgacctggacgtggacgaggcgtgcaggttcctgaaggtggggctcctgtgcaccaagaacgtgacgaaacggcggcccgacatgtcgatggtgacccggatgctgaagggcgaggaggacgtggagtcgcatgagatcaccaagcccgacgtgatccgggacttcagggacctgaagctgaggagcaaggccacgtcgtcgtcgctgctgacctccatcgtggcgcgctcctcgccgtcgtcgtcgtcgtccaccggcaacaccacccgcacctccatcaccttcaccgccatatcggaccgcccctgaccgaagaggcgcgcgggaggaaaatagacacgaagagactgcagagaaaactgtagatagccgtagcgcagcccaggtttttcctcttttcttgtggtttgtatggtctgtgtggtatagtagccttcatactttcattcactttactcttttttttggcggggcacttcacttgattgtttctctgtataaaagggttataccgattttttatttatcaatagaaaccaagctcatgtagttcacggcaaaaaaaaaa

SEQ ID NO: 186 - DNA, 1502 bp, Triticum aestivum
aagatccaaatcttctgtagcgacttgatccgatctccagccgacgccggcgaccatggctcgccgtcaccacctcctcctcctcctccctctcctcgcgctcgccttctccttcgtcgccgccgcccctgagggacagggagatgccgccgccttcatcgacggcgcgtcgcaccgctacctgcgggatcagcagggcgaccaggccacgtcgatgtcacttgatgaagtttccgcagctgtttctgtcttgcttggttttgcaccacctgccatgcttcccgcgccttcttctgcaaagttaaacgagctgctactcccaaagccatttgacaggcctcgtgctgttttcttgatgcaaattgatgggtcccatgactctgtcgatagcttcgtatctgatgccggtagtatttacaaaaccaagattgatgttgcaaaaaatgctgctacagggcttacagatagggatgaattgattgtcattcgttcagatgaatcttctggatcagatgttcttgataatgaactcaccaacttggcaacctggttggagggatcctatcagaaggctgatagcaaattaatcatcccattgaagagtggaaacagtcttactttgctcctcaataaggaagtagacgttgaatttgcatccagcttgatctcccttctcaaaaccatcaaaaggggtattcaggttcacgaagatttctcaggaggcattgtgagccctgcagagttattagtatgccacttcacgggcattaaggctctggaagatgaatatggttccgcagaaattgtcaagcagggagtggaagtagttcaaacagctctcaccaaagcatttgatcaattgcagggagcatataatgggaaaattgttgggctggtaatatccaccaaggaggcttcaacatccttggcatccatcatcgatgcaccgtcttcattgcatatctcaagacggcttgcagaagcatctaaaactaatgctacagcttctatagctgctatatatcttgttagattgagtcttgcatggattacagggatcatctttcttgtgtcaactctcattgggatttgcctgctcatgaacatgccgcttaccagggacacgctcctctattcgaatgtcaagatggattagtttgtgctacatatgaattttcgcacgatgtcattgaagttgtcaacagtcatgcgtgtttttattctttggaccttgggtttacaatagggacgctgagtgtgggcttgctgctcacccagtgcagcataaaaatactctgttgctatgtggacccttcatttagaattgtactgccactgcctgcatgggcttctctcgtttccccgtaaataaataaaaaacaatcgagaggagtgtattttgttaatatcagcgaagattgtactatattgttgtaaaaacccagtatctgaataaattcgccacttggatattcattgggatagctgttgtcttcatatat

SEQ ID NO: 187 - DNA, 677 bp, Sorghum bicolor
gccaagaaagagagagactgacagcaaaaggaagaatccgatcctgaaccattcatgcagcatggcagcctcagtcatggcctctttgtctctgaaaccatctccatttttggatcggtcgaggttcacaagtgtccagccatcagcaagatcttcaaccttcagagtaatggccaagaaaacaaagaagatcaaaacatcccaacctttcgggcctgcaggagggttgaacttgaaggatggtgttgatgcatctggaaggccagccaaggggaagggtgtctaccagtttgccaataaatacggagcaaatgttgatgggtacagtccaatatataacccagaagaatggtctccaagcggtgacgtttatgttggaggaaagacagggttgttgctctgggcagtcactcttgctggaatattgctgggtggtgctcttcttatttacaatactagtgccctggcttcttgaagcctggctgcagcaaataaaattatgtgccatgcagtgtcacgtagatatatctgtatccaggtgtccctagatccgtaggatatgcgaatgaaaaatccataaagaagtaacgttgctatgtgctgtacaatgtgacaaactgaagaaactcagtatgcaaaagaaacctatggcttcagctaagaaggctgtagtccca

SEQ ID NO: 188 - DNA, 715 bp, Hordeum vulgare
attcggcacgaggaaaaaggaagagcgagagcttactgtcattcatggcaacctcgaccatggcttttatgcctctgaaaccatctccatcgacattttctgggcattcgcagctccagcgcatccagcctttcacacgatcatcatctttcagagtaatgtccaaaaaggcaaagaaagttcagacttctcagcctttcgggcctgggggaggattggaattgaaagatggcgttgatgcatctggaaggccagccaaggggaagggcgtctaccagtttgccagcaagtacggagcaaatgttgatgggtacagcccgatatataacccagaagaatggtctccaagtggtgattactatgcgggaggaaagacagggttgttgctctgggtggctactcttgctggaattctgctgggtggtgctcttcttgtttacaatactagtgctttggcttcttgaagcctggtatagcaagccaaactatgtactgtaccatgcaaggatttacatcatctagggtagatattcgggcacctatatccctaggcttaattaccaaaaataatggtcttatatgttgtgcaactgatgtaatcaaggctaaataatcagcaaatttctatgccgtgggctaacaaggcagtgcatgtgagtgcagagagtctgacttgaacaaaatagctgaacatgaaacaactgaaatatgggac

SEQ ID NO: 189 - DNA, 1640 bp, Solanum lycopersicum
ccgggtggatccactcgagcctattaatctgtgcaaacccttgtaatttcatcaagtctaaaagccttttggtatctttactccaacaatggcggctacacaccttgtctcacactctccatcacttcacaagtccctcaaatacccatcaaatgcatcacaaaaactttcttttttcaaacccaattttccgttgaagcccatttcaagaaaccttagcataagggcatctgtatcaacttctgagcctcaaactcagaaatttcagcattgtttcaagaaatgtgaagatgggtttttgtattgtgagggtgttaaggttgaagatgttatggagactgtcgaaagacgacccttttatttatatagtaagccccaaattactaggaacgttgaggcttataaggccgctttagagggcttggattcaattattggttacgctattaaggccaacaataatctcaagattttggaacatttgaggagccttggttgtggagctgttttggttagtgggaatgaactcaaattggcacttggtgctggatttgatcctaccaagtgtatttttaatggaaatggaaagctgttagaggacctagtgctagctgcccaagcaggtgtgtttgtaaacatcgacagtgaatttgacttggataacattgtagcagctgcaagactggctgggaagaaagttaacgtgctactcaggattaatccagatgtagatccccaggttcatccttatgttgccactgggaataagagctccaaatttggcatcagaaatgagaagctgcaatggtttctagatgctgtcaaggcacatcctcaggaattgaaacttgttggagctcattgtcatcttgggtcaactatcaccaaggtagacatttttcgagatgcagctgccttgatggtgaactacattgacgaaatccgatctcaaggatttgaaattgattacctgaatattggaggtggtttagggattgattactatcatgctggagctatccttccttcacctagagatcttattaatacggtacgagaattagtcctttctcgaaacctcaatctcattattgaacctggaagatcactaattgcaaacacatgctgcttggttaacagagttactggagtgaaaaccaatgggaccaagaactttattgtgattgatggtagtatggctgagcttatacgtccaagtctttatgatgcttatcagcacatagagcttgtttcccctccacctccggaagctgcaattgctaagtttgatgttgttggtcctgtatgtgagtcggctgatttcctggggaaggaccgtgaacttcccgccccttctaggggcactggtttggtagttcacgatgcaggtgcttactgcatgagtatggcatcaacttacaatctcaaaatgcgcccaccagagtactgggtggaagaagatggatcactgtccaaaatccgtcatggggagacattcgaagaccatttaagattgtttgaaggtctgtaaacttatggtttcttttaagcacttaaacatgacaggatgtgagactcagaaattcctctggtagtttggttcctgtcagtgttgagaattcataggccttggtaccatt

SEQ ID NO: 190 - DNA, 1815 bp, Sorghum bicolor
ccagggtggccgggccttggctccgccggtgatcttgggggttcccatgggcggatgcttctcgcaggaggagcaccggctccagagcaggccagctgaagctgctggaccagacggactgaggaagtctaaatccgattctaaagttatagcaagtgttcttgctcctccaaaagatgtggtggacctgcaagtagaaggatatggaaatgtgaatattttcacatatgatgaattgagagcagccacaaaaaactttcgaccagatcaaattcttggagagggtgggtttggagttgtttacaaaggtgtaattgatgaaaatgttagagcaggtttcccatccagacaggttgctgtgaaagaactaaacccagagggctttcaaggggacaaggagtggctggcagaagtcaattatcttgggcaacttagtcatccaaatcttgttgaactgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgcgaagctttcagactttggtctcgcaagaacaggtcctagtggagaccagacccatgtgtcgactcgggtcatgggaacttatggatatgcagctccagaatatgtcatgactggccatctgacggcacgaagtgatgtttatggctttggagttgtgcttctagagatgattattggaagaagggctgtagacaagagccgaccgagccgtgagcataacctagttgattgggcacggcccctcctcgtccataacaggaagctgttccgaataatcgatccaagaatggaagggcaatactccaccaaggctgccattgaggtggcaagccttgcataccgctgcctgagccagaatcccaaaggacgaccaaccatgagccaagttgttgagacctttgaggcggtgcagaacatgcctgaatgccaagacatactcctccagaacagtatcacaggtgccgtgacgctctatgaggtcccaaaggagcctgcagacagagttgaattggagaaggccaagcaggaaccggcagtaaagaccaccgcaatgccaccccccgtgaatggaaagccagtcccccagagcaggcgaacacggcctgggaatggccggagcaagagcgagccatcgttggagtgtaagatgtacatcccgtcaccagactctgacggacagcagctcggcctggaggcactcgcatccccaaatggaagcataaaggaccctcctgatgaggatttgtacaagatataacaccagagcagttttttttcgacaacgtgagccctcgttgcttgccttttgtgccttcaccccctgttctcaaagatcagccagttataaatttttctctgatggccaccggccacgctagggttcctattcttccgattagcaattgtatgtagaggagagttgtgatggaaagcatgtgtgagtgcctgccaacctgatacacttatttccggggcggatttccactccaaaaatggaagtggagagatgtgtcctgacaattggtgccgttacccgtctgttgagttacttgtaaagatgcttgttctgagttgtaatcttgaacagtcctgcggggaatcaacaacaccatggaaattgataga

SEQ ID NO: 191 - DNA, 878 bp, Hordeum vulgare
acgcaggccgtcgctagccatcttccaagaatggcgccgcaccatcttgccctcctcctgctcgccgtgctgctccgggcggcggccacggccgacccggacgcagtgcaggacttctgcgtgccggacgccggccccggccggccggtggagctcaacctgatccgctcctacccgtgcaggagcccgggcaacgtcaccgcgggcgacttcgccttctccggcgtgcgcgcggcgggcaacttctcggcggacacggggttcgcgggggtgtcggtcacgccggcgcagttcccggggctgcacaccctgggcatgtccttcgcccgcgccgacctctctgcggccggcggcgtcaacccgccgcactaccacccgcgcgccaccgagacggcgctcgtcctcgccggccgcgtctacgccgggttcgtcgacacggccggccgcctcttcgccaaggtgctcgtggagggggaggtcatggtgttcccccgcggcatggtgcacttccagctcaacgtcggcgaccagccggccaccgtctacggcaccttcaacagcgagaaccccggcatcgtgcgcatcccggccaccgtgttcgggtcagggatcaggggcgccgtccttgagagggccttcgggctcaccgcggaggagctccggcggatcgagaagaggttcggcgtgcccaagaaggccgacgagctggaggactagctagttaattcgtttattagtgatggctgatgagtacttggttcgttgctggtcggccatggccgcatgtgcatgattagtcgacaggtagactcttgtgggttgagagtatgggcgatacttatttcttttccatttgattaatatatatacttatggat

SEQ ID NO: 192 - DNA, 939 bp, Oryza sativa
gcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccgcattcctgttaggacttaggagaagtaatgtcaggagtattagcaaaattcgctattgcatctgcggtgatgtggacagctccagttgccatcgtgtatggattttactaccagatgattccaggtgtgagtcaactgtcatcctcgacgcaaactctagcaagtggattccttgctgttatatcgattaatctggtaatcggcttttatatatgcatggcgatgaaggagactccccaccaagagccacaacctgatccaaccttcttggcaaatgctaaagcaagcattgatcaaccaactccgtctcaagtgaatgatgattcccatggaaagggaaaggtggagtaggtcatatcacaacatgtgcatgtttcacatgttatccagaaacagttcttctcgataccctgccttctaattcaatattatcttctgtaaatcttgagaattatggaaccaatatgagttttaccttttgtactgttattatcgagatactgtgttagaattatttttgtttggctgcagagaactactttggctggctgtatttaagtcaatttcgtttttcttcaatgtggtcagagatctcctttagcatacatttaataagataaatattatatctatttagtta

SEQ ID NO: 193 - DNA, 3812 bp, Arabidopsis thaliana
ctatgttcctaacacttctctcaacctttatctgatcgcaccaaaccagttttttcgcatcggcttcttccttttgctactagctctcctctcttctccgaaaatggcgttacaaaacaaagaagaagagaaaaagaaagtgaagaagttgcaaaagagttacttcgatgttctcggaatctgttgtacatcggaagttcctataatcgagaatattctcaagtcacttgacggcgttaaagaatattccgtcatcgttccctcgagaaccgtgattgttgttcacgacagtctcctcatctctcccttccaaattgctaaggcactaaacgaagctaggttagaagcaaacgtgagggtaaacggagaaactagcttcaagaacaaatggccgagccctttcgccgtagtttccggcttacttctcctcctatccttcctaaagtttgtctactcgcctttacgttggctcgccgtggcagcagttgccgccggtatctatccgattcttgccaaagcctttgcttccattaaaaggcctaggatcgacatcaacatattggtcataataaccgtgattgcaacacttgcaatgcaagatttcatggaggcagcagcagttgtgttcctattcaccatatccgactggctcgaaacaagagctagctacaaggcgacctcggtaatgcagtctctgatgagcttagctccacaaaaggctataatagcagagactggtgaagaagttgaagtagatgaggttaaggttgatacagttgtagcagttaaagctggtgaaaccataccaattgatggaattgtggtggatggaaactgtgaggtagacgagaaaaccttaacgggcgaagcatttcctgtgcctaaacagagagattctaccgtttgggctggaaccattaatctaaatggttacatatgtgtgaaaacaacttctttagcgggtgattgtgtggttgcgaaaatggctaagctagtagaagaagctcagagcagtaaaaccaaatctcagagactaatagacaaatgttctcagtactatactccagcaatcatcttagtatcagcttgcgttgccattgtcccggttataatgaaggtccacaaccttaaacattggttccacctagcattagttgtgttagtcagtggttgtccctgtggtcttatcctctctacaccagttgctactttctgtgcacttactaaagcggcaacttcagggcttctgatcaaaagtgctgattatcttgacacactctcaaagatcaagattgttgctttcgataaaactgggactattacaagaggagagttcattgtcatagatttcaagtcactctctagagatataaacctacgcagcttgctttactgggtatcaagtgttgaaagcaaatcaagtcatccaatggcagcaacaatcgtggattatgcaaaatctgtttctgttgagcctaggcctgaagaggttgaggattaccagaactttccaggtgaaggaatctacgggaagattgatggtaacgatatcttcattgggaacaaaaagatagcttctcgagctggttgttcaacagttccagagattgaagttgataccaaaggcgggaagactgttggatacgtctatgtaggtgaaagactagctggatttttcaatctttctgatgcttgtagatctggtgtttctcaagcaatggcagaactgaaatctctaggaatcaaaaccgcaatgctaacgggagataatcaagccgcggcaatgcatgctcaagaacagctagggaatgttttagatgttgtacatggagatcttcttccagaagataagtccagaatcatacaagagtttaagaaagagggaccaaccgcaatggtaggggacggtgtgaatgatgcaccagctttagctacagctgatattggtatctccatgggaatttctggctctgctcttgcaacacaaactggtaatattattctgatgtctaatgatataagaaggataccacaagcggtgaagctagcgagaagagcacgacgcaaagttgttgaaaacgtgtgtctatcgatcattttaaaagcaggaatactcgctttggcatttgctggtcatcctttgatttgggctgcggttcttgttgatgtagggacttgtctgcttgtgattttcaatagtatgttgctgctgcgagagaagaaaaagattgggaacaaaaagtgttacagggcttctacatctaagttgaatggtaggaaacttgaaggcgatgatgattatgttgtggacttagaagcaggcttgttaacaaagagcgggaatggtcaatgcaaatcaagctgttgtggagataagaaaaatcaagagaatgttgtgatgatgaaaccaagtagtaaaaccagttctgatcattctcaccctggttgttgtggcgataagaaggaagaaaaagtgaagccgcttgtgaaagatggctgttgcagtgagaaaactaggaaatcagagggagatatggtttcattgagctcatgtaagaagtctagtcatgtcaaacatgacctgaaaatgaaaggtggttcaggttgttgtgctagcaaaaatgagaaagggaaggaagtagtggcaaagagctgttgtgagaaacccaaacagcaggtggagagtgttggagactgcaagtctggtcattgcgagaagaagaagcaagctgaagacattgttgtcccggtgcagattattggtcatgcattaacgcatgtggagatcgagttgcagacaaaggaaacctgcaaaacaagctgttgtgacagtaaagaaaaggttaaggagacaggtttgctgctttctagtgagaacacaccttacctggagaaaggagtgctgattaaagatgaaggaaactgcaagtctggcagcgagaacatggggacagtgaaacaaagctgccatgagaagggctgcagcgatgaaaaacaaaccggggaaataactcttgcttcggaggaagagacagatgatcaagattgctcctcgggatgttgtgtgaacgagggaacagtgaaacaaagcttcgatgagaagaagcattctgtgttggtggagaaggaaggtttggacatggaaactggtttctgttgtgatgccaagctggtttgttgtggaaacacagaaggtgaagtgaaggagcaatgtcgtctggagataaagaaagaagaacattgcaagtctggttgctgcggcgaggaaatacaaaccggagaaatcactctggtttcagaggaagagacagagagcacgaattgttccacgggttgttgtgtggacaaagaagaagtgacacaaacctgtcatgagaagcctgctagcttggtggtatcaggcttggaagtgaagaaggatgagcattgtgagagctcacacagagccgtcaaggtagagacctgttgcaaagtgaagattccagaggcttgcgcatcaaaatgtagggacagagcgaagcgtcacagtggtaaaagctgttgcaggagttatgcaaaagagttatgcagccaccgccatcatcatcaccaccaccaccaccatcaccatgtgagtgcttgatggagattgattgaataacttaaactcttgatgcatccatctattcacattacgtttagtctcattccgtgaatgccgaaataaaaaacaaaatgttccagcaaaggcagtttattagattaagcaactgtgttattcataaagacaatgctagtgatttttttttagtactttatgtattgcaattcct

SEQ ID NO: 194 - DNA, 4139 bp, Solanum lycopersicum
tatccccttagaaacacaacaatttaaactcttggaagagaaaagaaaaaaaaatgaaagaaagtgagaaaattaataatgatataaataagctaagcaagagctattttgatgttcttgggatttgttgcacttcagaagttgttttggttgagaaaattctcaagaatcttgatggtgttagagaagtttcagtaattgtcacaacaaagactgtcattgttactcatgatgctcttctcatttctcaacaacaaattgttaaagcattgaatcaagcaagactagaagcaagtataagagtgaaaggattgcaaaactaccaaaagaaatggccaagtccatttgcaattggtagtggaattttgcttgctctttcatttttgaagtatttttaccaacctctccaatggttagcacttgttgctgttgctgttggaattccccctattatttttaggggtattgctgccatacgcaacttcacacttgacatcaacattcttgtattaattgcagttgctggatcaattgttttacatgattattgggaagctgctactattgtgttcttattcactattgctgaatggctagagtcaagggcaagtcacaaggctaatgctgttatgtcatcactggtgaatatagtccctcctacagcagttttagctgaaaacggagaagtagtaaatgttgatcaagtcaagttgaatagcgttcttgctgtgaaagctggtgaaactataccgattgatggaattgtagtcgaaggggaatgtgatgtggatgagaaaactttgacaggggagtcatttccagtttctaagcaaaaagactcaacggtctgggctgggactacgaatctaaatggttatatcagtgttaagactacagctctggctgaagattgcgcggtggctaggatggcgaaacttgtagaagatgctcagaacaagaagtcaaaagctgaaagatacattgacaaatgtgctaagtattatacaccagtaattgtggttatagctgctggtttcgcaatagttccgacagcattaagggttcacaaccttaaagaatggtatcggttggctttagttgctttggtgagtgcatgtccatgtgcacttgtgctatctacaccagttgctatgtgttgtgcactttcaaaggcagcaacatcagggcttctgttcaaaggagcagagtatcttgagactcttgctaaaataaaaatcatggcttttgacaaaactggaacaataactcgaggagagtttgcagtgaccgagttcaggtctctcattgatggccttagcctcaatacacttctttattgggtttcaagcattgagagcaagtcaggtcatccaatggcagctgctcttgtcgactatgctcaatcaaattccgtcgagccaaagcctgatagagtggagcagtttcaaaattttactggtgagggaatttatggaagaattgatggaatggaaatctatgtagggaatagaaagatttcttcaagagctggatgtactacagtgccagaaatagagggtggtgatagtttacaaggaaagtctgttggatacatatttttgggatcctctccagctggacttttccgtctttctgatgtttgtcgtactggcgtaaaggatgcaatgagagaactgaagcagatgggaatcaaaactgtgatgctcactggtgattgttatgcagctgccaaccatgtgcaggatcagttacatggagctttggatgaatttcaagcagaactcttacccgaggacaaggcaacaatcattaagggatttcagaaggaagctccaacagcaatgattggcgacggacttaatgatgctcctgcattagcaacagctgatattggtatctcaatgggtatctctgggtcagcgcttgcgaaggaaacaggacatgttatactaatgacaaatgacattggaaggataccgaaagctgcatgtcttgctagaagagttagaaggaaaataattgagaatatgataatagcaattggtacaaagggtgccatagttgcattggcaatagcaggtcatccgttggtttgggctgctgtcctcgcagatgctgggacatgcttgctagtgattttgaacagcatgctactgctgcgaggagctacacgtagacatgagaaaaaaatttgtaaatcttctacttcctctcatgctcaccaccacaaagacaaagcttcttgttgcaagtcggaaaagactcctcaacagtgttgctctgatattgagtcacaaaaagaatgtagaaagaaatcatgctcttccgaggtgtgtgttcaaagatgtcaacctatcccctcaggatcaacatcatgtgtaaatgatcagcgctcggactccactcaaaataatggtcatcagtctcattcgcatcctcagtgctgctcatccaagatgtctgttacagcatgccaatctgcagtttcagaatcaaagtcatgcggaagtaacaattgctcagactccattcgcaagagtagttgtcattcctcgacaaactccttaataagttcttcagatttgtcagctccacaatgtcattctgccacttcaagctccaaatcatgtggaggtaccaagcgctccaacttgagtgacaaaagttgttgtcgatctctagagattcctcaaacgtgctctaccaagaaggctgctcatggatgctactctgaagtttctggtcctaaatcatgtggaaatagcaagtgttctgactcaacagacaacaatatccatcattcacattctgatcgtcaaacatgcacgtccaaggtgtgtgctccacaaagcccatctgcaacttcaagctcaatgacatgtggaaatacgaagtgctcggacaccactagcaagatttcttgtcattcacatgctaactctgaaccatgctcttcaaagaagtctggtccaacatgccaaaatgctaactcaggttcgaggtcatgcggaaatcacaagtgccaagactctgcaaccgagcacggtgttcattcacttactgatccactctccgaggaagtgattctgaagcagaaaatcttggttttggaatcaaatcatgatcttagtcatggctgctgtgaagaggaacatgatcatcatccaaatttagacaaagcatatgacagttgtgcattacaagaatgtcattattcggttcaaggagatataactgacatatcaaaaactggaatccaggaaacttctcattgtgatagcaccaatcaaacatgccaaactgtaatttcaggctcaatgatctttggagataataagagcctggactctgtagacatccatgagtgtcattcacatgctcatccaccccacaaggaggaaccacatcattctgttggacatggctgttcggacaaggaacacgatcattcacatccagagaaagcatttgacagttgtgcaacacaagaatgttgtttttcagttcaggaccacagcattgacatatccgaaaatggaagtcaaggaactgatcattgtgacagcattaaacaaagcatggtcatcccatgtagctgcaaacatacaccacaagagaaggtaagtcactgtggatttcactctacaactatccctactgatgaagaactagcgaagctggttagaagatgttgcgattacagaccatgccacaacgtccgttctggctgcagaaatcatgctacagaatgtggtccaaccacccgatcaaccatcaatatcttacgggacaaccatcatcatcatcatctagactgcagtggtcgtaaggtttgttcgccaattgagaagagacacattggtggatgctgtgagagcttcagaaaagaatgttgccccaagaacattaatcattttgcatcaagttttggaggaggtttatcagaaattgtattagagtaagatgcaatcttaaaagtgtaaatatgttgcaacttttctacctattttatcttcaagaagctgagatgctattttgtatgaacttagctattaccatggcttgtatactaatcctaaaaatggtttgtgtatttgttgaattctaacaaagttgggaacttcaatgtcatttgcatg

SEQ ID NO: 195 - DNA, 986 bp, Hordeum vulgare
ggcagagcaccacagggtagctaccagtagcacatacactaacaatggcgatggcaagggtgcccatcctcgtcgccgtggccctcatggccgcgtcggcctcctgcagcgcatgggatcccaccatccggatggtcgacgacgcggtggcgccgctcatccacgcgctgcggccgctgctgggctccggcgggcacggcggcgtgccgtgcgacagctggaggctgggcgtggaggcgtacaacgtgcgggactggaagacggtgccggccaactgcgagggctacgtggggcactacatgctcggcaaccacttccggcgcgacttcaaggtcgtcatcgaccaggccatcgcctacgtcgacggcctcaagctcgccggcaacggcaaggacgtgtgggtcttcgacatcgacgagaccaccctctccaacctcccttactacgccacgcacggctttggggctaggccatacaacgcgacgagcttcgacgcgtacgtgctggaggggagcgcgccggcgctgccggagacgaagcggctctactacaagctactcaaggtgggcatcaagccggtgttcatcacaggccggacggaggacaagagggccgtcaccgtcgggaacctccgcagccagggcttctccgggtggatgaacctgacgctcaagcagcacggattcaagggctccgccatatcctacaagtccgccgagaggaagaagctgcaggacgccgggtacgtcatcgtcggcaacatcggcgaccagtggagcgacatcctcggcgcgcccgagggcgctcgcaccttcaagctgcctgaccccatttactacatcgcctagcggctgcggccatttggttgccccatgctcgtgctccacgaataataatcaagctccatgctctcttgatactccatggagtaattgttatctgcatgctcgatgcatcagtaataatccactgtgttttgttttttt

SEQ ID NO: 196 - DNA, 3838 bp, Oryza sativa
aatctcttcttgcttcctcctcctcctcctccagccgccgccgccgacgacgattcttggtagagagattcttgcgttgttttacctgcgtcttgttcttcttgggagttgggtggatcgattgatcgaggttttggaggttggaagaagtgtgtgttgtggtggggggtttgtagagagagagggcaaaggcacgcaaagagggagagagtgaggagagatggcggcggagggagggaggtgtcagaagagctacttcgacgtgctggggatttgctgcccgtcggaggttcccctcgtcgagaagcttctgcagccgctggagggcgtccagaaggtcaccgtgatcgttccctccaggacggtcatcgtcgtccacgacgtcgacgccatctcccaatcccaaatcgtcaaggcgctgaatcaggcaaggttggaggcgtcggttcgggcttatgggaacggcagtgagaagatcaccaacaaatggccgagcccgtatgttctcctctgcggacttcttctggtcgtgtcgctgttcgagcatttctggcacccgctcaagtggttcgcgctggtggctgcggccgccggcttgccgccgatcgtgctgaggagcattgcggccatccggagactcaccctggatgtcaacatactcatgctgattgctgttgctggagcaatagctctcaaggactattctgaggctgggttcatcgtcttcctcttcactacagctgaatggcttgagactagggccagccacaaggccaccgctgggatgtcagctctaatgagcatggcaccacaaaaggctattctggcagagaccggggaggtggttgcagcccgggatgtgaaggtcaatacagtaattgctgtcaaggcaggggaagtcattccaatcgacggtgttgttgttgatggacgtagtgaggtcgacgagagcaccctcacgggggagtccttcccagtgtccaagcagccagactcccaggtctgggctggcacactcaacattgacggttacattgctgtgaggacgactgctatggctgacaactccgcggtggccaaaatggcaaggttggttgaagaagcacaaaacagcagatccagtacacagaggctgatcgacacgtgtgctaagtattacacacctgcggtcgttgtcatggcaggatcagtagcagcaattcctgcaatagcgaaagcacataaccttaagcactggttccaattggctctagttcttctagtgagtgcttgtccatgtgcactggtactgtccacacccattgccaccttctgcgcgctactaagggccgcaaggacagggctgctcatcaaaggaggagatgtcctggaatccttggctagcatcaaagttgcagcttttgacaaaactggtacaattactagaggagagttcagtgttgaggagttccagccagttggtgaacgtgtttcattgcaacaacttctttactgggtctcgagcgttgagagcagatcaagtcaccccatggcatctgtcctggttgattatgctcaatcaaagtctgtggaaccaaaatcagagaatgttagtgaattccaaatatatcctggtgaggggatttatggtgaaatcgacggagcaggcatatatattgggaacaaaagaattttgtcaagagcttcatgcgaaacagttccggacatgaaagatatgaaaggagttaccattggatatgtggcatgtaacaatgaattgattggagtattcactctatcggatgcctgccgaactggatcagctgaggccatcaaggaactgagatcactgggcattaagtcagtgatgcttacaggtgatagtagcgctgctgccacatatgcacagaatcagctgggaaatatccttgctgaggttcatgctgaacttcttccagaggacaaagtgagaattgttggtgaactcaaggaaaaagatggccctacgctgatggttggtgatggcatgaatgatgccccggcattggctaaagctgatgttggagtctctatgggtgtatctggttcagctgttgcaatggagacaagccacgttgctctgatgtcaaatgacatccgcaggattccaaaggctgtccggctggcaaggaggacgcatcggacaatcatcgtgaacatcatattctcggtgattacgaagcttgcaatcgttgggcttgcatttgccggacatccacttatctgggcagccgtccttgcagatgttggcacatgcttgctggtgatcatgtacagcatgctgttgctgagagagaaggacagtcgaaaggcgaagaaatgtgctgcttctcatcacggatctccaaagaagtgctgttcttcttctcatcatggatctcatgcaaagaaaaatcatggcgtttcccaccattgttcggatggtccgtgcaaatcaatggtcagttgcaaagaatcatcagttgcaaagaatgcttgtcatgatcaccaccatgagcataaccatcacgaagagccagcccacaagcattcttcgaaccagcatggttgccatgatcacagccatggccatagcaactgcaaagagccaagcaaccagctgattacaaacaagcatgcttgccatgatggtcataaccactgcgcagatacgagcaatctgcacgacaccaagaagcatgactgccatggccatgagcatagcacctgcaaagaagaactcaacgctttgcctcccaccaatgaccatgcttgccatggccatgaacatagccactgtgaagaacccgttgctctgcactctaccggcgaacatgcttgccatgagcatgagcatgagcatatccactgtgacgagccaatcggctcgcattgcgctgataagcatgcttgccatgaccatgaacaggttcatgagcatcattgctgtgatgaacagcaaactccgcacaccgcagatttgcacccctgccatgaccatgaccatgacaacctggaggtcgaggaagtaaaggactgccatgctgaaccacctcaccaccacaaccattgctgccatgaacctcatgatcaggtcaagaatgatactcatccagtccaggagcactcgatctcgatcgaagaatcatcagaccaccatgagcatcaccacaacgaagaacacaaagccgaagattgcggacatcatccgaagccgaaagattgtgctccacctccaactgactgcatcagcagaaactgttgcagcaataccagcaaaggtaaagacatttgctcgagcttgcacagggatcatcataccagccaggccagccggtgctgcaggagctatgtgaaatgctccaggcccagcaggagttgctgcagccacagcatagtgaagctgcctgagatcgtagtggagtagtaggaaattcagcaatgtctgcacatatcatcagaaaatatagcaacctcgtcatcggcgaaatgtagaaaaagccgatgctgctatgcgtttgatctttttttttttagtcgtgctgcttttgcttcagctaaagaaaaaaatgttgtttgtagaggtgtctggttttgagacgaagcaggtgtttgaatcatgaaatgtataagcctgctttgtggttttctttcccggttgtgatcgaggcatcatctcctgtaagaatctgagaaggtgcatgaaatctgccatttctgggagcgggaggactagctggtgctgggattaacttgcttccaaaaactctttagattttgaaacatttgaccaacaattagtcaaatataaattaaattctattcgatgaaaacaatgtta

SEQ ID NO: 197 - DNA, 2120 bp, Oryza sativa
agtgaccaactgaccacttcccgccatgtcgccgccgccgccgcagcggccatccccctcccgcgcaggccgcgccaacctcttctcgtccccgccgcctcccctccccaactgctacgaccccaagcaccgccgccccgcgccgccgcctctcccctccgcccgtcgcctccccagcaaccgccgccgccgccacgaccagcctccgaatccgaccaccggcaatggcgggaaccccgccttccgcgcgccgcacctccgcaccgcctaccgcaagcccgtcccacccgtggcggcggcgggggagggcgaggcgctcctcgccgccgacgccagcgacgccgccgacgggcgggccgtggtggtggggccgtcggggctgtcgttccggctcccgggcgcgccgttcgacttccggttcagctactccgagtgcccccgcgccccgccggtggccatccgggagcccgcgttcctgccgttcgcgccgccgacgatgccccggccgtggacggggaaggcgccgctgctgaccaaggaggagaaggcgcggcggcggggcgtgcggctgcacaccccgctcggggaggaggcgcccaggacggtgagcgcgcacgggatcatgatggaggtgagggggaggaggaagctggacctggccagggtcagccccggcgacggcaggagcagggaggaggtgctcggcgagccgctcaccgccgccgaggtgcgcgacctcgtcaagccccacatctcgcacaaccgccagctcaacatcggaagggatggattgacccacaacatgttggaaatgatacattgtcattggaggcgccaggaaatttgcaaagtgagatgccgaggagttccaactgttgatatgaagaatctgtgctatcaccttgaggaaaaatcaggcggaaaggttattcaccgagtaggtggtgtagttttcttataccgtggaagaaactacaaccctcgaacccggcctcgttatccactaatgctttggaagccagctactcctgtctatccaaaacttatacaggaagccccagaaggtcttacaaaagaggaagcagatgaaatgagaagaagagggaaggatctgctgccaatttgcaaattagcaaaaaatggtatatacatctatcttgtcagggatgttcgagatgcttttgagggaagtgatctggtgaagattgactgcgaggggttgaatccaagtgactacaaaaagattggagcaaaactaagggatcttgttccttgtgttcttttgtcgtttgacaatgagcagatattaatgttcagaggcaaggaatggaagtccagatatccaaagcctctgactcttattccaaaaattcgaaagaataatgttccaatgtcatctgatgagagtagttcagatgaagccactgatgatgatgaccgtttggcagtaagagaagtactgagacctaaaatgtttgaactatggacaaatgcgattgagtcatctgtggcactgatgttggatgatgctgaagtggatgctcttacacctgattcccttcttacaagggtagaggacttcagtgttacatctcaggttgtcgaacattcatttccagctgtgcttgtggccaatgatgaatcaaacccagatgtcctaaatgctgaatacaccgaagatgagcctgagacaggtacacttgaaccccaacaacatgagtttacagaatcttctgatgtcgcagaggatgatcatttcgaagatgacatgcttaagcgtttggagtcatcagtcccattgggagcattaccgatcgacgcagtggtaaaacagttgaatgatgagtgaattatattaccaaacaatcatgaattcagtgttcagtccaatggggcaatgacctgcaatcacaaatacagcgcacattccacctttcagtccgatcaataacaatattttgaggatagtcagcaatttgcaaccaatcaacatgtagagggactggataactgtatactactgtagtctgcaaaatgcagcctgtgtagataaaactgatccatcaatcaccaataataagaagatggcattatgtggttgctgcagctgtacatatata

SEQ ID NO: 198 - DNA, 1869 bp, Oryza sativa
cactagtacatgcaaagctccctaccacggtgccacccccaccccaccccacccctgccgccgcctactgatcacaaattcacaactcaattctctccacacaaaaacacacacgtaactacttacgcttaatcagtgatcgatcgagctggagtagctagctgacaagaggaggtacgtgtcgccggcgatcgatcgtttgaccgacatggcggcgaaggggagcccggaggaggaggccctcctcgccggcgtcggaggtgatcatcagctggtggagtcggatgagttggcgccagctgcagcggtggtgcgggaggaggtgaagaagcagctgtggctggccgtcccgctcgtcgccggcgcgctgctgcagaacgtcatccagatgatctccgtgatgttcgtcggccacctcggcgagctccccctcgccggcgcctccatggccagctccttcgcctccgtcaccggcctcagcctcctgctaggaatggcaagcgcactggacaccctgtgcggccaggcgttcggctcccggcagtatcatctcctgggcgtctacaagcagcgcgccatgctgctgctcaccgccgtcagcgtcccgctcgtcgtcgtctggttctacaccggcgacatcctcgtcgcgttcgggcaggacgccgacatcgccgcggaggccggcgcgtacgcccggtggatgatcccggcgctgttcgcctacggcccgctgcagtgccacgtccggttcctgcagacgcagaacgtggtgctcccggtgatggcgagcgccggcgcggcggcgctgtgccacctggtcgtgtgctgggcgctcgtctacgccgccgggatgggcagcaagggcgcggcgctgagcaacgccgtgtcgtactggatcaatgtcgccatcctggcggtgtacgtgagggtgtcgagctcttgcaagaagacatggacggggttctccatggaagccttccatgacccgctcagcttcttcaggctcgccatcccttccgctctcatggtctgcttggagatgtggtcgtttgagctcattgtgcttctttcaggtattcttcccaacccgaagctagagacgtccgtgctatcaatcagcctcaacactgctgctttcgtttggatgatcccctttggcctcggttctgccataagcacccgtgtctccaacgagctcggagcgggccggccccgcgcggcccgcctcgccgtccgggtcgtcgtgttcatggccgtctcggagggattggtgatagggttggtgctggttggcgtgcgctacatctggggccatgcttacagcgacgaggaggaggttgtcacatacgtggccaagatgatgctggtcatcgcagtctccaacttcttcgacgggatacagtgtgtcctttcaggtgtggctagagggtgtggatggcaaaaaattggagcttgtgtaaaccttggcgcctactatatcgttggcatcccttcagcttacctcatagcttttgtcttacatgtcggcggaatgggtctatggctaggcatcatctgcggcctcttggtgcaagtcctgctactaatggcaataacactatgcacaaattgggataaagaggcggctaatgcgaaggacagggtcttcagttcttctcttccttcagatctcgcaacatgaagttagaggtgatagttgtgaaagcgtgcttgcagactacatgctattactaatcaggccgcattgatctagtttctcttggttgggtgtcgatcgtaaaatttagtatgctgatctggaagcttaaaacaacttgtgtatattgccacttttatatatatgctgccttgtgaaatttatttttttta

SEQ ID NO: 199 - DNA, 1712 bp, Oryza sativa
atcgcctcccacccgtctcgccgctccatctccaagcccgaatccccaaaaccctagcccaccccctgccgccatggccgcctcccccaccggctcctcctcctcggcccccgccgccgcggcggcggcggcggccgaggccaccgacgggccgaccctcagcgtcgtctcgaagcggctccgcgcgctgcggaagaagcacaaccggatcctccagatggaggagtcgctcgccggcgggaggaagctcaacaaggagcaggagggggtgctccgatccaagcccgccgtcgtcgcgctcatcgacgagctcgagcggatgcgcgcccctctcgccgccgccctcgccgaggagctctcctcccgccccgccccctcctcctccgccgcgccgccgccccccgcatcctcctccgccgcaggcgccgcggattcgtccgtcgtcgaggatctcctcgcgctcatctacttcggcaccctcttcgacctcaagccgcagaccgagttcgtcgccaccatggtcgcgcgcgcgcaggagcgggactgctgcatcacctacgactacgtcacggaggacgccgccgacctgctgcaccagtccgatctcgacaaggtgtctgctctggccgccctcgccgcctcgcgccctgccgcggcggtgggcgtctcgcaccgcgacgcgctccagtcctgcgcgcagcacgcccgcctctggcttcgccgtgccgatgagccaatccaccccgaatccagcatcacttatgcagcggttagggcgaagttggacaagatcatggcttcagactactacacagcgcaaccggagatgccggagatgggggctgcggtcgatttgtcggctgctgtgcaggagagcatggttgtgtcaccagaggcgccggctgtggaagagagccaggctgagggacacaaggatgagaaggaggcttcggaggctacagaaatctacaacgataatcagcctaatgtagctgatgctcagaatgtggaggatgaagccccggtgaatccttctgaagagttctcagcagcagaggtggagcaggagaagtttgaagcagatgtggaggaacaagagaggaatgcagatcaacagttcacttctcgacggccttaccagaaccagcgcggtggtggtggtcgtggtggtggcaggaggggttaccagaatggaggtcgtggtggacgtggggggcgaggaatgggcggtggcgggtaccagaatggtcgtggtggtggcggcggcggtggctaccagaatggccgtggtgggggtgagggtggtgggtactactataatgagcctggttactaccagcagagggggtacagcaacagaggcaggggtggtcgctctggtggtggcaactcttattacaacaatcaaggtggaggttcgcagggaggtggccacgcccatcctgggagggttgagctgggcgcaaacgcttagcttcctaactattttgcttggaggagtgagtgttacgcgaggagaggacataatatgtgggagccattttgttattatagaactaacttagccctttattatgtcaacatttgcccccctcagagttcttttgtcactccaatgactttcatatggatggttggttgataatgcggaatactttggggaagtagtttaaggtcatattcgttctccttaattccatttcttgtgttta

SEQ ID NO: 200 - DNA, 1396 bp, Arabidopsis thaliana
ctataaatagaacaccatggaaaggaaaagagacacacacaaataaagaaaacgaaaacacttttatacttatattgcagccatggctccgactttgcaaggccagtggatcaaggtggggcagaaaggaggaacgggaccaggacctagaagttcacacggcatagccgcggtcggagacaagctctacagtttcggcggcgagttaacaccaaacaaacacatcgacaaagacctctacgtctttgacttcaacactcaaacttggtcaatcgctcaacccaaaggagacgccccaactgtatcctgcttaggcgtgcgcatggtggccgtgggaactaagatctatatctttggaggccgcgatgagaaccgcaacttcgaaaactttcgctcctacgatacggtgacatccgagtggacattcctgacgaagcttgatgaggtgggaggacccgaggctcgtactttccattcgatggcttcggatgaaaaccatgtgtatgtattcggtggggtgagcaaaggcggtactatgaatactcccacgcggttcaggacaatcgaggcgtataacattgctgatgggaaatgggctcagctaccggatccaggagataacttcgagaaaagaggaggagcgggattcgctgtggtacaagggaagatttgggtggtttatgggtttgcgacctcgattgtgcccggaggcaaagatgactatgagtctaatgctgtgcaattctatgatccggcttccaaaaagtggaccgaagtagagactacaggagcgaaaccttccgcaaggagcgtgtttgcccatgcggtagtgggaaagtatataataatatttgcaggtgaggtatggcctgatctcaatgggcattatggtcccgggacgctgtccaatgagggatatgcgttggacaccgagacactggtgtgggaaaagttgggagaagaaggtgcaccagccataccacgaggttggactgcctatactgctgccactgtcgatggaaagaatggcctcctcatgcatggcggaaagcttccgaccaacgagcgaactgatgatctctacttctatgcggtcaattcagcttaatgcgtgtcaagatttgtgttgtgtgtgtggctcgttaatatttattactatccaataaggagccctaatggtttgctgtattattacaaattatctgtgtgtgggactcgtcgagcttttttactctaatgaggcctactcatggttgtgtgagtggttccttaagtatcattgtccaataaggagccaatttatttatggctggctgttttattacaaattatgtgtatgtgttaataattaaagattgaattatctacaactttatcgtattatcatttattttct

SEQ ID NO: 201 - DNA, 1189 bp, Glycine max
cttacttttcttcttctatttcttcttcaattacaaaattgtcttgatccttttaattttcatgtcggtttatttttgaaccccaaagatagaaacttttttcttttttataatgagaagcatagcatcttgttacaacgaacatgcaattagagtgtccgattcatattgttcaagaccttcgaaccaggcgtatctctgtccagaactcaacccttccaccagagattccgttacctgcatgtacaaactctccctcatcaaaacgcaaaaacaactcttcatcacaataacttgggccaagaaactcttgggccaaggcttcaccataaccatctccaattctgaacattctctttctccctctaataataaatccaacgcaaggcaattgagaaagaacaaaggcaacgaaacattccaatcccaaaattttcaagtccaagtcttgtgggatctctccgatgcaaagtacgaggaaggaccagaaccggttggtggcttttacgtcgacgttttggtggactccgaactgggcctacgcctcggcgacaaaaattcctcaatggaagaattgttaccaaactttgacgcaaaggaagcgactttctcgatggtttcacggagcgagacgttttccggcacagcggtttacgcgacgaaggcgaaattctcgcagacgggaagttctcacgatatattgattaggtgcggcgcggaggcggagcgaggagagccgaagggtcacgtgttgtccgtgtgcgtggacaagaagacaatgttccaggttaagaggctgaggtggaactttcgtgggaaccaaacaatttttgtcgatggtttggtcgttgatatgatgtgggacgtgcacgattggctttttaattcgaattctgcttcatctgcagtgttcatgttcaggacaaggagtggcctcgatagtaggctatggttggagaagagtttgcacgcgcacaaggaacaggacaaaattgggttctctttgttgatttgtgcctgtaagaacaatgactgattcaatcttatatagatttttttttcgttttaattcatctggattttataagattgaaaacactgacacctatttagatgatttttttcttcttcttaatcttaatctctgtcgatgatatttggtcagtggttatgtaatcctgtccgtttg

SEQ ID NO: 202 - DNA, 2313 bp, Oryza sativa
gaggccgagggagggagtttggcagttgctcgctcgccaaactgccagatccggatcccgcaccagatgcgcccgacggcgatgctccgatggcccgccgccgcggcggcgctcgcgctcgtcttcctcctcctcatcgccgccgcgccccccgccgcggccttctacctccccggcgtcgcgcccaacgacttccagaagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtgtttgagatgagagagcccaagatgtgtcagatcgtctgcaaagcaaccattagcgataaacaagcaaaggagctaaaggaaaagatagaggatgagtaccgggtgaacatgattcttgacaacctcccgctagttgtgcctattacaaggccagatagggatgatgttgtttttcagggtggatatcatgttggtgttaagggccaatatgctggtagcaaggatgagaagtactttatccataaccacctgatatttttagtgaagtatcacaaggatgaaaattcagatctctctagaattgttgggttcgaggtcaaaccatttagtgtaaaacaccaattcgaagagaaatggaatgatgcaaatactcgtttgagcacatgtcatccccatgccaacaaaataataataaactcagatactcctcaagaggttgaagctggaaaggatatcatattcacatatgatgttggctttgaggaaagtgatatcaagtgggcttctcgctgggacacctatctgcttatgacagatgatcaaattcactggttctctattgtgaactctctcatgatcgtgcttttcttatctggaatggtggccatgatcatgctccgcactctatatagagatatctccaggtacaatcaacttgagactgaagaagaagcccaggaggaaactggttggaagcttgttcatggagatgtgttccgcccaccaactaactctgacttactctgtgtctatgttggcactggtgtccagttctttggtatgctgctggttaccatgatgtttgctgtcttgggtttcctttctccatcaaaccgtggaggattgatgactgcgatgctgctcatttgggtcttgatggggctgtttgctggatatgcttcttcccgactctataagatgtttaaaggatcagaatggaagagcatcaccttgaagactgctttcctgtttccgggaattgcttttggtattttcttcgtcttgaatgctcttatatggggggagaaatcatcaggtgctgtccctttctccacaatgtttgccttggtgcttctttggttcggtatctcggttccacttgtctttgttgggagctatcttggtttcaagaaacctgccattgaggctccagtgaagaccaacaaaatcccgagacaggtcccagagcaggcttggtacatgaaccctgccttcaccattcttattggcgggattcttccattcggagcagttttcattgagctatttttcatcctcacttcaatctggcttcaccagttctactacatcttcggcttccttttcctcgtgttcattatcctcatcatcacttgtgcggagattgcaatcgtgctgtgctacttccagctctgcagtgaggattacatgtggtggtggaggtcctatcttacttcaggatcatctgccatctatctcttcctgtatgctgggttctacttcttcaccaagctgcagattactaaactggtgtcaggcattctgttcttcggctacatgcttctggcctcattctctttcttcgtgctcactggcacaattggtttctgtgcctgcttgtggttcacgagattgatttactcatctgtgaagattgactaggcgcagagttgctatacatccggcttccaatagttctgtatgattattgtggagaattgtgagacgaggatcagaatccactttgtattttgccgattttcaagaaaatttatatcgtagttcttagtttataaaccacttatgttcattcactataaatgagatgatacatctttgatatgaggttatataaggctaattacgattgttaatttcatatggcagagcatatttctcaattcttatggaccactgtatacattcattttattatatacggttaccgaatgctactgttctctgatc

SEQ ID NO: 203 - DNA, 1451 bp, Glycine max
gtcattggaaagtgcaaattaaagtggttcacgaaccttagcagaggctctccttgggtgctcttcaaacatgggaaaacagagcacaccccaattctctgccctcaactgcatcgatctctccaaccccgacatcaaccaatccgtcaacttactcaaagaggcatgtttggattccggttttttctacgttgtcaatcatggaataagccaggaattcatggacgaggtttttgcgcagagcaagaagttcttctctcttcctcacaacgagaagatgaagactctcaggaatgaacaacacaggggatacacccctgttcttgatgagttgcttgatcctgaaaaccaagtacatggagattacaaagaggggtattatattggagttgaaaaaggtgaagatgatccacaatcgaagaaacctttttatggaccgaataactggcccgcaccagatgttctgcccgggtggagggagaccatggaaaagttccatcaagagacattagaagtggggaaagcagttgcaaagatgatagcccttgcacttgatctggatgctaattattttgatcggccagaaattcttggagagccaattgcaattctgcgtttgctgcactatgaaggtcaagtttcagatccctcgaaaggattatatggagctggagctcataccgactttggtttaattacactgttagcaacagatgatgtcccaggtcttcaaatatgcaaagatagggatgctaaacctcagaaatgggaggatgtagcaccattgaagggagcattcatagtgaatcttggtgacatgctggagcgctggagcaactgtatttttaagtccacactgcacagagttctaggaaatggtcaagaaagatattctattgcatacttcttggagcctagtcatgattgtctagtggagtgcttgcctacctgcaaatcagatagtaatccccccaaatttcctcccatcttatgtcaggactacctgactcagcgctacgaggacactcatgctgatttgaaaatttacaagaaacagcaagcttgagtagtcaacctttggaactgaacagcctggagatttttcacaagaacactcacttatgctgatttggatatttaccataaaagataaccttaaggagttggtcttttggagctgagtagcctggaaattttggactgcatgttgttttagagacaacagcatcatactactacattagcaatgttatgtagaatttgtttgaatgtcaaattagtttttgttttggggaagggggatttagctgtatggtttggtactttaatgttaaacctaaaagaaaaaaacatgtatgaaattaacagatgtatgtttttattcaaccctaaagttgggaaatgggaatgataggaagatgaaaaatgaacattagtattttgctttcatc

SEQ ID NO: 204 - DNA, 2337 bp, Zea mays
tccttggtttcgtggcccgttaccccaccctgcttcctctccgtgggcacctgacgccgcgaccccggccccgagctggctttgccggccaatcggctcgcccgcgccgaccaccgcgcctcttcccctcgccgagatcgcctgaaaaggcaagcgaggccagcccgatccccctccccgcccccctcaagaaccaaaaaagggtgtcatttcgtcctaggatcgcagctcgagctcggtcgctctcgctcacctcgctccctactcgcctgctttccacttcctccgcgctcccgatttcctctccgattccttcgccgactcgtttcttcttggcaattcgttgcgcgggccatcgccccgacggcacctgggtacatcagctacaggacgggacaggtccctcttctaggagaggcttcgccagccgcctcccgcccccgtcactacgggcgccgtggagcggagatccatccggacttggatcggtctcgtcgcgtgattacagctcttgttttattgccagtttgagcaatatgggttggctgaccaagttttttagaggctcaacccacaatatctcggaagagcagtatcacagcaggcctgcagaagacacagcatggaatgaaccctctagctctcctgttgtgactgacatcctttcagagtttaacaatgaggatattgaccgtgctatagcgctctctctatcggaagaggagcaaagaaaggaaaaggcaatagataaggatatgcatttggaggaggatgagcaacttgcaagagctatccaggaaagtttgaatgttgagtcaccccctcgcagaaatggcagtgccaatggtggtactatgtatcatccgcctcgcgaaactggcaatgcatatcagccacctcgtgaaaatggcagtgccaatggtggaaatgcatatcacccattaccatttatgttctcatctggattcagagcatgcgcaggatgtcacagagagattggtcacgggcgttttctcagttgcatgggagctgtttggcatccggaatgttttcgttgccatgcatgtagtcaacctatatatgactatgagttctccatgtccgggaatcatccataccataaaacttgctacaaggagcagtttcacccgaaatgtgatgtctgcaagcagttcattcctacaaatatgaatggccttattgaatatagggcacatcctttctgggtacaaaaatactgtccttcacatgaaatggatggtactccgaggtgctgtagttgtgaaagaatggagccaagggaatcaaaatatgtattactggatgatggtcgtaagctctgcctggagtgccttgattccgcagtgatggatacaaacgactgccagcctttgtatcttgaaattcaggaattttacgaaggactgaatatgaaagtggaacagcaggttcctctgcttctggtcgagcgacaagctttgaatgaagccatggaaggagagaaggctggtcaccaccatcttcctgaaacaagaggactatgcttatcagaagaacagactgttagcacgatactgagaccaagaatggctggaaacaaaattatgggaatgataacagagccatataggctgacacggcgatgtgaagtgactgcaattcttattctgtatggtctcccaagattgttgacaggttcaattttagctcatgagatgatgcatgcatggttgcggcttaaaggataccggacactgagcccagacgtagaagagggcatttgccaagttcttgctcacatgtggatcgagtcagagatcatggccggatcaggcagtagtgccgcatcgtcatcctcaggatcttcgtcatccacatcatcgaaaaagggcgggcggtcccagtttgagcacaggcttggggactttttcaagcatcagatcgagacggatacttccatggcctacggagatggtttcagaactgggaatcgagccgttcttcattacggcttgaagcgcacccttgagcatatccggctaactgggacctttccattttgaagtagcatggattcatattttgggaaagcttatattatatacatgattttcttccagagttccattacaaccaaagagataaattgtaaaaaaacattctttccagaatccagagatataatatctatgaaggccaaaatgaagtattaaatgattgagatcgatggtcagtctgcccaatcattttgtattctgatcaaactctggaatgaaacaatggcaatctttttatatggtgtcagtttcaataaataccagtaccattttacagtat

SEQ ID NO: 205 - DNA, 1886 bp, Zea mays
gacgcagttgtggtcgcggcagcaggcgtcgaggtcgtgcaggtgcagggctcctcgccgtcgcagccgctccatcccacaccgcagtacttaccgtagcggatcccaacggctgcagcaaagaagcgttaaaccgggtcagatcgccgtcccgacggaatcgatgaggatggctgaagggggtcgcaattgagggccgcgcaagagcggctgcggcgggggctggggcgccgaggacggcggcggcgaggagcgtccgccgcggcgacaacgcttcgtattccgcatcgcagtttgttgaccggattggctggatgggccgaaccaggtcaagtggagatggagagagtcctggtgtggtgcgggccgcaagtgtgagtgagacgtcaccatcgaatcccaccacaaaagctcctttcgtcacaccggccagcacccagcttctcctctcctcacccccacgccccaccccaccaaacaatggcgccggcggcgacttccacagcctctgcgccctcctccttccactccaccggtaggcatagggccagggtcggggcccggccatcgctcgtctctctccgcgtcagagcagccaatcccaacgttaccgccgatcccgcaccggccttccagtccgtcacgaccttcgcgccagccaccgtcgccaacctcggcccgggcttcgacttcctcggatgcgccgtcgccgacgcctccctctccctgggtgacaccgtcaccgcaaccctggacccgtcactcccgcccgccaccgtctccatcgcctccgtcacatccccgtcccgccccaacctcgccgagcgcctctctagggacccgctccgcaactgcgcgggcgtcgccgccatcgccgcgctccgcgccctcggcgtccgctcccacgccgtgtccatccacctcaccaagggcctgccgctcggctcggggctcggctcctccgcggcctccgccgccgccgccgccaaggccgtcgacgccctcttcggctcgcgcctcggccgcgacgacctcgtcctcgcgggactcgagtcggagaaggccgtcagcggcttccacgccgacaacatcgcccccgccatcctcggcggcttcgtcctcgtccgcagctacgacccctttcacctcgtcccgctttccttcccgccagcgctccgcctccacttcgtcctggtcacccccgacttcgaggcgcccacgagcaagatgcgcgccgcgctgcccaggcaggtcgacgtccagcagcacgtgcgcaactccagccaggcagcggcgctcgtggcggcggtgctgcagggggacgcgggcctcatcggctccgcgatgtcgtccgacggcatcgtggagcccaccagggcacccctcatacctggcatggcggccgtaaaggcggcggccctgcaagctggagcgctgggctgcacaattagcggcgcgggccccacagtggtggccgtcatccaaggggaggaaaggggggaggaggttgcccgcaagatggtggacgcgttctggagcgcaggcaagctcaaggcgacagcaaccgtcgcgcagctcgatacccttggtgccagggtcatcgccacgtcatccttgaactagcaaaagattcggaaagtggtactgcaattgtatcaccaaacaaggaagaatgaaggggaaccccatggatttgtatgttttctcttctttcttgcatctttaggtggttaattggctttggaataaatgagatggaggacatcgctagaacaattctgttccgtgggctgtaatttcaatttgggctggtttctttatcatgccatggataattatgaataaatttgaggtagtttgttacctgtcgtcctcgacccatgggc

SEQ ID NO: 206 - DNA, 1788 bp, Sorghum bicolor
gtcctgcattgcagaagccggagaaacttccaagcccaagaaaaaagctgctacctttaacacgatcccctccctctccgtctgtgtccgtgcggcggcgccggagccgaaagcctccggcgagcccggggctacttgctgcggcgcgctatttcggcggttttgcgccacggcgggactggaaccgcccgggctgcgctgtcaggatcaccaagccggaacgaagttcagttgcgctttggcggttggattcgcctgttgccgcgcttcaggatactaaactgccatctcagttaaatgatacactgcacatcggtgggcaccgatagtttgaaacacatccgcaatgagttgttttgctcacttcttcaagaggaaaagagggccgcaacaacaagacaatccatctaacgattatttcaaaggttctgagaatataacaaaatacagctacagggaactggttagagctacatcaaattttgaccagagcaataagattggtgaggggggttatggacctgtctacaagggaacgctcaaggatggaacagctattgccgtaaagattctctctttacattctagacaaggtgcaaaggagtttcttaatgagcttcttgcaatctctgatgtagcacatgagaatcttgtcaaactctatgggtgctgtatagaaggaaaccacaggatccttgtctacaactatcttgaatataatagtcttgcacatacccttctaggtttgggacatagcaacatccagttcaactggagaactcgggtaaatatctgcattggtgttgcccaaggattagctttcctccatgacagtgtccgtcctcacattgttcaccgcgacatcaaggcgagcaatatacttcttgataaggatctcacgccaaaaatatctgattttggtctggcaaagcttctacctccagatgtatcacatgttagcacaagagtcgcagggaccctaggttacttggctcctgaatatgcgattcgaggacaagttacacggaaggcagacgtctacagctatggcgttctgcttatcgaaattgtgagtggaagatgcaacactgatacgaaattgtcctacgatgaccagattctccttgagaagacatggagatattacgaccggggggatctggagaagatcatagacagttccctgggcgatgacctggacgtcgatgaagcctgcaggtttctgaaggttgggctcctctgcacccaagacgtcacgaaacgccggccagggatgtctacggtggtcgccatgctgaaaggcgaggcagacgtggacacggagatgatcagcaagcccgacgtgatcagggactttggagacctcaagcagaggagcagggccacgtcgtcgacgctgctgacctccatcatggcgcggtcgtccccgctgtcgtctgaggagacgacgcgcacctccatcaccttcaccgagatatcagagcgcgactgatgatcgtgattcgccaacaagcagagattgcgaccgtgtagctagaggaccggaaattgtatgtagcataggctgaggagaattcttttgggcattgaggtgaatccgacaacatccaaacaaggccttggtgatcttatatgatctgtgtgcgtatatagatgcccattgcctggatgggttagagttatagagcatgaaccaactggtgagtcagtctgggattcagaactggaaagcaacctgtgaagttacttaaaaaaaagaaaaggaaaatcttcttgttttagttgttg

SEQ ID NO: 207 - DNA, 2359 bp, Zea mays
cgaaattaatgcccatacccctctcattgtcccatcaaactcgctactggcctcgggcccgcccgtcgtgaggtccgagctcgatgcagccgatccggcggcggcaccgaggctttgcactcctctgtctctccgccgccctcctcgctgccgccactctgctccccggcgccgccgtcgccgaaggtgtcacgccctccgaggcgcgccggctccgcgacgaggtgaaagatatgttctatcatgcgtttgatggatacatgaagtatgctttcccactcgatgagctgcggcccttaagttgccaaggtgaagactcccttggtggttatgcgctcactcttatcgattctttggataccttggctttactgggtgataaggagaaatttggtgctgctgtggagtgggttggtaagaatgtccactttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttagctcagaggttgttgcccgcatttgacactcctacaggtattccatttggatctgttaatttattgtacggagtcgatgaaaatgaaagcaagataacatcaacggctggtggtggtactttgacactggaatttggcatattgagtcgcttgactaataatactgtttttgagcgagttacaaaaaaatcagtgcgtggaatatggtcacgcagatcaaaactcaatcttgttggtgcccatataaatgtctttactggtgaatggacacagaaggatgcaggaattggcacaagcattgattcattctatgaatatcttctaaaggcatatttattgtttggagatgaagaatacctgtacatttttcaggaggcttacaaagctgccatgcactatctccatcatgatccttggtacgtggaggttaatatgaactctggtgctactgtttggccactcttcaatagtctgcaggcattctggccagggcttcaggttttagctggagatgttgatcctgctattcgcacacatgctgccttcttcagcgtctggaaaaagtatggttttacccctgaaggttttaatcttgctacatccactgtacagaatggacaaaggagctacccgctacgaccagagttgattgaaagcacatattggttgttcaaggctaccagagattacagataccttgatgttggaagggacatattagcaagccttcaatatggtgccagatgcccttgtggttactgccacatatcagatgtggaaacccacaagcaggatgatcacatggagagttttttccttgcagaaacggtcaagtatctctggcttctttttgatttagctgctggccctgacaatattgttgaaaatggaccatataagtacatatttagtacagagggccatttgttacctgttactcctgagatagccttggaagatgaacattgttcatattttggagcattctgtaatggcggtgccgaccatggatatggtgctagtgctagttctactaagcatcgaaatggaaactatacccaattagatgatattcaaaccccttccagtcactattcaatgtccaatgtgttgtttacgccaggttacatcaagggagtttgtccaggattgactcatgcgcagaaatttgggatatcatactctgatgaagaggataactttatagagcagacttctgagagtcttgatcatcatggtgaatctgccatagaatctagcgtccaagaccaatcaagttctattatattgatctctcacccagtcgcaagccaacaggatgaggcttttgagagcgagtctggaagtcaagatcatgcaaatattgttgtaacttctgattctgattctgattccacaagccgtgataatactgttggctctcccggaatgaactcggaagaacttatggacgacatatagggcacctctagacaggacaaaagatgaagaggttgctcacagtgttgagtccaagatatcagctgaccctttgctcatgtagcaacccatttctgtggaatcttcagggtcaatggcttgccgaatgcagaacaagttagcaagcaagcaaaatgtctggtagacgattccagtatcttgccagcttcaacatcggaaattgatatttactttcagatagaatatattacagggcgtacattcactaatttgttcttttttttctgtatcgatcactaatagatattattttgattaatagagaatgcacgagttttgta

SEQ ID NO: 208 - DNA, 1849 bp, Zea mays
cacagcgccacagacctccctcccagtggtcgattctttgcttgtagctagctgtaccagcctctctctctccgtctcttgtgttgaaggggagacagagaagggtaggcgacacgccatggaaccgacaaggctgctgcttcttctcctcgttctcggcgtgtcgctgcaaggatgcattgcgcagggcggcggcggcgccggagggctcacgcgggggagcttccccaagggattcgtcttcggcaccgcctcctccgcttaccagtacgagggagcggtgaaggaggacggcagagggaaaaccatctgggacaagttcgcgcacacgtttgggaaggttgcagacctgagtaacgccgatgtcgcggtcgatcagtaccaccggttcgaggaggatatacagctcatggcggacatggggatggacgcgtaccgcttttcgattgcctggtcgaggattctgcccaatggtaccggccaagtcaaccaggccggcgtcgaccactacaacaggtttatcgatgcactgctatcgaaagggattgagccatacgtgaccctgtaccactgggacctcccccaggccctggaagacaggtacaacggatggctggacaggcagatagtgtacgacttcgccgagtacgccgagacatgcttcgaggccttcggagaccgcgtgaggcactgggtcacgctcaacgagccgcacacggtcgccgtccagggctacgacgccgggctccaggcgccgggccgctgctccctgctgctccacctctactgcaggtcgggggactcggccaccgagccctacgtcgtcgcccacaacttcatcctggcacacgccaaggtctccgacgtgtacaggaaaaagtacaaggcggctcagaacggagagcttgggatagcgttcgacgtcatgtggttcgagccgatgaccaacactaccgccgacatcgaggctgccaagagagggcaggagttccagctcggatggttcgcggaccccttcttcttcggcgactacccggcgtcgatgaggtcgcgggtcggcgacaggctgcccaggttcacggcggccgaggccgcgctcgtcaagggggcgctcgacttcgtcggcataaaccactacaccacctactacaccaagcacaacagcaccgacctcgtgggccgactgctgcacaacaccctggcggacaccggaaccatcagcctcccgttcaggaacgggaaagccatcggtgacagggccaactcgatctggctgtacatcgtgcccagcgggatgaggagcctgatgaactacgtcaaggaaaggtacaacagcccgccgatttacgtcaccgaaaacgggatggacgacggcaacagccccttcacctccatcaaggacgccctcaaggacagcaagagggtcaagtaccacaacgactacctcaccaacctggctgcctctataaaggatgacgcctgcgacgtgcgtggctacttcgcctggtcgctgctggacaactgggagtggacggccggctactcctccaggttcgggctctacttcgtcgactacaaggacaaccttaagagataccccaagagctcggtgcagtggttcaagaacctgctggcctctagctgaagcctcgatggatatatatatactgcattgtcatttccttctttaatcttcatggcctgcccaagtggccatctgaaaccatgcatgcatgtacgctgtggcgtccccttctggatgccttctcctttcatctatatagccacgatacaatacaagttgcctggaagaaaactatcgaggcgaaataaagtcaaggcaatactt

SEQ ID NO: 209 - DNA, 1728 bp, Zea mays
cgaacgcagcagcagcagctcacgcgcgcacggcacaccagtgagtgacaccacctctcgcctcagcgccggcccccctataaataatggcgccactctcccctacccccgcctccgcctctgctcccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctgatgcaacttcaacagcagttctggcatggcgatttaacacatccacaccaagtggcttcacagtgggaaaagcgtggggatggccatcctcccgtctttagcaactccagtccctctctcttcggctatgatctaacaagctctggagcccagcaaaccccggcgagcaagctaaagacggagctttgagcgacgatggatggtagatagcattgtcaggagagcaggctgaacatatgcggtgggggcgcagcagcgacatgatttcagcaagttgaccaggtcaggctacaaacgggctgggaatgttgatgtgaagcgcatggagaccaacattttcagagacagagaggatgtacatatagcgatagagaatactattggtgttgagctgaagacgggaataccatagttgtattgtagagatgggcacgccctgctgctatcgctgaagagatgggagggcgagcgatactccggtctagttgctggtattcttggtgtatttcttactataatggcccaatcttaaggttatatgagcagcaatttttatgaaccaaaacccaaaaaaaaccatcatgggtcatcatatacccttctcgaatgcatttcaacaaaacatgaatgtagcacagtataactacatgtaacacacgtgcttgttacaatcctactgttccaagccattctaggttttctttaaggcatacggattttgttacatatttatatatggcttttgttatgt

SEQ ID NO: 210 - DNA, 4899 bp, Oryza sativa
tctctatataaaccacatgagaatattatttctctagcttaattccaatgctgccttagctctagcaatctagctaggtaatttagctaagtaagctagcgacgctatctgggatggcgtcgtcggcggaggcggctgcggcgatggcggcggcgccgtcggcgagcgggcggcggagcatgagctgggggtcgtcgatctcgcagtcgttccggcaggcggaggcggacgacccgttcggtcgcgcggcgtcgcagcaggggcacgacgacgacgaggagaacctccggtgggcggcgctcgagaagctccccacctacgaccgcatgcgccgcggcgtcatccgcaccgcgctcctccatcacgacggcggcggcgacggcggcggcgcggcggcggcggcgaaggacgggaggatggagctcgtcgacatccagaagctcgccgccggcaacctcggccgcgcgctcctcgaccgcgtgttccaggacgacagcgagcgcttcctccgccgcctccgggaccgcatcgacatggtggggatcgagctgccgacgatcgaggtgaggtacgagcagctgtcgatccaggcggaggtgttcgtcggcagccgtgcgctgcccacgctcaccaacgccgccaccaacgtcctccagggtctcattggacgatttggttcttcaaataagaggaccattaacatactgcaagatgttagtggcatcatcaagccatccaggatgacacttcttcttgggcctccatcctcgggaaagagcacactaatgcgagcacttacagggaagcttgataaaaacctcaaggtgtccggcgacatcacatactgtggacacacattttctgagttctaccctgagaggaccagtgcatatgtcagtcagtatgatcttcataatgcagagatgactgtgagagagacattggatttctctgggcggtgcttaggcattggtgcaagatatgacatgctcgcggaactcgcgagaagggagcgcaatgcaggcattaagccagatcctgagatcgatgctttcatgaaagctactgcagtgcaagggcataaaactaacatcactacagatgttactctcaaggcacttgggttggacatttgtgctgatattattattggggatgagatgattagaggaatttctggtgggcaaaagaagcgtgtgacaacaggggagatgttaacgggaccagcacgggcattgttcatggatgaaatatccaccggtctagatagctctagcacatttgagattgtcaagtatattgggcatttggtccatgtgatgaatgagactgtgatgatatccctcctgcagccaccaccggagacctacaatctttttgatgacataattctactatcagaaggatatatagtctatcacggaccacgtgagaacatcttggaattcttcgaaaatgctggtttccgatgccctgaaaggaaaggaatcgctgatttccttcaagaggtcacttccaagaaagaccagcagcagtactggtaccatgaccaagaacggtatcggtatgtgtcagttccagagtttgcacaacgtttcaagtcattccatgtaggtcagaaaatgcagaaggagatgcaaattccttatgacaagtccagcacacatcctgctgcattgacaactaccaagtatgggctatccagttgggagtcactcagggcagtgatgtcaagagagtggttattgatgaagcgcaactccttcatctacattttcaaggtcacccagttgatcatccttgccttcatgtccatgactgtgttcctcagaacaaagatgcctagtgggacaatctctgatggcactaaattccttggggctctcacctttagtttgatcaccatcttgttcaatggctttgctgagctacaactgaccataaagaagcttcctgtgttctacaaacatagagatttcttgttcttccctgcatggacctttggagtagcaaatatcctcttgaaagttcctgtttctcttgtagaggcggcggtatgggttgtgctcacatactatgtgatggggtttgcaccctctgcaggaaggttctttcgtcaatttatagctttctttgttactcaccaaatggcaatggctatgttccgatttcttggtgctattttgaaaacaatggttgtggccaatacttttgggatgtttgtgctgcttattgtcttcatttttggaggatttctcatatctagaaatgacatcaagccatggtggatttggggttactgggcatctcctatgatgtatagtcaacaagcaatatcaatcaatgagttccttgctagtagatgggctattccaaatactgatgcaacaattgatgagccaactgttggcaaggctattctcaaatccaaaggcttgattactagtgatggggggttttggatttccattggagcccttataggattccttgttgtgttcaatatcttatacattttggcccttacatacttgagtcctggtggcagctcaaacacaatagtttcagatgaagatagtgaagataagacggacatgaaaacaagaaatgaacaacaaatgtcccaaattgtacacaataatggagctagtaatacatctgcaacatcgtcaatccccatgagtggaagcagatcaacaaatcagcaaagtagatcacaaattgtcttgcctttccaacccctttcactttgtttcaaccatgtaaactactatgtggatatgccaacagaaatgaaagagcaaggattcacagaaagccgtctccagttactatctgatatcagtggagttttcagaccaggtgttttgacagcattagttggtgtaagtggagctggcaagaccaccctaatggatgtcttagcaggaaggaaaacaagtggagtaattgaaggagacatcaccctctctggttatccaaagaaacaagaaacttttgcacgcattagtggttactgtgaacagactgatattcattcaccaaatgttactgtctatgaatccattctctactctgcttggctacgtctttcgtcagatgttgacaccaatacgaggaagatgttcgtggatgaagtcatgtcccttgtagagcttgatgtgttacgtaatgctttggtgggtcttcctggagttagtggtttatcaactgaacagagaaagaggctcacaattgcagtggagttggtagcaaacccttcagtaatattcatggatgagccaacttctggacttgatgctagagctgcagcaattgtcatgcgaaccgtgagaaataccgtcaacacgggacgcactgtggtttgcacaattcatcaacccagcatcgatatttttgagtcttttgatgagcttttgctattgaaaaggggagggcaagttatttatgctggtgaactcggccgccactcccataaactagttgaatattttgaggcagttccaggtgttccaaagataacagaaggatataatcctgcaacatggatgctagaagtcacctcccctatagctgaggctcgtcttaatgtaaattttgctgaaatttatgctaattctgagctttataggaaaaaccaagagctaatcaaggaattgagcactcccccaccaggatatcaagatctctcatttcctacaaagtattctcaaaatttctatagtcaatgcattgcaaacttttggaagcaatatcgttcttattggaagaatccaccatacaatgccatgcgctatcttatgacattgctcaatggccttgtctttggcacggtattttggcaaaaaggaactaagatatcatcacaacaagatttgttcaatttgcttggagccacttatgctgcaactttcttccttggggctgccaattgtatcacagttcaacctgttgtttccatcgaaagaacagtcttctaccgcgaaagggcagcagggatgtactcttcattgtcctatgcatttgctcaggcatgcgtggaggtcatctacaacatcttacaggggattctatacactattatcatctatgcaatgattggatatgactggaaagccgacaaattcttctatttcatgttctttattgtagcaagtttcaactacttcacattgtttgggatgatgttggtggcatgcaccccatctgcaatgcttgcaaacattctcatatcctttgtacttcctctctggaatctttttgctgggttcctcgttgttaggccgttgataccgatttggtggaggtggtactactgggcaaaccccgtgtcatggaccatctatggtgttgtggcgtcacagtttggtaaaaatggtgatgttctttcggttcccggtgggagccctacggtagtgaagcaattcttggaggacaacctagggatgcggcatagtttcctaggatatgttgtgctcacacattttggctacatcatcgttttcttcttcatctttggctatgccatcaagtacttcaacttccagaaacgatagagatggtatgttatggcatagagtgacattatttttggccgccactgccacttgcagctaaagagggctactacacaattacttagttaagttagaagtgcttgtagattgttctagtttgtaaacattcacttcatgtatctatatacacaccaatgctattctaagccatggatgtgatttgttattccatttgcagaccaatagatcatcctaagattgtataaacctctaggaattgtaaaagttggcccacaagtgtaaaaaaaccctctcatttgcgtcctaaccttgccggacctcacccatgatcataaaatccagttctgcttccttttgtgat

SEQ ID NO: 211 - DNA, 1564 bp, Sorghum bicolor
gatactagataccaattgtttaatttgccttatggccgtttgggcagctgcacaagcaattcctgaggatctcctttctctcaagagagagcaactcgtctgcttctttatgggaaagccagatttatccgggcattaggggtcagccattggttgtaatgaacaaggactatgtggcagcaatactatttttctcttcaattctaataatatgtgtatttctgcaatttgtttaatttttctttattttagtactgcagttttagggcatgtttttaatttttgaacgttgtcattctagatagtaaatttgcttcttggtggattatttattggtgagcgctaggggtacattttagattggattctttgtcattccacagtttagcttaagcgtgctgacaattctcagttaagttgtcgtaacattcaaggttcagctgacatgcacactacaacatatatttagcttaaattaccccctatctgttgctatcatgggctcatggctgcacaaccaccacagtacacattatataaatgatggtcagtatacttgctttgtctacagttgatatgaatttgtctgccttttagtatgtatctgtaaaatttttgtttcatgtttgtttttctgcttaccagggaaggggaagatacaatgtttacttccttatgattgttgcccaaatttctctactgtaaacactacacagcagaaggtgatccatagcttccggcgcctggtcatagatgatgcagtctttagtgctctgcaacccatgacaatgtctcctagcagtagtacaacaacgtccatgcatcaccagccaaaagaattttttgactcatgggaggacatcttttccagatttgcttggcttcaggcggatttgatgaaccatagaacattgcgacataggccgaggctgcacaatactgctggtcgtcggacaagcaccgcgaggtcaagataccggtaatctcacacccatgctcgttgtggaattgcttccgccactccctagccactgccatgaacaacactataggaattcagacttatggttgttgagttttggagtttttcatatttgtatattttttccaataggcttcacttgagcagatcaggatagaaggcatatgtgttattgagtaggctttgagcaacttaagagtcgtgatgtctggtttgaattcttttttaggggagaaaatatggtccaacagtattgctatctcaaattcaaaaatgtcattttttttgtcaaccttcaatagtcttgactttattttttccctttgcaacgcacgagtattaactttataataaaaacacatgaatcacatgataagataataatattgtaaaattttgccgatgttaaagtgacatttagtataaaaaacaaagtttataaaattaacatagtcatagcatttccatactatcatgtactacgaaattaaatatcttggagatttcttctcgctgatataaaagattatcttagtcgcatcagaaaaatgtatatacagtagagtttatgagcctatgacg

SEQ ID NO: 212 - DNA, 3610 bp, Zea mays
gtacacgccaaccagcaccttttgcctaccccggcaccaccccgcctttgccttggtgttgaaaagtcgccgcgttcctcttgcctgatgaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcagaccttcagagctgcgacgttccggcttccgggggatctggatcttggctgactggacaattgcgaggcgttgacgggcttctaaagcgtggctggattgctggatctcctttctgccccgcgactcgatgatatctctttgtattggtaattattggatgaaatttcgataattattagatcggagagatgttggtcgcggcggtccgtgcctaactgaaggcaaggtaaggtccgagacaaaagaggggaaaaggatacatgaaaaagaagtgagatgtgacatcttgaaggcctttgccatgttgggtgcgctcgcatggcaggcatcgtaataaagatgttggttttgtgtgctgggtgggagatcgcacagggaattgtttttttcatccctgggttctcccgcccattgtgtccctgtgccctgcttcgtgttgtttggcttctcgtcctacgcttcatcaccggtgctgctgcaaattgaacggcgtttctcgtctcacggcgtgctgcaaattgaacggggctacatcgcaacgcaacacacaaggtacaaaccggatctaaacattttcaatttacagcgaagttagcaagttactgaaatcaccatcaatcgttcaaaactcagcgcgccacaaacttctacgcctatactacgccatgcatatgcagttcattcacccaacgcttatcccgtaaggctataaagcacatgcgaaaggcgttcattcactctgtaaggcgttcttgttcttcacccaacgcttctcgcacgggggtcttctattgaccattgaagaaaaacatttgactggagatagcatctggaatatatgaatctagtataacgaactaggtctgaaaatctgggcaattccagattcgattctcatgtgagatgataaaaacgtcataattatcctgcgtactaaaaaatattcgctagttgagtcgttccggcatatacaaaattattagctacagttgttcctgcatgcgtgtaatgtccttcggtgaacttgtctgtcattatcatttaaaaacgtatctagatgcattacggaagatttttagtttcctttgttatatttgagaagttatatattgtatatacagagagatgcagctgtgtattatttgctgtagcttcgattgcgagacgcatggttgcagtcattttattgtagttagtttatatgatacgtcgttgtcaccgcatgaagattaactgctgtgccatatgaagacctcctgcctcatcacggtgtttgtatataagatcaactgcagtgcctacacggtggacggagtatttgtatgatgtgaaggtcactattcagcatcgtcagtatgaaatggctatggccttcaaagctttctttcttggtcaccggacagggaagaaatattctgctcaagctcacaattagatacaagacataactcagataagagcttgttcaacttgcactatagttcatttgagtatttacctattattgatctcttgagttgaagctaggtttcaagtatctcctaaggattcgtatatgtgaaaaccagggattctcttttttttttgcactacaatctgtgacgttttaatatttgatgactagttgttcatgcattgctattgtatttgcatatcccctaggtttaagagcatttctaacaaggtgactcaatgatgtctcaaatttaaaatactacatttaaagtgttcaggtcgccaaaaacaaattgtgcttcaacatttaagctttaatcatgtatcttaggaaataaattatgttattagaaaaaatgtttagaatgatgtagaaaacaaggatagagccttactccgaaatttataaaatagggcactgtgttggagctgtttttactgagttgctctatattttaaggtagggtactgatttaaagcacggttatagatgctttaaatacaatatttcaaatttccacatattcttaacatttaactggagatatcatgtggaatatatgaatcaagtataaatgaaattagtcgcatgcaattccggattctcatgagagataataaaaatatgataattatttgctaagttcaatgacctaagtcttttactgcgtactaaaaaatattcgctagttgagtagttcccgcatattcaaaattattagctagttgagttgttcctgcatacgtctaatgtcctacggctgtttatgcgaacttgtctgtgaagacattgtacatacagagagattcagctgtgtattatttgttgtagcttcgaatgcgagacgtatggttgcagtcatttttattgtagttagtttatatgataaggcgttcattcagctgtgtattatcatttatccgggcgatcaaagcaatgcagcattgcgcgcatgtgtttagggggcgcttgcatgaagtcttgcgtgcgcactgcatgcgtgtgtgaagggacggaggactacatctttattttgcaggataagatactttttgctatagtctggtcctgtttggttcttctagaactaatcgttagcctctaaaattagatatagaggttttaaacactcacaattgtcagctatttaacaattagttcattaactcgttaactggattaatctagctattagcaatttgttagctggctaactattagctcttggttccaaacataggccttaatttgagctttctcctttgggtgagtttattcttaatgcctccttaaatttccctcttctcaaaatcaaaaaatgtatttactttccagatgttttcccctccttttcaaattaaagatgttttgactttccagattttggtatgcttgtagttaaatctacactgtagataaagaaatgtttgtggagaagtaaaaatcccttatttggtcgtcatggtaaatggctgcggtggacatgtgcagtctctggcgactgatgttcagtgatcttgctgttctattgtttgtatattcgtgtcggattgttaattctgagcagccattgtttgcaaatttttttggaggcttcaccacatccattatcaatcaataactcgattttgctctacgaaggtatatgtcaattatcaataactcgattttttactggttattagatagtcttgttgcattctgaagaccactgattgctgccatttgtaactagtactgttaaccaaggcgcgtagaaaattgtttgtgtgacctaattctacaaaaaaa

SEQ ID NO: 213 - DNA, 858 bp, Zea mays
ctcacccgtcggaaaggtttagaaagttagctaggtttcactgctcgtgcctcgagcaccacggcggcggcggcagcgggactgttctggccgacgacggcatcgatgacgacgagattcatttgcaggagtgttaaaacagctcgttgttttgggatttgccgcctcaagtttcatctagctacctccaacaaacccttcaatctccatggctacatcgatatcaactcaatatactaacgaggaggaaattaaaaggaagagaaagaagcgaaagagagttgttgtattagcctagtgtacaataaagaccaagcaaatggagagggtgctaaaacagcagctgaaagttcaaaggaaatgggaaaagagaatgatatcggaggcaaggatgctccatattctgtatcttcctcgagtagtttaaaaagacaaagatcagatgattcatttaactctatatggtgtgataagtttgacatgtatctgcattgaaagatgatggtccaaagctaccctcttccgccgaagttctcgccacattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttagatctctgtgttgaactgattgtgtgaacttgtctttgtgaaacttttgtgtgcgaacttgatggctatgtgaaactgttgtgtgtgaacttggtggctttatgaaactgctatgtgaagatttgatgtctttgtagaacttttatgtgcg

SEQ ID NO: 214 - DNA, 772 bp, Zea mays
atagatagaggttttttttcgccatgtgcttgtgttgggacctgtctgccgcctaactaaagcaaccacaccaccacaccagcgaggcgggggaaggcgcggcgcggcgcggcgcggcgggcttcgctcgtcgaggctgtaagtctagggtggcgacctgcactctctacaacccgcatctctccgtccccggcgacgactgcgtgagcagccgcagcactactaagagcggacagcggactatggaggtggaggccatccgagttcccttcgaagcttctcgaggataggtacgcggaagatagcttcgtcgtcaccattgcggcatcgtaaaagggcttagcaagaaagagctccaggaccttctgcaagagggcgccaagatgctggtgcgtgctgcaagtgctagaggaaatcggatcctcgggtcgggcgatgagatggaagggatgctgcagccacacgggcgttgagtcatgacgtgactgctcgcctggtgttagctttgtcaggaactcgctctattttgctgccgtctgttatgtcgtatggtctggtacttgtgtgatgtaaaactctaaactcgtcggttggcatgttgcctggtaggggacccggctgttctgagtcatccgaagcggattggctcgtcagcgcttctgtttgcgggttcttcctgttattttgcgttggtagtgtggaaactatctgaaccactttgtatttctgttatgacaataatagaaatggggtcctcctctcgtcaaaaaaa

SEQ ID NO: 215 - DNA, 818 bp, Hordeum vulgare
cggcacgaggactgataagagctgatctgcctgcgctgctctgctctgctcggtggacgcgggcctgcggcagtgccagcggtggagaagggaggggaggtgggcatcgggtgacctccgtgacactcttgatgttgggggagaagcccgacctggtctgcgagccgggcgacatgctcgggcaggcgacgcgaaccaaagacacaaaacaagcgaagcggaccccctcttcctcctcatgtcgccatccgccgccgccggcgaaaccccgtccggggagccgcggagagcaacaccagcgccgaggagtcgcggtggctcgcggccctctctgaacccgagctcgtccgtcctccacttccctcgtaatctctccttccaaccacagatttttcaacctttgatggtttcctgcaggatttgctcatcagcctgaagatgctggcctgtcacctgctgtcacccgctgattactctccaaatgcaaagttcatttccgtcctgtcacccgctgattactcacccgctgtcacctgcaggatggtttcttgctttatttccgtcctgtcacccgctgattactctccaaatgcaaagttcatttccgctttggtggcagacctattgtctttgttactgatttatgtgcacttacgccatgccttgggacattcagctgtttctgttattcttcaaatactctgaatctgtgtgtcaaggggggcagatttggagcaaaactttgaattcatggtaagcataggacggtttccctgattcagagttgcggcatataatagtcttcacacaaatgcagc

SEQ ID NO: 216 - DNA, 1383 bp, Hordeum vulgare
ttctctgtctcattctcccctattctaatcgatcctataggctcccacgtcggccgccggccgccggccgccgcccctcgatcgatctacaccccggagcgtcgccgcacaccctcccctattatccactgtcctggaacgccgccccacaccagatccgtgcgaccctccatcccggcgcgccgcccctcggcaacactcccctgcaaccctgcttctgtggtgcgccgttcctcgtcactgctcccctgcggccaactgcgtctgctacctctacacggggtcctgcggctatggggagagttgccgctacaaccaccctcgcggtcaagctgtcgtggtatgtggcatgcaagcagagcaaatgatgaacttaacaattaccaaatctacctcatttgatctgataagcacctcctttctctaacgtcatcagttggggtggcacctggtctccaagcagcatacacaatttctctccaatttcgtcatttttcttgaagagaaatagcataaggagaaaccattactgatgtgacatctaactaacaatttctggtcaccataatagttttttctagctaccaatgtgaaacacaagattgttagcccgtgcatgggttgatgactactttgcatagtagaataaccttactagccttttttacaatgttcgaagaaacttttgccttctatgttgaaaaggctgggaggaagatgcttgcattgtctaaaaacactataattgtgattttctgttgtaccatgataggaacttaaatcacaaataaaacattaactatctaagcttttgcagttcattaatggttacaactgtaataatatttgttatttttatgtagtgtgcaatggatttagaatccaccaaattactattgcgatttcctagagaaagtcctcatttcttagccggtgtagatgaacttctggagtttgcatatagagatatacttgtagatacaatgctagtagcctgcctctatcacttcttgcatcatgtcaatgcattgtatgttaatagttcatttgtgttttttgtatgtagattcaaaagataaatggatgattatatgggtgcatggaaactatacaacaatgatgaagacgatgttcctgttcatgatgatgatgatgatgatgatgatggaggcttttagttttaattaagttgtagggatggagttcttgctagatgatgttcctcgttaagttttagataagttgtacaaatgttgatggatgcttcgagtttaagttttgttgtgaagaaaatatttagattgcacatcacatttggatgatgttcctcatgtaatatcattactctaatccaacaattttatctaatatatgatttcttcc

SEQ ID NO: 217 - DNA, 720 bp, Triticum aestivum
gccaaaccaacccaaaaagcatttggtacgaggactctaggagagtgaagccatgaagaagagcgttgtcctgtaccctggcgtcggcgtcggccacctggtgccgatggtggaggtcgccaagctcttcctcaagcacggcctggccgtcaccgtggtgctcatcgacccgcaggtcgagtccacggacttctcctccgccgtcgcccgcgctagggcctccaacccctccgtcgccttccacgtcctgccaacgccgcccgccgattccaactccgacaccgcgcccaccaaccccgtcgtccagattttccggctcctgaaatccatgaacgcccccctcctcgacttcctccgctcgctgccctccgtcgacgcactcgtcctcgacatgttctgcgtcgacgcccaagatgtcgccgccgagctcaagctgccggtctactacttctacgcgtcggccgccgccgacctcgcgctcttcctcaacctgccgactatgctcgccggcagtaaggtaaaggagctcggcgactctatcatcacttccccgggtgttcctccgttgaaagcttcggacttacccgaggttacacacaacgatgaagtactcaagaccatcttaggcatgttcgaccgaatgccagattccaatggaattctcattatttccttccgagtcgtggagaaccggggggtgctcgctctcagggacgggtt

SEQ ID NO: 218 - DNA, 1501 bp, Sorghum bicolor
ctttcccagttcacacggacccgtgtgtgagcgcacccctcctcgtgctcctatggaggccaccccgatctccgtgaaaccaccgtcgccggcgctggcggcgccacccccggccacgctggggcccagggacatgccaacgcatgccgtcggagggaccgagctggagccgtccagcatgaaccagctggcaatagccccggaccccaagcggcagagggtagaggaggctgcggatggtaacgggtgcaagcattgcgcctgcaagaagtccagatgcttgaagctctattgcccatgtttttctggaggtggttattgttctgataagtgtggctgccaaccatgtttcaacaaagaagctttttcagaaacagttcagactactcgcaaggtgttactttcaagacagaagcgtatgtcaatgaaaattaataggagacctgaggcaaatgctgaacctatggaagatgctcaccattcttcttcttcaactccaccaaggagaggttgcaactgcaagaaatcaagttgcctaaagaaatactgtgattgctaccaggatgggaccggatgttccttgttttgccgttgtgacgattgccagaatccttttgggaaaaatgaaggcataatagctgatgatagtaagcgctatctatatactggtgctgatttggatcacagcgagggtgaacatgactttgttgtggagcgctcgcctcgtctacaatcacctatctcgaaggagtcttctttccaccaaaccccacctcatcttagggtctcaagcagagacacacatgtgttcccacaggcgatatcccagtggcaggcactgccccgctcgtggcagcattgtgccaacaagaggaacagcaatgacagggtgatggacgactctgcaaactacaagaactcaaaccatgactggcagctatccaagcacgaggacagctacagcatatcgaagtgcgtccagatcctgaacggcatggtggagctgtcacaggtggagaaatcagttgcccccgatgtcttcctgcagccaggcaaccgggaaattttcatctccctcagcggcgatgtgcgcgccatgtggctgaagcgcaagattcagcacctggcctagggtgggttgccttgtgccgtccttccgagtggagattggaggggacattgagttatcttttagatcttgcgtgttctgctgatcgtgggcatgcacaggattctaggtttttttttcccctgtatattgagtgtattcctggattataaccattatgtattgtctttgtagagagccattttgagcctggtatccgttaataaaatgagattgtacacctacaggtcgtttcgcggcaatggttgatggtccatctctcttgcccacgcgacctgtcgtcccagtggcctcagttttgtactactgttgttaccgctaccaggttgggcagtattagaaatttagaagtaaatgctactggagcgtttt

SEQ ID NO: 219 - DNA, 1345 bp, Glycine max
gaagaatgctccgttcaactccaattccggcaccgtacaattcggtgccagttctctctcgcgcccgcacgtgtcactctctagcacctgcacgtgccgttcattcccattcctctttcgtttcgcggctcgtgttcccacaattccggcaatacatcgtaaatgttcccggccgagtgtttgtcgcggcagccgcaaagaagcaacggcgcggcggcgctgaactcgctgtaacggacgacggtttcgacgatgacgaggagtacgacgacgacgatttttatgatgagtacgatgatgatgatgatgatgaagaagaagagtttgatgatgatgaagatgatgaggggatgctttcattggagaagatgaataaatggtttgagaagaagccgaggggttttggcgaagggaaagtttacgacacttcggttgaggataagctgctcgaggaaatgcgccagagtagaatagcgcaggctgagaacttgaagaagcttatgagcaacccagtaaaacatgcttccaatgaaagtgttcaaaagaagaaagatgcagaacttgttccaattggaggtcgagtgtgcttggtgaacctaccaaagaaaaagaacatccataaagatctgaaatcagctttgcaagggattcctggcataattaatatagtcccagctgttactggaaacaagaagacgagggacccaatctgcaagggttttgcatatgttgatttcaagcgtgaagaagatgcagttaggttcgtagagttatacactggacaaactattacttttggtaaaattcagaagcagataaaatgtgagcttctaaatgtacagtcttcatcttctctgaaattaagcaaaaaccttagtgctgctccgcaacttgtggccgctgcctttgaagaagattcaaatgaggattctaacttggatggttctgcccgtagttcctgggatgagaccaattcttcagatgatttggatgacctggactatcagatgaatggagaagaacaggaagatgatgaggataatcaagagtctgtcactgctttgggggtagatcatgatgataatgtggaaatgaggatcgatcctgaaaatatttcacttccctcagagcaggttgacagaaaccccgcagctgtgcagaagtcgtctgccaaggttaaacaggagaatgcccgtaagaaaaaaccaatttccaaagagaaaaccaaaaaagttttagatgttcctggatcctcaagaaggttaaagatcagggagaaagctgtattaagtgaggttttctccaagtacggattaaaagctacacttgcttcaaaagataatta

SEQ ID NO: 220 - DNA, 925 bp, Hordeum vulgare
agataatacagatgtaacatgtgaacctactggtcatcaaacacgacccagacgaagtgccactcgttattctaatttatcagagagaaaaaagaaaggaagcacagggagaaaaaagaaagagagaaaaaagaaaggaagcacagaagatgagatgtctgaacttcccatatatcttgagccaaaagacgatggtctcccatttgcagacgaaaatcaaccagagggtggtgcattgtgggatatattccgccgggaagacgccagtaaactgcatgagtatctaacaaagcattcagaggagtttaggcattacaactatgaatcagtaaagcaggttattcatcctatacatgaccagtgcttttacctaacaaatgagcacaagagaaagcttaaggaagaatatggagttgagccttggacatttgaacagaagcttggtgatgcagtctttattcctgcaggatgtccccaccaagtcagaaatttgaagtcatgtataaaggttgcacttgactttgtttctccggaaaatttacaagagtgtatcaggctgacagaagagtttcgtctgcttccaaaagggcatagagtgagtgaagataagctagaggttaagaagatagcttttcatgcaatcaagaaagccattcattatatcaagaaaaaacctgaggataaaagctctgatgacgaagttcaagataaacctgttccaagaaaaaggaaacctggtccgaaaaagggaaaacttggtcgtccgaaaaaagggaaaactggcccagttgaacctgcagaaccagaggagcacgaagaacaatcagctcaggaaatgtccccagttgaagatgaaggtgcagaaatggaggcggaccaggggcaatcggctctggacatgtgtgaagcgaaacctggcacaagt

SEQ ID NO: 221 - DNA, 876 bp, Zea mays
cctaattcgaaatcgaatggggtcggtcttgtcgtgcgtgcgtggctgcgcgagcgacttgactgcacccgacccccctcctcccagtccccacacactgcacgccgccgccgggtcctcctagggtttcgccgcgatgtcgctccggccgagcgagcgggagcagatgcggaagggcaactacaagcagacggtggacgcggaggagagccgccgccgccgcgagggccagatgatggacatgcgcaaggccaagcgcgaggaaagtctccagaagaagcgctgcgatgggtttcccgcctccgccgccggtgtgccgccgatgggccactccaccgcgctccagcagaagtcccccaatcgaagaggtgatcagcacaggagtggtgtcgcgattcattgagtttcttacacgtgaggaccatccccaactccagtttgaggctgcatgggcactcaccaacattgcatcaggcacatcagagaacactaaggtggtcgttgagagtggtgctgtgcgcctgtgcccatctttgtcaagctactcaactccctcaagcgaggatgttcgtgaataggcatgcactaaattacaagagatgtgtcttattatgacccggggcagatccagaatttttctatgacccaagccaaatctaccaaattttcttctttttattttatcttaactattttgtaccatattaaatagagacttatatagagttacatggatcaagccctgggccacagatcgggtggcctgtggtgtagatctgccactgattatgactatggatgagacttttgtgatgtaattgatgagactatggatttaaatattgttatgtgattgtgtgtgagatattttatgtg

SEQ ID NO: 222 - DNA, 1331 bp, Pennisetum glaucum
ttacaaggctgtcatgcactatctccatcatgatccttggtatgtggaggtaaatatgaattctggtgctactgtttggccactattcaatagcctgcaggcattctggccaggacttcaggttttagccggagatgttgatcctgctattcgaacgcatgctgccttcttcagtgtctggaaaaagtatggtttcacccctgaaggttttaatctcgctacatcctctgtccagaatggacaaaggagctatccgctacggccagagttgattgaaagcacatattggctgttcaaggctaccagagattatagataccttgatgttggaagggacatattagcaagtcttcaatatggtgctagatgtccttgtggctactgccacatatcagatgtggaaacacacaagcaggatgatcacatggagagttttttccttgcagaaacagttaaatatctctggcttctctttgatttagccgcgggccctgataacattgttgaaaatggaccatataagtacatatttagtacagaaggtcatttgctacccattactcctgagatagccttggtagatgaacattgttcgtattttggagcattctgtaatggcagtgcagaccatggatatggtacaagtgctagttctatgaaacataaaaaagcaaactatactcatttagatgatatcgaaaccgcttccagtcactattcagcatccaacatgtttgcaacaagaggttacatcaagggagtttgtccaggattgactcatgcacagaaacttgggatatcatactctgatgaagagggtagcgatatagagcagacttctgatggtcatgagcatcatgatgaatctacaatagaatctagcgcccaagcccaatcgagtaatattatacttatatctcacccagtggcaagccaacaggatcaggctttggagagcaggtctggacatggagatcatgctgatattgtggtaactgctgattctgattctgattctgtttctgattccatgagccatgataataatgatggttcactcggtgcgaacactgagcaacttattgaggacaccaagcggacctccaaacattcagaagatgaagatattgctcagaatttgaagttggaggatatcagctgacctttagttcatatagggaccaatttttgtacttatctgcagaatcttcaggatggaagcttgctcaatgcagaacaagttagtaagcaggcaatgttagagcctggtggatgctgcgatagtatctggctcgttgactagttgagatgagctgatgaggtcgtggggc

SEQ ID NO: 223 - DNA, 850 bp, Oryza sativa
aacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgctctctgctgcgagtgcggctgcggcgttgcatcgcatgctctttgtgaattgtgggtgagagagcggtggccggacgagctcgccggagaggaggaagaagaagaagacgacgagcttagctttgcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcgacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttttgcattttaagctggtctagcttctgtgccgttgatgatcattttggttggaataaataacgatttgattc

SEQ ID NO: 224 - DNA, 3240 bp, Sorghum bicolor
tctcagaccagtatcgttgacccctcctcctcctcctcctcctcctctcgctcttggatctgaccctgcttagccgccgccgactctgcggaggcggcagcagcgacgtgggaggagagagtactggtgaagacactgaagcagcagctgcagggagagaagcaccgggcgccatggcggagacggcgctgggcatggccaccacactggtgggcagcgcgctccgcgtcgcctcatcagcagcaaaggaggaggatgagcctgctgcttggggtgcacgaccacatctgagaaagatgctagcacctaccacatcaaagaggttcatcagcgatgagctaaagatgatgcaagccttcctcagagcagctgatggagcacgtgagaacattggggtgttgaaggcgtattcggagctgatccgtgatttggcctatgacattgaagatagcctagaggagttcatggtgtttatcaagaacaagagccttgtgaaacaacttctcagcttacgtgagcgtcatcgcattgctgtccagatacgcactctcaaactaagagtccaggaggtgagccaaaggaacacaaggtacaatgcaatcaagctcacaccatccacctccactaatgtgataggtgacacagagttcacccggaatttcacagctctaaatgttgaggaagcccagcttgttggtttggatgagccaaagaagaaactgatggaattaataggcatattggatgaacccaaggaacatgaatcctccaatactggtccaagagtggtatcccttgttgggatgggtggcattggcaagacaactctcacgaagaaggtgtttgatagcaacgatcttagtgacaagtttggcactcgtgcttggatcacagtgtcacagtcattcgagcaaaaggagatttttaaggagatggtgaagcacctctttggagctgagttattgcataagctcttagaagatcatcaagggcaacaggttacttttcaagatagtggtaaggatgatagttgtgtggtagtgactacaaggaatcaaacattagctaaatactgtagtcccccatcacacatccaccaacctgacttcctagggaaagaagaggctagaaccttgtttctgaaaaagacaaacagaagtcttgatgaactggagaaaggtgacaaaaccaaaggaattgttgaaaaaatattgaataaatgtggtggactaccacttgccattttgacaattggagccgtacttgccaataaggacactgaggagtgggagaatatatacatgcaactcccctgggatcttgcaaacaatccaagccttgatgcgctaaggcgagtggttagccttagttacaaccacttgccttcgcgtctcaagccttgctttttgcatctcagtatctttcctgaagattttgagattgaaaagaaacacctagtgaataggtgggtagccgaagggttggtagcagatgacacaacaacaataacacttgaagaagttgctgaaaattacttctatgagctcatcagccggagcctgattcaaccatctaagttagatatactgggaaacgtgaaaacatgcagagttcatgacattgtgcatgatattgcggtgtcaatctctaggcaggagaactatgcattcatacatggagaacacacctccaacatatcaacaagagtaggcatccgacatctatcatgtgttgctagcaggaaactgaacactgctatggatttaagctgtgtccggtctttaactgcgttcagtaagcctctagagctaaaatccttagtttggtcatccaagttcaagatgttgaggattctggatttaaaacatgctggatttacggcaatccaacaagatataaaatacatagggttgttgctacacttgaagtacttgcactttccaaagcgtataaatagtagtgtttatgcacttccaaagtctataggcaatctgcttggcttacagactctagacctacaaagatcaagtgtttcgaccctaccaatagaaatcactaagctgcataaccttcgcagccttcgatgtagcaaggtacctaattatgtttatttcaatccagcgcaacctgcgacggagtggttcacggatgccatagaatgtttaacgagtgagagtggtgcaactgctgacctgcacatggccttgtctagttgttggtctaattcatccggcattaagttgcccaaaggagtgggaagattaaaagagctacaaatactagagaaagtggatatcaagcgaacaagtcggaaagcaatcaaggagctaggggaactaactcagctgaggaagataattgtgagagggagaggagcctccaagaaaaactgcaaggcattctgtgaggctgcgccaaaactgtgctccctccgttccctcaatgtgagtaccatggagagtaaaaaggcagctgaggcgctggatgtggtggtttcttttacatcccctgtcccttctcttgagcgtctcaaattgaaggggcttcttcagaagatacctgcttgggttggtgaatgtgagaacttggtgaaggttgacttaaaatattgtcagctcaaggaattggtggccttggctgaactgcgcaacctggtacagcttcgtcttaaaaaagatgcattcgatgcagagaatttagtgttccacgagcatggattcccaaagctcaggatcttaatcataaaggatcattatgtaatggcactgaaggaggtgacctttgagcagagctcctcgcccaacatagaaacaataggcatcttccattgccatttggaagcagggatcaatggtatcaaacaccttccaaaattcaagaagatttgtattaacaacaatgatttggggaagcaaagtagcatgttacaagaggaagtggagaatcacacgaatcaccctgtgctgcaaataattccgggctccgcttttgatccaggacagaatttgtactcttgatctgccttcacgtctgcacagtccaagctcctgcacatcatcagcagcaggagcctcccttcttcgtaatcatcactctgttcaattatatatgtgtctcctgccctgaggactgcttcaatttgtatcattgtgccttataatactctttgtgtgtaatataatctggacagcagacttgtgttccactgttcgtgtgtggcctttactaatgcaaaagcca

SEQ ID NO: 225 - DNA, 2619 bp, Zea mays
cccgttgtcccctccaccagtcctcttcgggcctcagccttctcccccttacccctctccacacggcgtcgccccctcccatttcgccggcatcgacgatgaacggcggcggcgggcggcggcggtactcctcggagcagctcctcttcgacgttccgtccaatgccggtgccggccggtgggcacagcagtccggtggagtgcggcgcggggacggagagatcttcgtgtcggtggagccagcaacgccggcgcggctgcgcggaggggacgccgcggctggggactcgccgggacagaggcagcagctcagtcccgggttgctcgatctccatgctttcgacacggagctaatcccggattttcaagtaccagggatgtatgatggtgcccaaaagtttggctatggaggaggtctagatgaatctgatatgagattcacagcaaacaagctgatgagcaagtctgctgtttttcctgatggtaactacctgaaggccttcacagagaaagagaaggcagcacctgtcgcgaaaatcaaagtggtggtgcgcaaaagaccacttaacaagaaggaagtatcaaagaaggaagaagatatcatagacattgaacaaagatcaaactctttgactgtacatgagactaaacttaaggttgatcttactgaatatgtcgaaaagcatgagtttgtattcgatgccgtcttagatgaagatgtttcaaatgatgaggtttatcgtgaaacagtggagcctgtggttccttcaatttttaatcgaacaaaggcaacttgttttgcttatgggcaaactggcagtggaaagacatataccatgcgtccccttcctcttaaggcttcccaagatatcttgaggttaatgcaccatgcatatcgaaatcaaggatttcaattgcatgttagcttctttgagatatatggtggcaaattatttgaccttctcaatgataggagcaaactttgcatgagagaggatgcaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgctattaaacgccgtgtggatggcaatgactccaaaccacccagacctgttggcaagctgtcatttattgaccttgctggcagcgagcgtggtgctgatacatctgacaatgataaacaaacaagaattgagggtgctgagatcaataaaagtttgcttgctttaaaggaatgcattagagcacttgataacgatcagactcacattcctttccgaggtagcaaattaactgaagtcctgcgtgactcattcattggagactcacgcactgtcatgatatcatgcatttctcctagttctggctcttgtgagcatactctgaacacattgagatatgcagacagagtgaagagtttgtcaaagggaagcaatgccaagaaagatgtgtctttggcagtgcctttaagagagtcgagcccttccccactgccttcagttgtaccctcattctctgcatctgaggtgatgaatgatatcaccgagagaaacaattttggttggcccaagcagcagtatgttaaagaacggcctgctccgacatttgttgaacgaatgcccaaagtgaaggatgccgtggagttcgcaacatcagacggtgcttatttgaagggacaaagaagccagggctgtatggcaccaaatatagctgaaataccggatacaatgtaccagcagagaaggcaaccagcaaggaaggctaaagataccgctttgcggaataatatgagaaattccgttgcttacccaactagaagtgttgagccagacgaagatgatcatctgaataatcttctccaggaagaggaaggcttggttagtgctcatagggagcaggttgaagcgactctggacatcctcaaagaggaaatgaacatattaggcgaagcggatcagcctggcttccaacttgacgactacaacattacgagactaagcagtatactctcgcagaaggcggctgggattgtggacctacaggctcggttggagcagttccagaggcttttggatgagaacaatgtgctgctatatgctcagagcccccggttgtagttccatctgttgccttcatggcaccgtaaaaggtgggcatcggtggcttctaccagcgcctcaggtggcatcatatgcggtatcggcatgtcgctgtggccatgacccatgatgctgcaatttgtttttaacccataggtgccggtgaaacgcaaactagatggctagttcacagcctgttgccatggttctttggcatggccggccccgcaacctattttgtactagagttgctccattcttgtctttccgcgctccatccttaatccaatgtgtatatcttgtatttgtccgtgtcacatgagtgctctgttatttgtagctcaacaaatacatttttttacctttctgatgtatgaagttttccagagtgtacggtatcatccagttacacacatacttttgccaagta

SEQ ID NO: 226 - DNA, 1251 bp, Vitis vinifera
tacctgatggccaagcagttgctgtgaagcaacacaaattggctagttctcagggtgatgttgaattttgctcagaagtggaagtcctgagctgtgctcagcaccgaaatgttgttatgctgattgggtactgtatagaagacagaagaaggttgctggtttatgaatatatatgcaatggctcactggattctcatctatatggacgccatcgagatccactagaatggtctgctcgacaaaaagttgctgttggagctgctcgaggtctgcgttatcttcatgaagaatgcagagtgggttgcattgtccaccgtgacatgcgacccaacaacatcctcatcacccatgattttgagccactggttggggattttggcttggctaggtggcagcctgatggagacacgggtgtggaaacaagagtaattggaacatttgggtatttggctccagaatatgctcaaagcggccaaatcacagaaaaggctgatgtatattcttttggggttgtcttggtggagcttgtcacaggacgaaaagctgtggaccttaaccggcccaagggtcagcaatgcctcactgaatgggcacgtcctttattggaagagtatgccattgatgaactagtagacccacggctgggaaactgttattcggagcaggaggtctattgcatgttgcatgcagcatccttgtgcatccggagggatcctcatgcaaggcctcggatgtcacaggtgttacgcattctggagggagacatggttatggactcaaattacatggcaaccccgggttatgatgtgggcagccagagtgggcggatttggtcagaccagcatcaacattacagtggtccaatattaaacgaggcatatgaagaattcagtggtaagctgtcccttgaagcgctaaggtcagccttctgggagaaggataagggcaggaggacttcaagcgaagacaaattgtaaggctaggagtgctacatgtatgggaatgctgaagatgcatttgcctattttctttttcacttagattttttttcttgtttttcttttcctgcccaatgtcatctagattttgcttctgtacagtagagggggaagttaggtgggatagcaaggttttgtaattcattgagagatggggagaaagagtagtaaaataccaaatggcaatatgaacaatggtggatgtcttttgtttgaatcaaggaagaagctctcaaaaaatatgttttgctca

SEQ ID NO: 227 - DNA, 1940 bp, Triticum aestivum
gtcgacccacgcgtccgggcctcttgccatttactatttaggcgccgtgtaggtggccggccggcagggacacacatccatccatcgaccgccattgcctgccaaccccgtcgtgtaggtaggtgactggccggccgcggtagtgagtgaaggcttctgtgctctgctctgctctgtgaggcggccatggcggggctgcggcttcttgttggggcgctttggctgctggcggtgctgcggcagggcgcggcggcggaggcgggggccgtctccgtggacgggcggcgcgccattgcgtccacgggcgaggacttcgtgtgcgccaccctcgactggtggccgcccgacaagtgcgactacggcacctgcagctggggccgcgcctcgctcctcaacctggatctctccaacaaaatcctgctcaatgccatcaaagccttctcgccgctggtgctccggctgggcggctcgctgcaggacaaggtggtgtacggcacggcggaccggccggggccgtgcgcgccgttcaacaagagcaagtcggagatgttcggcttcacccagggctgcctgcccatgccccgctgggacgacctcaacgccttcttcgagaaatctggggcgaagatcgtgtttggcctgaacgcgctcaacggccgggtgccactgcagggcggggccatgggaggcaactgggacaccacgaacgcggcgtccttcatccggtacaccgccggcaagggctacaaaatctatggctgggagctcgggaatgagctcagcggcaccggcgtcgggaccaaggtcggcgtggctcagtacgtcaaggacgcgatcgccctgaagacgacggtggacgccatctaccggggcagcccggagaagccgctggtgctcgcgccgggcggcttcttcgacgcgcgctggtacggcgagctcatcgccaagaccaagccagacatgctcaacgtggtgacccaccacatctacaacctaggggcaggggtggacagggacacacagctgatggacaggatactcaacccgaagacgctcgacggcatggcgggcccgttcagggatctccaggggctgctgaaagccgcagggacgtcggccgtcgcctgggtcggggagtctggaggagcttacaacagtgggcatcaccttgtcaccgacgcatttgtgttcagcttctggttcctggatcagctcggcatgtcggcgaaattcgacaccaagagctactgcaggcagagcttcatcggcggcaactacggcctgctgaacacaaccaccttccagccaaatcctgactactacagtgctctgctgtggcatcgcctgatgggaaccaaggtgctggaagccaagttcacgggcaccaacatggtccgcgcctacgcgcattgcgcaaagcatgctccggggataaccctgctgctcatcaacctgcacgtcaacgcgacgaaccacgtctcggtggcgggccgcggcgcacacgccggaaggaagcacggggggaggtttgctcagccgcccggggcggcgagggaggagtaccacctcacgcccgagggcggcaacatccagagccaggtgatgctgctgaacggcagggcgctggccgccggcgccgacgggagcatccccgggatggagcctgtcaaggtggacgcggcgcggcccatcgccgtggcgccccggtccatcgtgttcgtccacatgccggattaccatgcccctgcgtgtgcttagttagggctttttggtgttcttgttggtataggtagtggtgataaaagggtggcttgctaagcatgtccatcctagctagggtagttataagatggctgaagagagtgtgtggctttgtgtgattagatgtaataagtttggagggaaaattgaattagtgaaacaagaggcaatgggaataa

SEQ ID NO: 228 - DNA, 1240 bp, Triticum aestivum
ccacgcgtccgccggactactgtcgttgttaccaaccagccggcaatctccatccacaagctctaaagaaagaaacgggcaatcagaaagccttctcttccaagaagtgacgcgggagaggggcagagcggcgcaagccatggccatggcggagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaaggatttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcacaccatctacattctcttctctagaagcgaaatcccgacagcgaaggaagatcaagaaatcacggatctcgcggacctgtcgactccccttccagagtggttcaccgaggaggatcttgcagtctacacgtccctctatgagaaatcaggtttcgtgtatccactgcagatgccatacaggtctctccataagaggcaaccaatcgaagacccaaaattcgaagtcccggtgttcgtcgtcatgggggagaaagactacgtgatcaagttccccggggtcgaggccgtgttgaaaaatggcaccatggagaagtttgcgccggatctgaagatcacttacatccctgaaggaagccatttcgttcaggagcagttcccggacaaggtcaacgagctcctccttggcttcctcaaggaccatcctgtggcttgacacacggggtctataagtctattatgcttggcctgcacttggttgagcaccctactccgtgcacattctgcagtgttatgaacatatgatgcgtgcttcctgtgaagtgaaggatatgctagtttcatcaacaacctttaataa

SEQ ID NO: 229 - DNA, 1817 bp, Triticum aestivum
aggttcgctttctccgatcctcacgaaaccgccgcgcccttctcccacccgcgcccttccccgctgggccatgcccctgccgccgccgcagcagcagccgcgatggcgcgttgcggcgtggaggtgatcgccagcaggggctgctccaggctgatcctccccgggatgcagccctcctcggcttccgccgcctcctcctccgtctcggcctcccgctccgccgcggccgcccggcgcccgcccgacggccccttcgccggcctggtcgtctgcgtcacggggctgtccaaagaggcgaggagtcaggtgaaggaggccgctgagaggctgggaggcgagtacagcggcagcttgcaccccaaatgcactcacctcgtggtgcagagcttcgccggccgcaagtttgagcacgctctcaagcatggtcccaggatggcttttgttgtcacgctgggctggtttgtcgattgtgttcgaaggaacatgaggctggatgaatccttgtacagtatcaagaacattggggagaacggtctgctgctcggggaatccaaccggcttgttggactgcctgtcaatgagaagtcatgccttccaccaatgatttttcaagacaaagcatgctcagacacaacacataagcgccagcttcaggctcatagagaagaacctgaagatgatgtgttcgtttttacgaatgacacaatctacattgaccctgggatatctggtgagatgaagaagaagatatcggatgctgctacgagtgaagatgcaaaattattggaccactggtttattggttgtcatgccacatatgttgtgtgtgaggatgcttctgtcaagagatatgttggtcactcagataacattgtaacaccgttttggatcttgaaaacagtgaaggaaaagaacttgcagcgcctggtccatttgtcttcagacctagctagacatgtcgcagtggttctcgaaaatttccacacatctcgagagaatacgaaacttgggagtgttccttctcttaactccagcgagctgccaacccaaggggagatagatgagactcatcaggaaaggcaaaaatttgtcgaggcagcgaaaaaggatattcgagaccgtcgtgttcgccgtatgcagtcatgtgaagtaccaatccatccgctcacacctgtcacacttctggattcaatctgctggacaatatctgagccggtttcatctgcaagtatttatatggattcttcatggtctgaagatgccgatgagcagcaaagcactacttattttgatgcagatggggatggaaaggatcgagaccagtcagctgataatttgtctcgcccgctaagagaaagtgagagaagcgaggtgatttttaagaaccatttctttaccatactcttccctctcgatcgttttggcgagcttggaccttcttcgaggacattcttcagcaatggtggcttcacacgcgaacaagtgttggatcacatctataatttctaccaggagaatatgtcaaccgacgagataaatgtagccctgcacacggattcacggcatgccgatcgacttcgttccctgtacgcaagcgctgaatgcgcagaacgaggctttgtagtagcattcaaaagaatagattttttgggaagccggagaagtttcgaggcactaaagcgccttagcagagagaacaatagcaatgtatatgagcttgtgattagggcatgaaccgcacccctactcggtgccatttagtaaaatttgtttgttgcttacaggatgtactgtgccatgtccatggtatgcagaat

SEQ ID NO: 230 - DNA, 1228 bp, Oryza sativa
atggcatccgccgtttcgctcctcctcctctcgtccccgcgcccgctccgccgcgcggcgccggtgccagcgctacgctcccaggcgcgccaccccttgctcctcggccacgcgggcgagaccgcgctcggggtatgggccacgcgcgcccgcctgcccgcgccgccgccgcgcgcctccaacccgaacaacgacaacgacaacagcggcgccgtggaggcgcccgaccgcctggtggccgccgtcgcctacctctacccgttcctcgacggcgtgcaccacggccgcttcctcctcgcgcagttcccgctcttcagcaccctgctcagcccgctcgcgccggccgcgcgcctcttccgctcctccccgctcacgcccttcctcctcttcctcaccctctacttcgccgtcgtgcgcaaccagcaggccttctcccgcttcgtccgcttcaacgccatgcaggccgtcgcgctcgacgtgctgctcatcttccccgacctcctcgtgcagtccttcgcgccctccaccggtggcgggatcggcttcgagctcttccagagtatggagagcaccgtgttcctcttcctgctcgtctgcctagtctacggcgggggcgcgtgcctgctagggaagacgccgcggctgccaatcgtcgcagatgcagccgagcgccaggtgatgtgatgagcttttgtcaaatcttgctggtgaaaaggaacaaaggaaaatgatatacacatccatctcgatgcctcattgatgttagtagatcgcaaattcacaagttcagtttagtacagtgattatttacagctgtagtaaccaatttaatgaatggagttacggaaggttggtacaatggcattacaaaatttacaatcaagtgtatgaacgaatgagttgaattgggaatttttagagatagcaatacatatactcgctatagaatatggaattctggactacatttacagatgatgaatgagaaattggggagtgtcctcaagacctcccctgaaggagcttcaatggtatatgaatggatgcttaggttagttaattgttgttgcaatataaataaaataattgcatcaattggggattgtggttgctgctaccaagttattgtctgaacttgatgatgtctgaattttctagtttggagaaaaagttctagcttttattgcaccgcctcttggttatttggatgggctcttcatcttcattg

SEQ ID NO: 231 - DNA, 1295 bp, Triticum aestivum
ctcccactgaagcagcggcggaagaagaagaagctagaggacatgggggcgcagagagctctcctcgcgagcttcctgctcgccgcgttggtcacccaggccttcgtctccgtctcggccaggaccggcccaacggacaaggcaagccaagatgacgtgaagaagccggactgcgtgccgtcgctcgacccgcacaatttccccggccacgggggcaccacggtgccgcttccctcgcacgggggctcctccggcacgcccccctaccacggaggctccggcacgacgccgtcgcacggcggctccggctcgactccgtcgcacagcggctctgggtcgttgcctgacccttcgcacggcgggtacgggacgccgccttcgcacgggggctctggatcgttgcctgacccatcgcacagcggaggaggttacgggtccaccccagatgcgccgtcacacggcggaggcgcgtacgggagctccccgacgccttccactggcggtgcctacggcagctcacccactccgtcccacgacggaggcgcctacgggagctccccgacgccggcccacgacggaggctcctacagcggaactccggctgcaccgtcgcacagcagccacgggtctgtgacaccaacgccgctcgtcccagtcgatcccaacagcctcgggacatgcgactactggaggacgcaccccatgcagatctggtcggcactggggagctggccgagctcggtgagccacttcttcggcgccgccggtggcgcggtcgccggcgggccgagcatgagcatccaggacgcgctggcgaacacgaggaccgacggcgccggcgcgctgctgcgcgagggcaccgccgcgctgctcaactccatgacccgcccggggttcgcctacaccacccagcaggtgagggacgcgttcgcggcggccgcagccggcggttccgacagcgctgcggccgcccaggcggcggcgttcaagaaggcccacgaggggaggaaggccccccccccccccctcgccatcgagagggctttagctagctggctacctatatctgtggcatgtctgcatgcatgcgtttaggccggacggacgtgtgcgttgcgatttggttgtttcgtttgagttatggtttggttgtgtacgttggtgtcttcgtgggctagcttcgatctatcgtactgtgttgtaatgaatctcgtttaagttttttgcagttccgtaccctgtcgcattgaatggaatatattgaagcgaactattcctagctcaaaaaaaaaaaa

SEQ ID NO: 232 - DNA, 842 bp, Triticum aestivum
acatttatcgcggtttggtttgttggtggcctctcagtgtttcacttgtatctcatgagcactaaccagacaacatatgagaacttcaggtatcgctatgaccaacgggccaacccatacaacagaggagttgtggagaacatcaaggagatcttcttcacgccgatccctgcttccaggaacaacttcggcgccagagttccacaggagcagggcctgaggcctcgctcgacgaacggtttcatgagcccaaacatggggagagctgttggcgacatcgagatgggcagaaagccggtggcatgggatgagcccaggatggcagcagagataggcgacctgggcggtctgggcaacttgctggaggacaaggatggcaggttccgcaacgcatcaccagatctaagccgtgacgccctcgtggtcggtggcttggatgagcaaggctcctcggtgatgaacccaccacggacgagctggggagtcgaagcgggcaggtgatggtaactggccaatgtggccatctaagcagctatagtggaggaggactaaggggtgtatgttagtgccagcttgttcgtagtttggtgtcgtggttgagactcggggtcagtgatgttgttattaggcctatgacctggttgttaattcttgcatcatgtatcagtggtttttaagcagattgttggtgtgtgaggtctccagttcagtagaatcttaattgtgtctgtatatagtttggagtggtgaacccggaaatggattggtttgctttggcttccgttgtcaaagattgtgaacggcattgtacctttcaatttatgctgccactccaaagcttg

SEQ ID NO: 233 - DNA, 1191 bp, Triticum aestivum
gccagatgctatcgtggccgacacgtacctgcagtgggcggtggcggccggcgcgcggctcggcgtgccggtgtgctcgctttggacccagccggccacgttcttgttggcgctctgccatttggacctgtggcgaccagcggttgaaggtttcagcgaagaagaactaagccgcaagtcgttggagcaatatgtaccgggcctctcatcagtgaggttgtctgatgtcaagatcttcctcgcttgggaggggccaatcaaaatatcagcggaggtgttcgtcaaagtacgcaaagcgcagtgcgtcctatttacctccttccacgagctcgagcccagttccatgagcaaaatagcagagttacttccctgccccatctatccaatcggcccttcaatcctgcgtgcgccggacaacgaagagaacgcccgtgacgaggagcaccggcgctggctggatgcgcagccgcagaactcggtgctgtacgtctcgttcggcagcttcgtcgccatgccgcccaagcagttcgaggagatcgccgtggggctgcgcgacagcgcggtcaggttcttctgggtggcccgggacagggccaccgacggcctcagggagatgtgcggcgacagggggctgccggtgccgtggtgcgaccagcaggaggtgctgcgccacccgtccgtcggcggcttcctcagccactgcgggtggaactcggtgctcgaggccgtgtgcgccggagtgccggtgcttggcttccccgtcgcgtgggatcagctggtgaacgcccggatggtcgccgacgaatggaaggccggcatcgacctgagggagcagagggggaaggatgggatcgtgagcagggccgcggtctctgctgccgccaggaagctgatggatttggacagtggtgccggccaagagatgaggacaagggctgcgcagctgcgcgaggcttcccgtggtgcggtcatcgaaggcggctcgtcccatcgttctttgaccggtttcctcgaggatctcggcaagggaaaactggacgtccctgaaagttctgcgtgatttccttcgtttactccagtcagtgatagaaaaatcgctgtttgtggttcaaaatggtgcatcatagtaaggccatgtgtcctacagatatttcatttattttgctgcacttgagagcattctgaccgatc

SEQ ID NO: 234 - DNA, 1352 bp, Triticum aestivum
catgggctccctttcatgaagtgcctgctcttcacctcggcagtcgccgttgtccttgctcttttccccgttgccgctgtcggcgccggcctgaaagtcggattctatagcaagagctgcccatcggcagagaacctggtgcagcaggcggtggctgctgccttcaagaacaacaccggtgtcgccgctggcctcatccggctgcacttccacgactgttttgtcaagggttgcgacggatcagtcctgatcgactcgacagcaaacaacactgccgagaaagacgcgccccccaacaagcccagcctccgcgggttcgaggtgatcgacgcggcaaagaaggccatcgaggccaaatgccccaagacggtctcatgcgcggacatcctcgccttcgccgcccgtgacagcgtcgcgctagcaggaaacgttacctacaaggtgcccgccgggcgccgcgacggcaggatttccaccaacgcgagcgccctcagcaacctaccctcgccgctctcgacggcggccgagctggtcggcaacttcaccctcaagaacctcacggccgaggacatggtcgtcctctccggcgcccacaccattggcgtctcccgctgctcgtccttcacaaacaggctatatgccttcagcaacaccagtcaggttgaccctacgatgagctctgcctacgcgttcctgctgaaaagcatatgccctgccaacagcagccagttcttcccaaccacgacgactgatatggacatcatcaccccgacggtgctcgacaacaagtattacgtgggtctgacgaacaacctgggcatgttcacgtcggaccaggcgttgctcacgaactcgactctgaaggcatcggtcgacgagtttgtcaagagcgagaagagatggaagagcaagtttgtcaagtccatggtgaagatgggggacattgaggtgctgacaggaacgcaaggagagataaggctcagctgcagggtcataaacaaagggagcgctggtcttgagatcaataatggacccgactatggtgaattcgctgaaatcgcgacgagctagtggctttttaggcccttgatttgacaaagaaaacaagcatgccgaacaactgaagatcgatcgtcctgctttttttgtgttgttccgtctgtttcttagtttttattgtaacgatgcaagataaaagttaatgttgcgccatgggaatggtgtgttgtgaattttaccaagatgacaatgggatgtttttgttcttgtatttacgcattctaaattcaggaaatggaagagatgatggagaaaaactactttcaaaaaatatggacaacattatactccat

SEQ ID NO: 235 - DNA, 1266 bp, Triticum aestivum
accaaggctagacacaagcaactgaaatgagctccctttccatgaagtgcatgctcttcacctcggcggtcaccgttgcccttgcccttttcccagttgccactgtcggcgccggcctgaaagtcggattctacagcaagagctgcccatcggcagagaacctggtgcagcaggcggtggctgctgccttcaagaacaacaccggtgtcgccgctggcctcatccggttgcacttccacgactgttttgtcaagggttgtgatggctcagtcctgatcgactcgacagcaaacaacaccgccgagaaagacgcgccccccaacaagcccagcctccgtgggttcgaggtgatcgacgctgcaaagaaggccatcgaggcgaaatgccccaagacggtctcgtgcgcggacatcctcgccttcgccgcccgtgacagcatcgcgctagcaggaaatgttacctacaaggtgcccgccgggcgccgcgacggcaggatttccaccaacgcgagcgccctcagcaacctaccctcgccgctctcaacggcggccgagctggtcggcaacttcaccctcaagaacctcacggccgaggacatggtcgtcctctccggtgcgcacaccataggcgtctcccgctgctcgtccttcacaaacaggctatatgccttcagcaacaccagccaggttgatcctacgatgagctcggcctacgccttcctgctgaaaagcatatgccctgccaacagcagccagttcttcccaaccacgacgacggatatggacatcatcaccccgacgctgctggacaacaagtattacgtgggtctgaccaacaacctgggcctgttcacgtcggaccaggcgttgctcacgaactcgactctgaaagcatcggtcgacgcgtttgtcaaaagcgagaagagttggaagagcaagtttgtcaagtccatggtgaagatgggggacatcgaggtgctgacaggaacgcagggggagataaggctcagctgcagggtcataaacaaggggagcgctggtcttgagatcaatgatggacccgactctgctgaattcgctggaatagcgacgagctagtggctgtttaggtccttgatttgacaaagaaaacaagcatgcagaacaactgaagggaagaaaatgtcgtcctgcttttttgtttgtttgtatttttccgtctgtttcttagtttttcttgtaacgatgcaagagaaaggtttttgttattacaatgttgcgcatggga

SEQ ID NO: 236 - DNA, 1557 bp, Triticum aestivum
agcaaccagacctacaagccgccgccaatattcgggccttacttcttcattgcagatccatatgtccccttcttagttgctggtggcaagaaatcgaagttcagtacagctgctgttgctggaatcgcagtggccggtggggttcttgtgattgccctcattttggtgggactgttcgctttgcgacagaagagaaggaacaaggaactaaaagaacgaagcaccgacccttttgcttcgtggggcgcggcgcagaaagacagcggaggagctccacagctgaaaggagcgaggttcttctccttcgaggagctgaaaagctgcacggacaactttgcagatagccatgagataggcgcaggaggctatggaaaggtgtacaagggaacacttgtggacggaatacgggtggcgataaagcgggcgcagtccgggtcgatgcagggcgcgccggagttcaagaacgagatcgagctgctgtcccgggttcaccacaggaacctggtgagcctgatcggcttctgcttccagcaaggggagcagatgctggtttacgagttcgtcgccggtgggacactgagggagaaccttgttgttagagggacgtacttgggctggaagaagaggctgaggatcgcgctcgggtcggcgagggggctggcgtaccttcacgagctcgccgacccgccgatcatccaccgcgacatcaagtccaccaacatcctcctcgacgagaacctcaaggccaaggtcgccgacttcgggctctccaagctcgtcgccgacaccgagaagggccacgtctccacccaagtcaaaggaacactgggatatttggacccggagtactacatgacgcagcagctgtcggagaagagcgacgtgtacagcttcggggtggtgatgctggagctggtgagcgggaggcagccgatcgagaaggggaaatacgtggtgcgggaggtgaggcaggccatcgacccggccgaccgcgactactacggcctgcgcgccatcgtcgacccggcgatccgggacgccgcgcggacgcccgggttccggcggttcgtgcagctggcgatgcagtgcgtggacgagtccgcggcggcgcggcccaccatgggcaccgtcgtcaaggaggtggaggccatgctgctgaacgagcccgacggggaggggtccaactcggccgggtcgtcggccaccgagttcgacggcgccggcaggggcgcgccctcgcacccgtacagcgacgtggagatcacccggtcgtcctacggcggcgccggggaggcgtccgattacatgccctacttcgaggtcaagccaaaataatagacacattgtacattcatttttggggtatagaaagtgtacattttgttccttctcgtgtcagcttgtgagttgtgacgatgaattgtacattgatttttttttgtacgtgttgcgagtgatgtgacttgtgatgcatcgtatagtagtattagattcttctttgttcattgtatgcgagtttcactctcttgacattcattggatgcaagttcattgttt

SEQ ID NO: 237 - DNA, 463 bp, Sorghum bicolor
cgcgcatctctccacgccatggacgggtcggcgttcctgtcgctgtcgccggagctccgcgacgcgctcgccaaggtggccgtgttcgtgctcgtccaggggctggtctacctcatcctccgcagctcctccgacgtcttctccaaggacggcggcgggctcaggtccctcagcttccgccccatgcgctccatgagcgtcaggcgcgtgctggctccgctctctgacgtccccgtcggcaccgacgagccctcgccttcgccgtcgtggtccatgtcgcccgccgcgtcgtcgtcgcgccgcagggctgcccgcgaggattgaaatggccgcaacttctgggtctgggcaccttggaatcggaggtagtttatttggtcgttctggattgtaattggtttgttattgtggatggaaatggtatttgagttcctatatgtaagtaaggccttgtttagttccc

SEQ ID NO: 238 - DNA, 2673 bp, Arabidopsis thaliana
accacaggcatgaacacttattccccactccaactcataccgacgcctattcatctcaaatcctcacgcgccgcctcaccgtcatcattacgcgtcgcttctccgttaattatacgcgccgcctcctcagacgactcacagtcagtcgaaaaccaaactctagaagtcctcgaatggcgtgccctctgcaatcagctctctccgttcgcttccacaaccatgggcctttccgccaccaaaaacgccgaaattccggtgggaaactcgccggaagaaagcaggaatctccttaacgagacctcagctgcattagctgctatggagatgatgaaatcgcgaggattaggtctttctgaaatccaagacttgtctgatatcgttgagcgtgctgtgtccggtcaattgcttaccgttagagaactctgtaccgttcgaagcacgttaacggctgctacatcaacgtttcagaaactccgaaaagcagccattagtgataacagggttactccacttgtagatatactacagggttgtgatttcaaggatacattacagcagaagattagtttttgtatagactgcaacatgactatgattcttgatagagctagtgaagatttagagattataagatctgaacggaggagaaacatggagaatttggattctcttttgaagaaaatatcaactaagatttttctagctggggggattaacaagcctttgataacgcagaggagatcaaggatgtgtgtagctattagagctacacacaaaagtttacttccaggtggtgttgttttaagtgttagtagctctagggcaacatgctttatagaaccgaaagaggcagtggagcttaataatatggaagtgagacatgcgaactccgagaaagctgaggaaatggcgattttgagcattttgacatctgaggtggtgatggcgcagagagagatattgcatttgttggatagaatattagaacttgacattgcttttgcaagagcatcacatgcaaattggattaatggtgtctatcccaacgtaacttcagaacacacaaaaacaccgggcttagctgtagacattgattctgcgcagcacccgctacttcttggttcagtattaggcagcccaaatggtggagacattttccctgtgccagtagacattaaagttgaaagcagtgccaaagtagtcgtcatctcgggtccaaacacaggaggaaagaccgctttgttaaagacattgggattattgtctcttatgtccaagtccgggatgtatttgcctgctaagaactgcccaaggttgccttggtttgatcttattctggctgacattggagatcctcagtctttggagcaaagtctttcaacctttagtggccacatctcacggatacgacagatacttgacattgcttcagaaaattcacttgtcttactagacgaaatatgtagtggaactgatccttcagaaggggttgcacttgctactagcatcctacagtatattaaaaaccgtgttaatgtggcagttgtatcaacacattacggtgacttaagtcgcttgaaggataatgaacctcgattccaaaatgctgcaatggagttctccatggaaactttgcagcctacatttcgagtactctggggaagtactggtctatcaaatgcattgagagtagctaagtccattggtttcaataaaagaatattagagaatgcgcataagtggacggagaaattgaatcccgagcaggatgtagagcggaaaggctcactctttcagtcccttatggaagaaagaaataaactaaagcttcaggcaactaagactgcagcttttcatagagacttaatgaacctttaccacgagcttgagcatgagtcgcatgatcttgataaacgtgagagggctcttctgaaaaaagaaacgcaaaaggtgcaagaagatctaaactctgctaagtcaaagatggagagactggtggctgaatttgaaagtcaactagaaatcactcaagctgatcaatacaattccttaatcctgaaaaccgaagaggcagttgcagagattattgaagcttgctgtcctatggatcctgattccttagaagaagaatacagtgactactcaccacaagctggtgaaaaagttcttgtaactggactgggagataagttaggtactgtggttgaagaacctggagatgatgatgatacagttctagtccagcatggtaagataagagtacgcataaagaaaaaggacataaagccccttcctcgtagcacaagtagccaaacatccaatcgttctctacgttcgaagagacagataaacatgaaagagctaggcagtgtgttgcaaatgcaaagcgaaccagtgcggattcaaacgtcaaagaacacattggatctaagaggaatgcgggcggaagaagcggttcaccagctagacatggccatctcgggaagagactcgggctcgatcctatttattattcatggaatgggggcaggcattataaaggagctagtgcttgagaggttaagaaagaacactcgtgtctcaaggtatgaacaggcaaatcctatgaaccatggatgtacagttgcttacattaaatgatatatctctcaaacacattctttgtaaatcttc

SEQ ID NO: 239 - DNA, 1046 bp, Sorghum bicolor
ctgaggaagaggataaagaacaccccgaaatgccactcctgctgctcccaccagcggcgtgcaccacggcagcgaccgcgccggcgtctctcgcgttctcgcggcctcggtcgtcacgggcgcgttggtccagcctctctttcgcgttcccccgcctgaggaaatacgggcgccgccaacgcgagcccgtggccgcccccagcctcgatgacgacgaggacgaggaggagacgggggcaggggagtgggagtccgacgaaggtgaggaagagatggaggtagacgaggaggagtttctggcgacgcggcccaagccggcgggatttggtgaggggaaaacgtattccactgacattgaggagcagcttctccgggagatgggcttcggcggtggcagcgagcggcgtcgaggagaggcggccccggccagtcgccgcgccggggatagttccaccaaagtaatggccgcagatgccagtgacgatggtgttcaagttcgtgtctggaaccttccaaaaaagaaaaacatacacaaggatctgaagcaagcttttaaagggttccgtggccttttatctatagaaccagcagtttccgcaaataagaaaactcgtgatcctatctgtaagggtttcgcatatctcaaactagagtctgcggaagctgcaacaaggttcgttgagatatactctcatcaaactgtgtcatttgggaaggttcagaagccaatcagttgctgtatcgtcgataaaggcagctctgttgagccttcaaaagcatccagtagtcaggcaacccctcaaccaatgttgaagcaccaaaaattggtagcggcgagttaagtaacacatgtatctgtcatctagcacaagtggtcacgcacacttctagaggtcgcaagttttctgaaaaagctttgataaacagattagattagatagtcctctgtattccaaacaattgctttgtacgtatcaagcaatttggtcttgttacccatctatataggcaatagtattggcatttgcgcatcagcgattttccac

SEQ ID NO: 240 - DNA, 2637 bp, Sorghum bicolor
caggcgagggggaggcagcgcaagccgcaaaacccacctcgcgcgccccgcctccaccgcccgccgccgccgccgctcgccggagagctctcattcaaaaactagcaaagatggtacaatgtactcaacctcctccccagttaaagctcccagagagtaagatcacagaactgacagatgatgagaaccatgattcgccgccaaaacttgagaaaaggacaaggatgcaccacattgagaggcacagatcttgtgttgtgaccttatctgacatagaacttaatggtctgcaacctcgtcgtctgctccagaccattgagaaaagcccaggaggaggatcacagtgttcgctccatgaagaaacacctacagatactaatgcatcacacaggcatgcaattgcagatgctgcttgggaagccctcaaaaggtcaatagtttacttcagaggccagccaattgggactgttgctgcaatagacaagtctcagggggcagcactcaactatgaccaggttttcatgagggatttcattcctagcgcattggcttttcttatgaaaggagaacacttgatagtgaagaattttctggtagaaactgcacgccttcagtcaagggagaagatggttgaccttttcaagcttggtcagggtgtgatgcctgcaagctttaaggtgcatcatcgcaatcctacccagaagacagaaagcttactggctgattttggtgaaactgccattgggagggttgctcctgtagattctggcttatggtggattattctccttcgtgcttacaccaaatggacaggggataattctctggctgaaagtcctaactgccaaagggccatgcaccttattctcaggttgtgtctctcagagggatgtgatacttctccagccttgctttgtgctgatgggtgctccatgatagaccgaagaatgggcatatatggctacccaattgaaatccaggctctctttttcatggctatgagatgtgccctaagcttgttgaagcaagactctgacgctgactttgtgaatcacatcacaaaacgaatccaagctttgagctaccatttgcacagttactactggttagacttccaaagacttaatgacatataccgctacaagactgaagagtactcacagacagctttgaacaagttcaatgtgatacctgaatcgatacctgattggatatttgacttcatgcctagccggggtggatacttcattggtaatgttagtcctgcaaggatggatttccgctggttttgcttgggcaacttcattgcaattctatcatcattggcgactggagagcaggctgaagcaatactggatcttgtggaggagcgctggcaagaactcattggtgagatgccactcaagatctgctaccctgcgatggaaaatcaggaatggcagatagtcactggatgcgacccgaagaacaccaggtggagctaccacaacggaggctcatggccagtgctgctgtggctgctggtggcggtgagcgtgaagctggggcgccctcacctggcgcggagagccgtggagctgatggagcagcggctggccaaggacgacttccccgagtactacgacggcaaggcggggcggtacgtggggaagcaggcgcgcaagttccagacgtggtcgcccgccagcctcctacccttcccgtgccgccgtgccggcagactcgtctgcgccaccgctgccggggaggcgccgcccgtcgaggtcgagcagcgggacgaggcggagccggcccccgccgcggcctccaacggggccgccgtcaaggccgaggcgcccgccccaaaggccgtgcaggctgaggccccgccggcgcccgcgccggtcccggccttccgggacgccaggtgggtcaacggcacctgggacctcacccagttcgacaagggcggcgtcgtcgactgggacgccgtcatcgacgccgaggccaggagaaggaaatggcttgaagattatccagaggccactagcacagacgaggctgtcgtcttcgacacttcaattatcccatggtgggcatggatgaagcgattccaccttcctgaagccgagaagctaaatggtcgcgctgccatggttggcttcttcatggcatactttgtggatagcttgacaggcgtgggccttgttgaccaaatgggcaacttcttctgcaaaacgctgctgtttgttgctgtcgctggcgtactgctaatcaggaaaaatgaggacattgaatcactgaagaagcttatcgacgagtctacgttctatgacaagcaatggctggcaacctggcaagatgattccactgggggaccaaagaattagttcagcattgggatacagatgcagaatcgttcttgtgatgtactttacctctttcttcggcctttttgtttcgccgtctcgtgaggcttggaggaacattttgacaaaccgtaataatctacgtgatcctgtaaaatagtatggactcactttgtgtgctagagataattacgtgcagtttcaatgctttatatggtttgccatctcaaagcatttctcatccaagcagtaagggcaaccatgccatggtattttcatcagtagtatg

SEQ ID NO: 241 - DNA, 1276 bp, Hordeum vulgare
cggcacgagggagagaactagttttcttcgagggttcttcatataactttgacctggaagatttgcttagagcttcagctgaagtacttggaaagggaagctttggaactacctacaaggctgttcttgaggacagcaccacagttgtggtcaagagattaaaggagatggtggtggggaagaaagacttcgaacagcagatggagatagttggcaggattggccagcatcagaatattgttccgttgcgtgcttattattactccaaagatgaaaagctactggtgtatgactatgtccctgctggtagccttgctgctgttttgcatgggaacaaagctactggaagagctgcactggactgggaaacgagagtgaagatatccctcggcgtggcgcgagggctcgcccatcttcacgccgagggaagcgggaagttcatccacggcaacctgaagtcgtcgaacatccttctgtcgcagaacctcgacggctgcgtctccgagttcggcctggcgcagctcatgaccaccctgcctgcccccgcccggctcatcggataccgagcgccggaggtcctggagaccaagaagccgacccagaagtcggacgtctacagctttggcgtcctgctcctggaaatgctgactggaaaggcacccctgaggtccccgggcgtgaggattccatcgagcacctgccgcggtgggtgcagtccgttgtccgggaggagttgaccgcggaggtgttcgacgtggacctgctccggcaccccaacatcgaggacgagatggtgcagctgctccaggtggccatggcgtgcgtggccgtcgcgccggaccagcggccgaggatggacgaggtgatcaggcgaatcgccgagatccgaaactcggactccgggccagcgacgccgccggaggaggccgcagcccaggcgccgtgagggcgggtcgcggagatgaaggagtcccgttgtgtttagcagaggtagctagctagctaagctaggttgctgcatagttacttggttggttatatagatagctttgagcgaaagttgatagccgcttgcttggttgattagtggggtgaggtttctgttgatctctgatttattctttttgttttgagaaattctgctgtgccgttttcggagtagtgaggctactgatcctgaatgagtatctgatgggctctgctggtgttcagagcggtgtttgtgttgttgtcctgtaatttggcatgcttttatcttagtgtgtgattaattctt

SEQ ID NO: 242 - DNA, 597 bp, Hordeum vulgare
catgctgcagtgggtcagggacaacatggacttcaacagcaccagggtcttcttcaccagcatgtcgcctacccacggcaagagccaggactggggggacgcgcaggggggcaactgctacaacgagacggcgatgatcgaggacgccgagtactggggcacggacgcgcggcggagcgtgatgcgagtgatcagggagatcctagacggcgatggcgccgacgtgccgctcacgttcctcaacgtcacgcagctgtccatgtaccgcaaggacgcgcacacctccatctacaagaagcagtggaacccgctgacgccggagcaggtggccgaccccaggacgtacgccgactgcgtccactggtgcctaccgggactccaggacacgtggaacgaactcctctattccaagctcttctacccttgatcacgcacgtttattttcacttactacaagtactcgtaggttgtagtgaggccacctaacggatctctaatagccggttagaatagtaaaaggaaaaggtttaaaatctatgggatgataacagaaaaagataaaccatgtgcattgattgacaaaaaaaaaaaaaaaaa

SEQ ID NO: 243 - DNA, 688 bp, Triticum aestivum
ccacgcgtccgcggggacgggcgccgcatgtccgggatcgtcggcacgccctactacgtcgcccccgaggtggtcgccggcagggagtacggcgagaaggtggacgtgtggagcgccggggtcgtgctctacatgacgctgtcggggtccgtgccgttctacggcgccaccgcaccggagatcttcgaggcggtgctccgcggcaacgtccgcttcccgccgcgcgccttcgccggcgtctcccccgaggccaaggacctgatgcgccgcatgctctgcaaggacgtctcccgcaggttctccgccgaacaagtcctgaggcatccgtggatcgcgagctgcggaggggatgcggttgcgggctgaagaaatcgatgggccaacatgcggcacgcgctccatccgcctgtagatagaagatgtctccacggacgacggctctgctctgtttctccggcaaatcggcgatggacagaagcagcggcggtgccggagttgagtccagtcagtagaactagcggtggttccttccgtgatcctgtaggtctagatatgggtctctggtgaagctggaattgcagaagctttcaccagagttagcctgaatgtgtgtttgttctctgaatctctgtactagtccttgtacatagtcttgttcagttctagctgaagaggaagagagggttta

SEQ ID NO: 244 - DNA, 905 bp, Brassica juncea
cgggcgaaactaaagtaagcaaatagcaaatacataaattcgaacattgcagctatggctcccacattgcaaggcgagtggatcaaggtgcagcagaaaggaggagagggacctggagcaagaagctcacacggcatagccgtggtcggagacaagctctactctttcggtggcgagcgtactccaaacatttccatcgacaaacacctttacgtctttgacttcaacactcacacatggtcaatcgccccggccaacggacaagcccctaacgtccaggctctgggcacccgcatggtggccgtgggaactatgctctatctattcggaggccgtgatgagaagaaacagttcgacgacttttactcgtacgatacggtgaaacaggagtggaagttcatcaccaagctcgatgaagagggaggacctgaggctcgtagcttccactctatggcttcggatgcagagaacgtgtacttgtttggtggggtgagcaaaaccgtgaggctcaagacccccttcaggttcaggaccattgaggcgtataacattgctgatgggaagtgggctcagctacctgatcctggtgagcaattccctaggttcgagagaagaggaggagctggattcattgtggtggaaggaaagatttgggtggtttacgggtttgcaacttcgcctgatcctaatggaaaaaacgactatgagtctgatcttgtgcactactttgatcctgctactcaaaagtggaccgaagtggagactaaaggagagaaaccttctccgaggagcgtgtttgcgcatgcggcagtaggaaaatacataataatatttggaggtgaggtctggccggacccaaacgggacatttggggtcccggaacatttggaccaatgagggtcacg

SEQ ID NO: 245 - DNA, 1236 bp, Triticum aestivum
cgaccccgcgtccggtaccactgggacctcccccaggccctggaggacaagtacaacgggtggctcgacaggcagattgtggatgactttgcggagtacgccgagacgtgcttcgcggcgttcggggaccgggtgaagcactggatcacggtgaacgagccgcacacggtggccatccagggctacgacgccgggctgcaggcgcccggccgctgctccgtgctgctccacctctactgcaagtcaggcaactccggcaccgagccctacatcgtcgcccacaacttcatcctcgcccacgccgccgtctcccaattgtacaggaccaagtacaaggcggcgcagaacggggagctcggcatggcgttcgacgtgatgtggtacgagcccatgtcgggcgcggcgatcgacgtcgaggcgactaagcgggcgcaggagttccagctggggtggttcgccgaccccttcttcttcggcgactacccggccaccatgcggaagcgggtcggggagaggctgccccggttcacggcggaggaggccgcgctcgtcaagggggcgctcgacttcgtcgggatcaaccactacacgacgtactacaccaggcacaacgacaccgacatcatcgtccgcctgctcaacgacaccctcgccgacaccggcaccatcagcctcccattcaagaacggcagagcgattggggacagggcgaactcgatatggttgtacattgtgcccagagggatgaggagcctgatgaactatgtcaagaacaggtacaacagcccaccaatctacatcaccgaaaacgggatggatgacagcaacagccccttcattgccctcaaggacgccctcaaggacaccaagcggatcaagtaccacaacgactacctcaccaatctggctgcctccataaaggaggacgggtgcgacgtgcgcggatacttcgcgtggtctctgctagacaactgggagtgggcggccggatacacgtccaggttcgggctctacttcgtggactacaacgataagctcaagaggtaccccaagagctcggtacagtggttcaagagcctcctccgctccagttgagatcgagctactagcactttgctaggtcattggtttgtgctcgtgtgcatggtgtgactgcatgtattgtcaccgtgtctgtctgttgctgccagtatgttaggatgatacacacgtctggggtttcagagttagaaggtg

SEQ ID NO: 246 - DNA, 1224 bp, Sorghum bicolor
cagcctccagccatccatgccggccttcgccgggagcgcagcggagccgccgctggcagacagctactacgcgctgctccgacgccgcggcggcggcggcaataatgatgatgaagaagcatcaggtggcgcctactactacgacacgacgtcgtcgacagtgccatcgtcggacgacgacgtggcggagtgcgagctcccgatgatcgacgtcgggtgcctgacgaccctgacgaggagcgagcacggatcgtcgtcggaggcggagcgggcggcgtgcacggccgccatcgcgcgcgccgccgaggagtggggcttcttccaggtgcgcaaccacggcgtgtcgcaggagctcctggacgagatgcggcgggagcaggcgcgcctgttccgcctgccgttcgaggccaaggccacggccggcctgctcaaccactcctaccgctggggcaccccgaccgcgacgtccccgcagcagctgtcctggtccgaggccttccacgtcccgctcgccggcgtctccggatccgccgccgccggcacctgcgacttcggcgacctcaccaccctcagggatgtgactcgggaggtggcgggcgcgatgtcaaagctggccggcacgctggcgcgcgtcctggcggaggaggcccggccccggccctgcctgcccgcgggcggcggcggcggtggcggtggcgagcgcttcccggaggggtgcgacgagacgacgtgcttcctgcggctgaaccggtacccgccgtgccccatcgccgccgacgccttcggcctggtcccgcacacggacagcgacttcctcaccgtgctctgccaggaccagcaggtcggcggcctgcagctcatgaaggggggcaggtgggtggccgtcaagccaatccccggcgccctcatcgtcaacatcggggacctcttccaggcgtggagcaacaacagatacaagagcgtggagcacaaagtgatgacgaacgccaagacggagcggtactccgttgcctactttctttgcccgtcctacgactcgccgatcggcacgtgcgaggagccttctctttacaggacgttcacgttcggagagtacaggcgaaaggtgcaagaagatgtcaagagaaccgggaagaaggtcggcctccctaattttctcgtgtaatggcctacatacccctagctttgcacacaacagtcgtgcaaatgtatattgagtttttg

SEQ ID NO: 247 - DNA, 1706 bp, Brachypodium distachyon
cgtaccatggcgccatttcccgtctctcctccttcctcgggcggcggtaaacaagctggtgcagtaataggcagtccaagatcatcgctgcagaggagcagcagcgagtgcaacgtggtggtgcagaggaacatcaagtcctcgctgctgctcctgctggcgatctccgccgtcttcgccttctccatcctctactcgtctcgtaacctgaccgtggcgaccatggccggcgaagcggtgacgcagggacccttgctcgcagcccttgacatgggccgtatggtgcatgacgacgaggccgttgatgggccagccggcccagacacggacgtgaatgaacagcgcggcggacccgcagatgacgtctccttgccggcggcgaacgacccatcggctgctgcagtagtagcccctgcaccgagcacagctgaccaaacagctggtctaagtatgcagcttgaggagaaatgcgacatttccatggggaaatgggtgaaggagccgaaaggtccggtgtacaccaatctgacgtgcccgatgctgccggactacaagaactgccagaagtacggcaaggacacgggccacctctactggcgttggcagcccgacgggtgcgacctgccgcggttctccccggcgcggttcctcgacgtcgtccgcgggaagcggctcgccttcatcggcgactctctggcccgcaaccagatggactccctgctctgcctcctgtcgcaggccgagacgccagcggaagtgtactcggacgcgctggacaagttcgggacgtggcatttcccggcgcacaacttcacgctgacggtgatgtggacggagttctacgcgcacgccgagccggtcctggactcgtccgggaagccgacggcctcgttccacatccacctggaccggctcggcgccgactggacgagccggctgcgggacctggactacgccgtcatctccggcggcaactggttcttccgcgtcaactacctctgggaaggggggcggctcgtgggctgcctcaactgcggcggcaaggggaacctgacccaattcggcgtcgcggacgccgtccgccgcgtcgtgagagccgccatcgagggcatcgccaagtgcaaggactgcaagagcggcctcgtgacgatcctgcggacttactcgccggaccacttcgagcacggctcgtggttcagcggcgggtactgcaacaggacgcagcccctggaggagcgcgaggtgagctttgagagcgtcgggtgggagctgaggaaggtgcagagggaggaagtgaggcgggcgatgaggaaggagaacttggcgagcggggccgggaagaggtacttcggggtgatggacgtgaccaaggcgatgatgatgcgcgccgacgggcaccctgatagacactatgacaagcggtgggtgaggaacggcagcgactgcctgcactggtgcctgccggggccggtggacatgtggaacggcgtgctgctccagaggctcgccgagatcgatcccgcaccgctgccgatcgatcgtggtgaggtggtcaattagaggagcctcacatggtttcgcgtcgccgtgagcccgtgatcttgtttatactcccaagttcgaaatcttacgtcttggaagctgtttggttttcacactccccggaaaaagaagaaaatattagtactcacatgttacagttgttt

SEQ ID NO: 248 - DNA, 637 bp, Hordeum vulgare
cactctcctcactccacaccagcgcacccacccaagaaccgcaaagccacgaccacgatcgagagcagagcaccccatgggggcgaggcagcgcggtgagagaggcggtatgccgacgacgaccacgaggtcgaggctggcggacgcgtcgtcgtggtgcctcgcgctgtcggcgctggcggcgctgctgctggtgtgctcgctgggggagacgacggaggccgtcaccgtgcggggcgcgtcgctgtcggcgcggtggcggccgtgcgaggagatctacgtggtggcggagggcgagacgctgcacggcatcagcgaccggtgcggcgacccctacatcctggagcgcaacccgcacgttcacgaccccgacgacgtcttccctggcctcgtcctcaggatcacgccctccaaccccaggccgtccgtccccgctagccccccgtaggtaggccacaagaaagaacagactggttgttctggagattcgttcaagtccctacgatggactctgaatctctgatttgcgagcaacctcggtactcccaagtactaaactactactaatagtccagaatagttcagtggtggattgaataaggccttgttcctttggcctcctttcagcccttaattc

SEQ ID NO: 249 - DNA, 2843 bp, Sorghum bicolor
agagagctcggctcctcaccagttgtcctcctcttcaccatcctccttccttgcccacctcaaaacaagaatcttgctttttccgacgataccatagctccacccaatccttgcgctccctgccgtcgccatccctcatcctcctagcgcatctcattcagtcattcctcgtcctcaaactgactgatgcggttggtaccaaggttccggcgctcgacggcccccgcgccgtgctcttctagcctctagtgccgcttgaattccgggcaatgggcgccgctcagttggtgattctgttcttggcgcttggcgccgcgatgcgggcggcgtcggcggcgggggcgcggccgagcgaggtgaccgttggcgctctcttcacgtacgactccacaattggtcgcgcggcgcagcttgccatcgagctcgccgtcgatgacgtcaacgcggacggcaaggtcctcccggggacccagctcaatttggtgccccaggacaccaactgcagcggctttattgggaccatcgaagcgttgcggctaatggaaaaaagcgtagttgcggtgattggcccgcaatcctctgggataggccatgtcatctcccatgttgttaatgagctacatgtacctcttctatcatttgcggctacagatccaactctctctgcatcagagtatccgtacttcatcaggacaaccataagtgactacttccaaatgaatgccgttgctagcattgttgattactatcaatggaaaagggtgactgctatattcgttgatgatgattatgggcgaggtggcatggaagccctcggtgatgcgcttgcattaaagagggcaaagatttcatataaagcagctattcctccaaattcaaatacggatgtgatcaatgatgtactatttagagcaaatatgatggaatcaagggtcatggttgtgcatgtcaatcctgacacggggatgagaatattttctgtagctaagaacctccaaatgatggccagtggctatgtatggatagtaactgattggctagctgctgtccttgattcctcagcatatagagatcttaaagatatgggtcatattcagggactaattgttctgcgtcagcacattcctgaatctgaagccaaggataagttcatatctaaatggaatgatgtggctcgtaacagaagtattacttctggcttgaactcatatggtttttatgcttatgactcggtttgggctgttgctcgtgctgtcgataaatttctcagtagtgggcaacagatcaacttctcaacagatcccagattacaaaatttaaatgacagcacgttgcatctatcaactctgaagatatttgatggtggtgagcagatgctgcagcaacttctactctccaaatttacaggtgttacaggtccagtccagtttgattcagaccacaatttggtacgcccagcgtatgatatccttaatattgctggctctggctcccgcttgattggctattggtctaactattctgggctttcggtggctgctcctgaaattttgtatcagatgccacgaaatacatctacaagtgcccagcagctgcatgatgtggtatggcctggtgattccactactaagcctcagggatggatattcccaaacactggccaacctctgagagttggggttccaattaaagcaagctttaaggaattagtgtcaggcagaggagataacatgagtggttattgcgtcgagatattcaacgcagcaattaaactgcttccttacccagttccttaccaatttataactattggggatggcacaaaaaaccctagctatattgacatcattagaatggttgctgccaattcacttgatgcagctgtaggcgactttgctatagtgagaaatggaacgcagcttgcagaatacacacagccttatattgagtcagggcttgtgatagtagcgcctgtgaaacacgtaacttcaagtgcctgggctttccttgaacctttcacattggagatgtggtgtgtcacagttgctctttttattttggtgggtgtagtagtttggcttcttgaacatcgtactaatgaggaatttcgaggatctccaaggcgacaagtcataacaatgttatggtttagcttctcaacaatgttcttcgcacacagagagaacactgtaagcacacttgggcggttcgtgttgataatatggttgttcgttgtgctgatcatcacttcaagttacactgctagcttgacgtcaatcctcactgtccaacagctctcaactggaattacagggattgatagtttggtttcaagttctttacctattggataccagaatggaaaatttaccaaaaggtacctgagtgaaaacttcaatgttcctctctctcgactggtgccactgaatacgatccaggaatatgctgatgcccttaaccgtggaccaaaatacggtggtgttgctgcaattgttgatgagaagccatatatagatatcttcctgtcaaactactgcaaattcagaatagtgggagaggaattcacaaaggaaggatggggctttgcattccagagagactcccccctcgctgcagatttatcaaccgccatccttcaactttcagagagtggccaacttcagagaatccacgacgagtggttctcacggtctagttgctcctcagatgacagcgaagtgggagcaaccaggcttggcctcggaagcttttggggcctcttccttgtgtgtgccctgatatgcctcttcgctctgctggcgccatttgagctttcctctgatttacttctgcatgatgtttaa

SEQ ID NO: 250 - DNA, 1922 bp, Solanum lycopersicum
atggccggtggtggtggtggtggaagatcgttggagcaaacgccaacttgggcggttgccgttgtttgttttgtgttagttgcaatatctattgtcattgaacatattatccaccttattggaaagtggttgaagtctaaaaataaaagtgccttgtatgaagcacttgaaaagatcaaagcagagcttatgctgctgggattcatatcattgttgttaacagtaggacaaagtccaatttcgaacatatgtgtatcagaaaaattaggaaattcatggcatccatgtagtaaaaaagaagaagatagtagtataatttcagaagattcgttgtcggagcaacaccgccggagacttcttatggatgctgccggcggtggcgtacgacgaatattggctggtggtggtggagatgacaaattaccatttgtgtctgctgatggaattcatcaattacacattttcatctttgtgctggctgtatttcatgtcctctattgtgttacaactttggctttggggagagctaagatgagaagttggaagtcatgggaaaatgaaactaaaacagctgaatacgaattctctcacgatcctgaaagatttcgatttacaagagaaacatcatttggaagaagacacttgagcttttggaccaaaaatcctgtcctactttggatcgtttgtttctttaggcaatttgtaagatctgtcccaaaagttgattacttaacacttaggcatggatttattacggcacatttagcaccacagagccaccaaaaatttgatttccgaaagtacattaaacgatcacttgaagaagattttaaagtggttgtaggaatcagtcccccaatatggttcctcgccgtgctcttcttactctttaatactcatggctggtattcctatctttggctaccattcatccccttgattgtgatattattagtagggacaaagctacaagtgataataacaaaaatggggctaaggattcatgaaagaggagaagtagtaaaaggggtacctgtggttcagccaggagatcaccttttttggttcaaccgtcctcgtctcattctttatcttattaactttgttctctttcagaatgcttttcagttggccttctttgcttggacttggtatgaatttgggttgaaatcttgttaccatgaccatactgaggatattgtcatcagaattactatgggggtcctcattcagattctgtgcagttatgtcactcttcctctttatgcccttgtgacacagatgggttcaaacatgaaatcaactatcttcaatgaaagagtagcaacagcattgaagaattggcaccacacagcaaagaaacatgtaaaggatcaaagcaaacattctaatccagtgacaccaatgtcaagtagaccagggacaccttctcatcatggcatgtcacccgtgcatttattgcgcggacattataggagtgatatgggcagtctacaaaactcacctcgtagatcaaactacgattttgatcattgggacaacgagggctcaccttcaccctcccggttttaccaggaggctgttgatggctcattgcaccatattcaacttggtcaattggaccatgaactgcaacaagttattgagcctaattcgtcacaagtggttcctctatcacaagagggtcgcgaccaacatgagattactattgctggatcaagagatttttcgtttgagaaaagaacaaccagtatatagatattattatttaattaacaaggagcacattaatactatattctatattatttttattaatttatatacttgatttcggagaaataacgattgtaaagttgcagcaatggatgcacggtgtaaatttgtaattaaaatatggagaattcgatctgaaaattcta

SEQ ID NO: 251 - DNA, 575 bp, Solanum lycopersicum
accatccatcagcctagcattgacatatttgatgcttttgatgagctcctactcctgaaacgaggaggcgaagaaatatttgtcggcccattaggacgccattcttctcaccttattaagtattttgagggaatcgatggagttctgaaaatcagagatggttacaatccagcaacatggatgttggaggtaacttcactagcacaagaagcagttcttggaattgactttacagaattgtacaagaactcagaattgtataggagaaacaaagctttaatccaggaactaagtgtggcagccccaggttcaaaagacctatactttgaaactgagtattctcagtctttcttcacccaatgcatggcttgcttatggaaacaacacttgtcatactggcgaaatcctccttacacagcagtcaggctcatgttcacattctttgtttctctcatgcttggaacgatattctggggtcttggttccaaaaggggaaggcaacaagatattttgaatgcaattggttcaatgtattctgcgatcttatttcttggcataataaacgctacttctgt

SEQ ID NO: 252 - DNA, 1311 bp, Hordeum vulgare
ggcaagcttgtgtggcgccataccccgtggctcggctcccatgccgccaaaggccctgttcgcccccttcgccgtgcccttcagggcttggatccactgactgcagcaagcatgtttgccggtgcacggtgcattggggagaggaaggtgaacggggaggattgcttcatcctgaagctgtgcactgaccctgagaccctcaaggcacggacagagggcctcgccgagatcatcaggcatgtcatgttcgggtacttcagccagaggaccggccttcttgtccacatcgaggactcgcatctcacgcggattcagtcaacaaccggtggggatgcggtctactgggagaccaccatcaactcattcatcgaggactaccggccggtggatggcatcatgattgcgcactctgggcgctcggcggtgaccctgttccgtttcggcgaggtggccatgagccacaccaagactcggatggaggaggcatggagcatcgaggaggtggcgttcaatgtccctggtctgtccatggattgtttcatcccacccaccgacatcaagtctggatctgttagtgaaaccgtggagctccctcatggcgagaagaacaagtttggtcctccccatggccatcgcgccaaagttgccgcgctggagaagacggatggcgacgagctagcatggaggggaactcgtacctgaaaaccgcaattcgttttcagcccaattcatacttgcttcttttcattgcaactgactgatgatgagtagtgtaggagagaaacaggtcgagggaggatttcgcttttggaaattcgaaatgacctctgtgtacaggaaggaagcagcatgaggcattcacaaggtcctgacctgaatatccttgagggaggcctcctgtgatgaagaatggtttctaatctcttcaagtgggagcccgtagtaggtaaccttgtttgctatttcaggcttctttgtcagtatcatgtggtgcgttcgttccccgttccagctacctgagaaaggccatcttggtggcgctgtttgtttacctttagaaacaaacactaattggtcactggcatcaatcaagggaagaaggaccgattccaactggatgttcagcttggtatacgcttggtgaagccaaccctgtcagacaagtgtaacctctgtaactgccgttgattttcctgaaccttccttggcatctctctcgtttttcctgagatgaaggttgttgttgtagtactactgctcgttaacagaagctttgcttgtttccttgtaatccaaaacatctaatgagtg

SEQ ID NO: 253 - DNA, 310 bp, Hordeum vulgare
cgccggctcccgggacaccacacagcgcacagacagcacacggcccatcaccgctctcgttgtctcgtacctgccagcgatcgaatcgaaccaagccgacgcgcgcgcgagggcttgtgcatgattaggaggaggatgggggcactgcacgtcggcgagccgcgggtcatcttccaccagcaggtcggcaagaacggcggcgggcacggcgccgtcgtcaaggagatacacgggctcatccgcgtgtacaaggacgggcacgtggagcgcctcccggccatccccgacgtgccctgcacgtggggctcga

SEQ ID NO: 254 - DNA, 186 bp, Glycine max
gatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaactcaacaccta

SEQ ID NO: 255 - DNA, 707 bp, Hordeum vulgare
gattctaatcgatcctataggctcccacgtcggccgccggccgccggccgccgcccctcgatcgatctacaccccggagcgtcgccgcacaccctcccctattatccactgtcctggaacgccgccccacaccagatccgtgcgaccctccatcccggcgcgccgcccctcggcaacactcccctgcaaccctgcttctgtggtgcgccgttcctcgtcactgctcccctgcggccaactgcgtctgctacctctacacggggtcctgcggctatggggagagttgccgctacaaccaccctcgcggtcaagctgtcgtggtatgtggcatgcaagcagagcaaatgatgaacttaacaattaccaaatctacctcatttgatctgataagattcaaaagataaatggatgattatatgggtgcatggaaactatacaacaatgatgaagacgatgttcctgttcatgatgatgatgatgatgatgatgatggaggcttttagttttaattaagttgtagggatggagttcttgctagatgatgttcctcgttaagttttagataagttgtacaaatgttgatggatgcttcgagtttaagttttgttgtgaagaaaatatttagattgcacatcacatttggatgatgttcctcatgtaatatcattactctaatccaacaattttatctaatatatgatttcttc

SEQ ID NO: 256 - DNA, 3932 bp, Populus trichocarpa
aaaatggtgaggctattaggattaactcgcggagaatcggatgattctccgcgagagattacctcgaggacgactcctttaactagtgagtcaggtgagagtgggtggttgattaggttctttgactcatctttcttttgtgagtggattgcagttagttatctatacaagcacgatcatgccggggttcgggattatctgtgtaatagaatgtatacattgcccttatcgggtattgagagttatttgtttcaaatttgttatatgatgatacataagccaagtccgtcacttgataggtttgttattgatatgtgttctaagtctttgttaatagctttgaaagtgcattggtttttgttggcggagcttgaggattcggatgataatgatgggattagtaggattcaggagaagtgtcagattgctgccactttgatgggagagtggccgccattgttgaggccacggaatgagtcttcgagtcctgggagtaagaatcaggttttgaatagaatcttgtcatcaaaacagaagttgttgtcattgacttcttctccacctctacagaagtctacgcaattatcggggaatagtttgcaggaggatgggactgggagtcagttgtcaccggatgagaataagatttttaagaagtttattcctggtccaaagtttagagatgctttgttgtttaggaagaaatcagttgataaagatgaggatgagggtggaaaggatggatttttcaagagacttttgagggatagtagtagacgcgaggatgaggagttgacaacaagttcagatggttttttcaagaggcttagagatagcattaaaagcgaggatgaggagttgacgtccagctcagatgggtttttcaagaggcttctcagggacaatagtagagtcgaggatgaggaagtaatgtcaagctccgatggctttttcaagaaactgtttcgtgatagtaagagtgatggtgatgaaaagctggtttctaaatctgctgaagacgatgaaaaagaggggttccttaagaggttttttaaggagaagtttgaagacaagaaagatggaaatgatcagaacgaggatgaagaaaggttgaagcttgaagagaaaggttcaaaatctgcagaggatgatgaaaaagaggggttcttctggaagttgttcaaggataagtttgaggacaagaaagatggggctgataaacctgatgaggggactgtcaatggtgaggaagaagaaccttctgacttttcgttgtttcgaagactgtttcgtgtgcatcctgaagaggtccaaagttctcctgtgaatgaaaataacagtagtggtagcttgcttgaaagcagcctgggtactgagaatttttttcgcaaattgtttagagatcgtgagcgctcatttgaagactctgagttatttagttttaagaagaacaatgagaagcatcctggatcacctaagcaacagaatgagaaatcaaacacaaagcccccactttcaaatactgcagcactgttccggaaaggggcttatcatgagtcattggactttgtgatgacattatgtgaaacttcgtatggtttggtggatgtatttcctgttgaagatcgtaaaagtgctctttgtgagtcacttgcagagatcaacatgcatttagctgaggctcaaaacagtggaggggtttgctttccaatgggaaaggggatgtatcgcattgttcatatacccgaagatgaagctgttctcttgaattcgagggaaaaggcaccttatctgatttgtgttgaagtattgaaaagtgaaatgccaagtaatagcaaggagacatctggtactcaaaagctttccagaggaggaattcctctagcaaatggcgatgcattcttgcagaagccacctccttgggcttatcctttgtggactgcccaggaagtttatcggaatagtagtgataggatgtctcgatcaaccgctgaggcgattgaccaggcaatgtcccattcatcagaaatgaaaatgaaatttgttagtgtgagtctttcagtggagaagcaattccctagccagtcaactatcattgaagcacctaaattgaattctggcatcaattgtatgcatcaaaatgcttcacattgtaatgatttggaatgggtaagggtagtgttgacagcagatcctggagttagaatggaagacacagggtatgcaggggcaccacgacgcaaggagcatcgtcgggttcctagtacaattgccatggaagaagtaaaggctgctgcagccaaaggggaagcacctcctggactccctctgaaaggggctggtcaagattcctcggatgcacacccaaaggttgatggcaatcccaaggccagtgatgccttatctggtgaactctgggaggtcaagaaagagagaatacgcaaagcttcattatatgggaaattacctggttgggacctgcgctctgttattgtgaagagtggtgatgattgtaggcaggagcatcttgctgtgcaactcatttctcacttttatgatatatttcaagaagctggtctccctctttggttgcgtccctatgaagttctatgtacttcatcttacacagctctcattgaaacaattccagatacggcatcaatccattctattaagagcagatatccaaatgtcacgagtttgcgtgacttttttgttgccaagtatggagagaactccccaagttttaagcttgcacagaggaactttgttgaaagcatggctggatattctcttgtgtgctaccttttacaggtgaaggacaggcacaatgggaacttgttaatggatgaagatggccacattatacacattgattttggcttcatgctctctaactctcctggtggtgtaaattttgaaagcgcacctttcaaactaacccgggaacttcttgaggtcatggattctgacgctgagggaattccaagcgagttctttgactattttaaggttttatgtattcaaggcttcttgacatgtcgtaagcatgcagagcgtattattctccttgttgagatgttgcaggattctggtttcccttgctttaaaggtggtccacggacaatacagaacctaagaaagcgataccatctaagtttgacagaagagcaatgcgtgtccttggtgctctctctgatcagcagcagcttagatgcatggcggacacggcagtacgattattatcaaagggttttaaatggaatattgtgaggtgagatttgtttggtgactgccttctttgctccctttgaccaaaccagtctgtccagtgaagcattttgattggagctgtttgtaaaatgatgtcatataatggcaattggttcactgcactgtggttttggcaactaagcagaatagtgatgacagtttgtgacctgttttcgcttggtgtgaggaaattgtaattgtatcggctgaaataccttttaaaagtcctgcaggctgcatttacctcagcaaggttttctttttttcatcatttcccttgtcatttgtcatagaattctgctggctgctgggggaatttagttacacgacaagagaaatactgcactgtttacgcatcttcagatagaacatacttgtacatagtgattcctcgggggacaacgttccaggcatgaaatggtgtctgaggctgtaattgttggttcccattgcagctacttcatattccacactggttagtgatcagaagcagctgagcattcccgattttgtatctattcatatttcgaagtctattattttcttccgatgtatattggataggcggccctgtcagtcagtaactgttctccgtttgatgtctattcttccaagagtatgattcttccatgctttctaccaaaggcttgctagtaaca

SEQ ID NO: 257 - DNA, 2107 bp, Sorghum bicolor
atggcgtcagtgagaattcgcggtgccgccgccgcggcgccacccgcgtccgtagagcccgagcggagagccggaggcacactaccactccaacttgcccacctcgacggacggttctaccaccagtccaccaccctcaccctgtggttcattgaacctggcccttcaacactcgccaaggccagccaaccaactagccaaagccgccagggggcgtctgtgctctgcgcagcagccctttcgtcccgccctccctccacctccaccccttcgcggacagaaaaaagaagtgtcagtgtcagctgcccccgtataaagcgcgcaccaccagcggcggcctgcccgcccgcccgcccgcatcgccatggctctcgccgtccgcacgccccgcttccagcctcgacggacctccatttctgcgcccgcaccacccgcctcgacatccctcgccgccgcgaacgcgagggcccgtgcctgcgcacgcgccgccgtccgagcctcgcccttcaccgagggcacctcctcctcgcgctaccgccgagacgcctggtcctacgccgccgccgatggctcctccagctccgcatccccgtcctcttccgatgctgccgctgccgccgccgctgcggcggcggcggcggcccgccgggagacgagatcgcgctgcagctgccggagctgcggaggctcctggacgcgctgagggcgtccagggggaaaggcgccgagggggcagacggcggcggcgggcccgggagggtggcgctggtggggacagggcccggggaccccgagctgctcacgctcaaggcggtccgggccatcgaagcggcggacctggtgctctacgacaggctggtgtctaacgacgtgttggacttggtcggggagggcgccaggctgctctacgtcggcaagacggcgggataccacagccgcacccaggaggagattcacgagctgctgctgagctttgccgaggctggtgccaatgttgtccgcttgaaaggtggcgatcctctggtttttggaaggggcggagaagagatggatttcttacagcaacagggaatcaaagtcgaagttatcccaggaattacttctgcttcaggaattgcagcagaactaggcattccgctaacccatagaggtgttgctaccagtgtcagatttttaaccggacactccagaaatggtgggacagatccactacatgtagctggaagtgcagctgatccagacactactttggttgtgtacatgggtttgtcaacacttccatcactcgctccaaagttaatgaagcacggcctgccgccagatacccctgctgttgcagtagagcgcgggactacacctcaacaacgaacggtgttctccttgttaaaggatcttgtggatgaagtcaagtcagctgatctagtttctccaactctaataattatcgggaaagtggtatccttgtcgcccttctgggtggagtcatctgaacattatgcactgaaaattgagagctcttatacaaatgaaaccagatgatagcacgttttcctgattttagtgattggacaatacttaagtaatgaaatatcccagatacgagcagttccaattgagatccatttaggaaatgcaagcacaggttcgacctggtgtacacaaaacatttcaggaagcatggattctgaatgatggatggcttaagcccataacagcattgggacagaagcgcacttcgactgatcatgctttgactctttggcctatctacctgagatccacaaatttttgatttagttgttcgacaataattgtgtgcttctgtattgctttggtgggaattgctttgatcccctttcttctgttgatgaagaggtcatgtctggaggcttgagcttcagtatatagacgcatttcaattcagtgtggtctttgtcagagaagtctcggtagatgtatgttttcattctgacttgtggcccattcggagcgcaggattttacagaattcgacaataagtagttatattttttgtggaaaataggaaaattcctgctccccaaattcctgactgtaaggattttttggtcatctttaaaataaatat

SEQ ID NO: 258 - DNA, 806 bp, Solanum lycopersicum
taaaactttgtcgtcttttccaggtagacatttttcgagatgcagctgccttgatggtgaactacattgacgaaatccgatctcaaggatttgaaattgattacctgaatattggaggtggtttagggattgattactatcatgctggagctatccttccttcacctagagatcttattaatacggtacgagaattagtcctttctcgaaacctcaatctcattattgaacctggaagatcactaattgcaaacacatgctgcttggttaacagagttactggagtgaaaaccaatgggaccaagaactttattgtgattgatggtagtatggctgagcttatacgtccaagtctttatgatgcttatcagcacatagagcttgtttcccctccacctccggaagctgcaattgctaagtttgatgttgttggtcctgtatgtgagtcggctgatttcctggggaaggaccgtgaacttcccgccccttctaggggcactggtttggtagttcacgatgcaggtgcttactgcatgagtatggcatcaacttacaatctcaagatgcgcccaccagagtactgggtggaagaagatggatcactgtccaaaatccgtcatggggagacattcgaagaccatttaagattgtttgaaggtctgtaaaattatggtttcttttaagcacttaaacatgacaggatgtgagactcagaaattcctctggtagtttggttcctgtcagtgttgacaattctgtatttggattgttccaattaatggattttccccatgactttccacctt

SEQ ID NO: 259 - DNA, 4071 bp, Solanum lycopersicum
aaaattaataatgatataaataagctaagcaagagctattttgatgttcttgggatttgttgcacttcagaagttgttttggttgagaaaattctcaagaatcttgatggtgttagagaagtttcagtaattgtcacaacaaagactgtcattgttactcatgatgctcttctcatttctcaacaacaaattgttaaagcattgaatcaagcaagactagaagcaagtataagagtgaaaggattgcaaaactaccaaaagaaatggccaagtccatttgcaattggtagtggaattttgcttgctctttcatttttgaagtatttttaccaacctctccaatggttagcacttgttgctgttgctgttggaattccccctattatttttaggggtattgctgccatacgcaacttcacacttgacatcaacattcttgtattaattgcagttgctggatcaattgttttacatgattattgggaagctgctactattgtgttcttattcactattgctgaatggctagagtcaagggcaagtcacaaggctaatgctgttatgtcatcactggtgaatatagtccctcctacagcagttttagctgaaaacggagaagtagtaaatgttgatcaagtcaagttgaatagcgttcttgctgtgaaagctggtgaaactataccgattgatggaattgtagtcgaaggggaatgtgatgtggatgagaaaactttgacaggggagtcatttccagtttctaagcaaaaagactcaacggtctgggctgggactacgaatctaaatggttatatcagtgttaagactacagctctggctgaagattgcgcggtggctaggatggcgaaacttgtagaagatgctcagaacaagaagtcaaaagctgaaagatacattgacaaatgtgctaagtattatacaccagtaattgtggttatagctgctggtttcgcaatagttccgacagcattaagggttcacaaccttaaagaatggtatcggttggctttagttgctttggtgagtgcatgtccatgtgcacttgtgctatctacaccagttgctatgtgttgtgcactttcaaaggcagcaacatcagggcttctgttcaaaggagcagagtatcttgagactcttgctaaaataaaaatcatggcttttgacaaaactggaacaataactcgaggagagtttgcagtgaccgagttcaggtctctcattgatggccttagcctcaatacacttctttattgggtttcaagcattgagagcaagtcaggtcatccaatggcagctgctcttgtcgactatgctcaatcaaattccgtcgagccaaagcctgatagagtggagcagtttcaaaattttactggtgagggaatttatggaagaattgatggaatggaaatctatgtagggaatagaaagatttcttcaagagctggatgtactacagtgccagaaatagagggtggtgatagtttacaaggaaagtctgttggatacatatttttgggatcctctccagctggacttttccgtctttctgatgtttgtcgtactggcgtaaaggatgcaatgagagaactgaagcagatgggaatcaaaactgtgatgctcactggtgattgttatgcagctgccaaccatgtgcaggatcagttacatggagctttggatgaatttcaagcagaactcttacccgaggacaaggcaacaatcattaagggatttcagaaggaagctccaacagcaatgattggcgacggacttaatgatgctcctgcattagcaacagctgatattggtatctcaatgggtatctctgggtcagcgcttgcgaaggaaacaggacatgttatactaatgacaaatgacattggaaggataccgaaagctgcatgtcttgctagaagagttagaaggaaaataattgagaatatgataatagcaattggtacaaagggtgccatagttgcattggcaatagcaggtcatccgttggtttgggctgctgtcctcgcagatgctgggacatgcttgctagtgattttgaacagcatgctactgctgcgaggagctacacgtagacatgagaaaaaaatttgtaaatcttctacttcctctcatgctcaccaccacaaagacaaagcttcttgttgcaagtcggaaaagactcctcaacagtgttgctctgatattgagtcacaaaaagaatgtagaaagaaatcatgctcttccgaggtgtgtgttcaaagatgtcaacctatcccctcaggatcaacatcatgtgtaaatgatcagcgctcggactccactcaaaataatggtcatcagtctcattcgcatcctcagtgctgctcatccaagatgtctgttacagcatgccaatctgcagtttcagaatcaaagtcatgcggaagtaacaattgctcagactccattcgcaagagtagttgtcattcctcgacaaactccttaataagttcttcagatttgtcagctccacaatgtcattctgccacttcaagctccaaatcatgtggaggtaccaagcgctccaacttgagtgacaaaagttgttgtcgatctctagagattcctcaaacgtgctctaccaagaaggctgctcatggatgctactctgaagtttctggtcctaaatcatgtggaaatagcaagtgttctgactcaacagacaacaatatccatcattcacattctgatcgtcaaacatgcacgtccaaggtgtgtgctccacaaagcccatctgcaacttcaagctcaatgacatgtggaaatacgaagtgctcggacaccactagcaagatttcttgtcattcacatgctaactctgaaccatgctcttcaaagaagtctggtccaacatgccaaaatgctaactcaggttcgaggtcatgcggaaatcacaagtgccaagactctgcaaccgagcacggtgttcattcacttactgatccactctccgaggaagtgattctgaagcagaaaatcttggttttggaatcaaatcatgatcttagtcatggctgctgtgaagaggaacatgatcatcatccaaatttagacaaagcatatgacagttgtgcattacaagaatgtcattattcggttcaaggagatataactgacatatcaaaaactggaatccaggaaacttctcattgtgatagcaccaatcaaacatgccaaactgtaatttcaggctcaatgatctttggagataataagagcctggactctgtagacatccatgagtgtcattcacatgctcatccaccccacaaggaggaaccacatcattctgttggacatggctgttcggacaaggaacacgatcattcacatccagagaaagcatttgacagttgtgcaacacaagaatgttgtttttcagttcaggaccacagcattgacatatccgaaaatggaagtcaaggaactgatcattgtgacagcattaaacaaagcatggtcatcccatgtagctgcaaacatacaccacaagagaaggtaagtcactgtggatttcactctacaactatccctactgatgaagaactagcgaagctggttagaagatgttgcgattacagaccatgccacaacgtccgttctggctgcagaaatcatgctacagaatgtggtccaaccacccgatcaaccatcaatatcttacgggacaaccatcatcatcatcatctagactgcagtggtcgtaaggtttgttcgccaattgagaagagacacattggtggatgctgtgagagcttcagaaaagaatgttgccccaagaacattaatcattttgcatcaagttttggaggaggtttatcagaaattgtattagagtaagatgcaatcttaaaagtgtaaatatgttgcaacttttctacctattttatcttcaagaagctgagatgctattttgtatgaacttagctattaccatggcttgtatactaatcctaaaaatggtttgtgtatttgttgaattctaacaaagttgggaacttcaatgtcatttgcatg

SEQ ID NO: 260 - DNA, 2305 bp, Oryza sativa
atctgtcctggttgattatgctcaatcaaagtctgtggaaccaaaatcagagaatgttagtgaattccaaatatatcctggtgaggggatttatggtgaaatcgacggagcaggcatatatattgggaacaaaagaattttgtcaagagcttcatgcgaaacagttccggacatgaaagatatgaaaggagttaccattggatatgtggcatgtaacaatgaattgattggagtattcactctatcggatgcctgccgaactggatcagctgaggccatcaaggaactgagatcactgggcattaagtcagtgatgcttacaggtgatagtagcgctgctgccacatatgcacagaatcagctgggaaatatccttgctgaggttcatgctgaacttcttccagaggacaaagtgagaattgttggtgaactcaaggaaaaagatggccctacgctgatggttggtgatggcatgaatgatgccccggcattggctaaagctgatgttggagtctctatgggtgtatctggttcagctgttgcaatggagacaagccacgttgctctgatgtcaaatgacatccgcaggattccaaaggctgtccggctggcaaggaggacgcatcggacaatcatcgtgaacatcatattctcggtgattacgaagcttgcaatcgttgggcttgcatttgccggacatccacttatctgggcagccgtccttgcagatgttggcacatgcttgctggtgatcatgtacagcatgctgttgctgagagagaaggacagtcgaaaggcgaagaaatgtgctgcttctcatcacggatctccaaagaagtgctgttcttcttctcatcatggatctcatgcaaagaaaaatcatggcgtttcccaccattgttcggatggtccgtgcaaatcaatggtcagttgcaaagaatcatcagttgcaaagaatgcttgtcatgatcaccaccatgagcataaccatcacgaagagccagcccacaagcattcttcgaaccagcatggttgccatgatcacagccatggccatagcaactgcaaagagccaagcaaccagctgattacaaacaagcatgcttgccatgatggtcataaccactgcgcagatacgagcaatctgcacgacaccaagaagcatgactgccatggccatgagcatagcacctgcaaagaagaactcaacgctttgcctcccaccaatgaccatgcttgccatggccatgaacatagccactgtgaagaacccgttgctctgcactctaccggcgaacatgcttgccatgagcatgagcatgagcatatccactgtgacgagccaatcggctcgcattgcgctgataagcatgcttgccatgaccatgaacaggttcatgagcatcattgctgtgatgaacagcaaactccgcacaccgcagatttgcacccctgccatgaccatgaccatgacaacctggaggtcgaggaagtaaaggactgccatgctgaaccacctcaccaccacaaccattgctgccatgaacctcatgatcaggtcaagaatgatactcatccagtccaggagcactcgatctcgatcgaagaatcatcagaccaccatgagcatcaccacaacgaagaacacaaagccgaagattgcggacatcatccgaagccgaaagattgtgctccacctccaactgactgcatcagcagaaactgttgcagcaataccagcaaaggtaaagacatttgctcgagcttgcacagggatcatcataccagccaggccagccggtgctgcaggagctatgtgaaatgctccaggcccagcaggagttgctgcagccacagcatagtgaagctgcctgagatcgtagtggagtagtaggaaattcagcaatgtctgcacatatcatcagaaaatatagcaacctcgtcatcggcgaaatgtagaaaaagccgatgctgctatgcgtttgatctttttttttttagtcgtgctgcttttgcttcagctaaagaaaaaaatgttgtttgtagaggtgtctggttttgagacgaagcaggtgtttgaatcatgaaatgtataagcctgctttgtggttttctttcccggttgtgatcgaggcatcatctcctgtaagaatctgagaaggtgcatgaaatctgccatttctgggagcgggaggactagctggtgctgggattaacttgcttccaaaaactctttagattttgaaacatttgaccaacaattagtcaaatataaattaaattctattcgatgaaaacaatgtta

SEQ ID NO: 261 - DNA, 2095 bp, Oryza sativa
atgtcgccgccgccgccgcagcggccatccccctcccgcgcaggccgcgccaacctcttctcgtccccgccgcctcccctccccaactgctacgaccccaagcaccgccgccccgcgccgccgcctctcccctccgcccgtcgcctccccagcaaccgccgccgccgccacgaccagcctccgaatccgaccaccggcaatggcgggaaccccgccttccgcgcgccgcacctccgcaccgcctaccgcaagcccgtcccacccgtggcggcggcgggggagggcgaggcgctcctcgccgccgacgccagcgacgccgccgacgggcgggccgtggtggtggggccgtcggggctgtcgttccggctcccgggcgcgccgttcgacttccggttcagctactccgagtgcccccgcgccccgccggtggccatccgggagcccgcgttcctgccgttcgcgccgccgacgatgccccggccgtggacggggaaggcgccgctgctgaccaaggaggagaaggcgcggcggcggggcgtgcggctgcacaccccgctcggggaggaggcgcccaggacggtgagcgcgcacgggatcatgatggaggtgagggggaggaggaagctggacctggccagggtcagccccggcgacggcaggagcagggaggaggtgctcggcgagccgctcaccgccgccgaggtgcgcgacctcgtcaagccccacatctcgcacaaccgccagctcaacatcggaagggatggattgacccacaacatgttggaaatgatacattgtcattggaggcgccaggaaatttgcaaagtgagatgccgaggagttccaactgttgatatgaagaatctgtgctatcaccttgaggaaaaatcaggcggaaaggttattcaccgagtaggtggtgtagttttcttataccgtggaagaaactacaaccctcgaacccggcctcgttatccactaatgctttggaagccagctactcctgtctatccaaaacttatacaggaagccccagaaggtcttacaaaagaggaagcagatgaaatgagaagaagagggaaggatctgctgccaatttgcaaattagcaaaaaatggtatatacatctatcttgtcagggatgttcgagatgcttttgagggaagtgatctggtgaagattgactgcgaggggttgaatccaagtgactacaaaaagattggagcaaaactaagggatcttgttccttgtgttcttttgtcgtttgacaatgagcagatattaatgttcagaggcaaggaatggaagtccagatatccaaagcctctgactcttattccaaaaattcgaaagaataatgttccaatgtcatctgatgagagtagttcagatgaagccactgatgatgatgaccgtttggcagtaagagaagtactgagacctaaaatgtttgaactatggacaaatgcgattgagtcatctgtggcactgatgttggatgatgctgaagtggatgctcttacacctgattcccttcttacaagggtagaggacttcagtgttacatctcaggttgtcgaacattcatttccagctgtgcttgtggccaatgatgaatcaaacccagatgtcctaaatgctgaatacaccgaagatgagcctgagacaggtacacttgaaccccaacaacatgagtttacagaatcttctgatgtcgcagaggatgatcatttcgaagatgacatgcttaagcgtttggagtcatcagtcccattgggagcattaccgatcgacgcagtggtaaaacagttgaatgatgagtgaattatattaccaaacaatcatgaattcagtgttcagtccaatggggcaatgacctgcaatcacaaatacagcgcacattccacctttcagtccgatcaataacaatattttgaggatagtcagcaatttgcaaccaatcaacatgtagagggactggataactgtatactactgtagtctgcaaaatgcagcctgtgtagataaaactgatccatcaatcaccaataataagaagatggcattatgtggttgctgcagctgtacatatata

SEQ ID NO: 262 - DNA, 2376 bp, Zea mays
cgaaattaatgcccatacccctctcattgtcccatcaaactcgctactggcctcgggcccgcccgtcgtgaggtccgagctcgatgcagccgatccggcggcggcaccgaggctttgcactcctctgtctctccgccgccctcctcgctgccgccactctgctccccggcgccgccgtcgccgaaggtgtcacgccctccgaggcgcgccggctccgcgacgaggtgaaagatatgttctatcatgcgtttgatggatacatgaagtatgctttcccactcgatgagctgcggcccttaagttgccaaggtgaagactcccttggtggttatgcgctcactcttatcgattctttggataccttggctttactgggtgataaggagaaatttggtgctgctgtggagtgggttggtaagaatgtccactttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttagctcagaggttgttgcccgcatttgacactcctacaggtattccatttggatctgttaatttattgtacggagtcgatgaaaatgaaagcaagataacatcaacggctggtggtggtactttgacactggaatttggcatattgagtcgcttgactaataatactgtttttgagcgagttacaaaaaaatcagtgcgtggaatatggtcacgcagatcaaaactcaatcttgttggtgcccatataaatgtctttactggtgaatggacacagaaggatgcaggaattggcacaagcattgattcattctatgaatatcttctaaaggcaaggaaagccactatgcatatttattgtttggagatgaagaatacctgtacatttttcaggaggcttacaaagctgccatgcactatctccatcatgatccttggtacgtggaggttaatatgaactctggtgctactgtttggccactcttcaatagtctgcaggcattctggccagggcttcaggttttagctggagatgttgatcctgctattcgcacacatgctgccttcttcagcgtctggaaaaagtatggttttacccctgaaggttttaatcttgctacatccactgtacagaatggacaaaggagctacccgctacgaccagagttgattgaaagcacatattggttgttcaaggctaccagagattacagataccttgatgttggaagggacatattagcaagccttcaatatggtgccagatgcccttgtggttactgccacatatcagatgtggaaacccacaagcaggatgatcacatggagagttttttccttgcagaaacggtcaagtatctctggcttctttttgatttagctgctggccctgacaatattgttgaaaatggaccatataagtacatatttagtacagagggccatttgttacctgttactcctgagatagccttggaagatgaacattgttcatattttggagcattctgtaatggcggtgccgaccatggatatggtgctagtgctagttctactaagcatcgaaatggaaactatacccaattagatgatattcaaaccccttccagtcactattcaatgtccaatgtgttgtttacgccaggttacatcaagggagtttgtccaggattgactcatgcgcagaaatttgggatatcatactctgatgaagaggataactttatagagcagacttctgagagtcttgatcatcatggtgaatctgccatagaatctagcgtccaagaccaatcaagttctattatattgatctctcacccagtcgcaagccaacaggatgaggcttttgagagcgagtctggaagtcaagatcatgcaaatattgttgtaacttctgattctgattctgattccacaagccgtgataatactgttggctctcccggaatgaactcggaagaacttatggacgacatatagggcacctctagacaggacaaaagatgaagaggttgctcacagtgttgagtccaagatatcagctgaccctttgctcatgtagcaacccatttctgtggaatcttcagggtcaatggcttgccgaatgcagaacaagttagcaagcaagcaaaatgtctggtagacgattccagtatcttgccagcttcaacatcggaaattgatatttactttcagatagaatatattacagggcgtacattcactaatttgttcttttttttctgtatcgatcactaatagatattattttgattaatagagaatgcacgagttttgta

SEQ ID NO: 263 - DNA, 1822 bp, Zea mays
cgaacgcagcagcagcagctcacgcgcgcacggcacaccagtgagtgacaccacctctcgcctcagcgccggcccccctataaataatggcgccactctcccctacccccgcctccgcctctgctcccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctgatgcaacttcaacagcagttctggcatggcgatttaacacatccacaccaagtggcttcacagtgggaaaagcgtggggatggccatcctcccgtctttagcaactccagtccctctctcttcggctatgatctaacaagctctggagcccagcaaaccccggcgagcaagctaaagacggagctttgagcgacgatggatggtagatagcattgtcaggagagcaggctgaacatatgcggtgggggcgcagcagcgacatgatttcagcaagttgaccaggtcaggctacaaacgggctgggaatgttgatgtgaagcgcatggagaccaacattttcagagacagagaggatgtacatatagcgatagagaatactattggtgttgagctgaagacgggaataccatagttgtattgtagagatgggcacgccctgctgctatcgctgaagagatgggagggcgagcgatactccggtctagttgctggtattcttggtgtatttcttactataatggcccaatcttaaggttatatgagcagcaatttttatgaaccaaaacccaaaaaaaaccatcatgggtcatcatatacccttctcgaatgcatttcaacaaaacatgaatgtagcacagtataactacatgtaacacacgtgcttgttacaatcctactgttccaagccattctaggttttctttaaggcatacggattttgttacatatttatatatggcttttgttatgtactttcagatacgcattgtattttttattgtgcacttggatatgcattatatctatgtatgtatatatatatatatatctaaaaatgttggaat

SEQ ID NO: 264 - DNA, 1030 bp, Sorghum bicolor
tttttgaacgttgtcattctagatagtaaatttgcttcttggtggattatttattggtgagcgctaggggtacattttagattggattctttgtcattccacagtttagcttaagcgtgctgacaattctcagttaagttgtcgtaacattcaaggttcagctgacatgcacactacaacatatatttagcttaaattaccccctatctgttgctatcatgggctcatggctgcacaaccaccacagtacacattatataaatgatggtcagtatacttgctttgtctacagttgatatgaatttgtctgccttttagtatgtatctgtaaaatttttgtttcatgtttgtttttctgcttaccagggaaggggaagatacaatgtttacttccttatgattgttgcccaaatttctctactgtaaacactacacagcagaaggtgatccatagcttccggcgcctggtcatagatgatgcagtctttagtgctctgcaacccatgacaatgtctcctagcagtagtacaacaacgtccatgcatcaccagccaaaagaattttttgactcatgggaggacatcttttccagatttgcttggcttcaggcggatttgatgaaccatagaacattgcgacataggccgaggctgcacaatactgctggtcgtcggacaagcaccgcgaggtcaagataccggtaatctcacacccatgctcgttgtggaattgcttccgccactccctagccactgccatgaacaacactataggaattcagacttatggttgttgagttttggagtttttcatatttgtatattttttccaataggcttcacttgagcagatcaggatagaaggcatatgtgttattgagtaggctttgagcaacttaagagtcgtgatgtctggtttgaattcttttttaggggagaaaatatggtccaacagtattgctatctcaaattcaaaaatgtcattttttttgtcaaccttcaatagtcttgactttattttttccctttgc

SEQ ID NO: 265 - DNA, 3600 bp, Zea mays
gtacacgccaaccagcaccttttgcctaccccggcaccaccccgcctttgccttggtgttgaaaagtcgccgcgttcctcttgcctgatgaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcagaccttcagagctgcgacgttccggcttccgggggatctggatcttggctgactggacaattgcgaggcgttgacgggcttctaaagcgtggctggattgctggatctcctttctgccccgcgactcgatgatatctctttgtattggtaattattggatgaaatttcgataattattagatcggagagatgttggtcgcggcggtccgtgcctaactgaaggcaaggtaaggtccgagacaaaagaggggaaaaggatacatgaaaaagaagtgagatgtgacatcttgaaggcctttgccatgttgggtgcgctcgcatggcaggcatcgtaataaagatgttggttttgtgtgctgggtgggagatcgcacagggaattgttttttcatccctgggttctcccgcccattgtgtccccgtgccctgcttcgtgttgtttggcttctcgtcctacgcttcatcaccggcgctgcagcaaattgaacggtgtttctcgtctcacggcgtgctgcaaattgaacggggctacatcgcaacgcaacacacaaggtacaaaccggatctaaacattttcaatttacagcaaagttagcaagttactgaaatcaccatcaatcgttcaaaacttcgcgcgccacaaacttctacgcctatactacgccatgcatatgcagttcattcacccaacgcttatcccgtaaggctataaagcacatgcgaaagacgttcattcactctgtaaggcgttcttgttcttcacccaacgcttctcgcacgggggtcttctattgaccattgaagaaaaacattgactggagatagcatctggaatatatgaatcgagtataacgaactaggtctgaaaatctgggcaattccagattcgattctcatgtgagatgataaaaacgtcataattatcctgcgtactaaaaaatattcgctagttgagtcgttccggcatatacaaaattattagctacagttgttcctgcatgcgtgtaatgtccttcggtgaacttgtctgtcattatcatttaaaaacgtatctagatgcattacggaagatttttagtttcctttgttatatttgagaagttatatattgtatatacagagagatgcagctgtgtattatttgctgtagcttcgattgcgagacgcatggttgcagtcattttattgtagttagtttatatgatacgtcgttgtcaccgcatgaagattaactgctgtgccatatgaagacctcctgcctcatcacggtgtttgtatataagatcaactgcagtgcctacacggtggacggagtatttgtatgatgtgaaggtcactattcagcatcgtcagtatgaaatggctatggccttcaaagctttctttcttggtcaccggacagggaagaaatattctgctcaagctcacaattagatacaagacataactcagataagagcttgttcaacttgcactatagttcatttgagtatttacctattattgatctcttgagttgaagctaggtttcaagtatctcctaaggattcgtatatgtgaaaaccagggattctcttttttttttgcactacaatctgtgacgttttaatatttgatgactagttgttcatgcattgctattgtatttgcatatcccctaggtttaagagcatttctaacaaggtgactcaatgatgtctcaaatttaaaatactacatttatagtgttcaggtcgccaaaaacaaattgtgcttcaacatttaagctttaatcatgtattttaggaagtaaattatattattagaaaaaatgtttagaatgatgtagaaaacaaggatagagccttactccgaaatttataaaatagggcactgtgttggagctgtttttactgagttgctctatattttaaggtagggtactgatttaaagcacggttatagatgctttaaatacaatatttcaaatttccacatattcttaacatttaactggagatatcatgtggaatatatgaatcaagtataaatgaaattagtcgcatgcaattccggattctcatgagagataataaaaatatgataattatttgctaagttcaatgacctaagtcttttactgcgtactaaaaaatattcgctagttgagtagttcccgcatattcaaaattattagctagttgagttgttcctgcatacgtctaatgtcctacggctgtttatgcgaacttgtctgtgaagacattgtacatacagagagattcagctgtgtattatttgttgtagcttcgaatgcgagacgtatggttgcagtcatttttattgtagttagtttatatgataaggcgttcattcagctgtgtattatcatttatccgggcgatcaaagcaatgcagcattgcgcgcatgtgtttagggggcgcttgcatgaagtcttgcgtgcgcactgcatgcgtgtgtgaagggacggaggactacatctttattttgcaggataagatactttttgctatagtctggtcctgtttggttcttctagaactaatcgttagcctctaaaattagatatataggttttaaacactcactattgttagctatttaacaattagttcattaacttgattaatctagctactagcaatttgttagctggctaattattagctcttggttccaaatataggccttaatttgagctttctcctttaggtgagtttattcttaatgcctacttaatttcccctcttctcaaaatcaaaagatatttttactttccagatgttttcccctccttttcaaactaaagatgttttgactttccagattttggtatgcttgtagttaaatctacactttagataaagaaatgtttgtgtataagtaaaaatcccttatttggtcgtcatggtaaatggctgcggtggacatgtgcagtctgtggcgactgatgttcagtgatcttgctgttttattgtttgtatattcgtgtcggattgttaattctgagcagccattgtttgcaaatttttttggaggcttcaccacatccattatcaatcaataactcgattttgctctacgaaggtatatgtcaattatcaataactcgattttttactggttattagatagtcttgttgcattctgaagaccactgattgctgccatttgtaactagtactgttaaccaaggcgcgtagaaaattgtttgtgtgacctaattctacaaaaaaa

SEQ ID NO: 266 - DNA, 1503 bp, Triticum aestivum
aaaggatcccgaggactctaggagagtgaagccatgaagaagagcgttgtcctgtaccctggcgtcggcgtcggccacctggtgccgatggtggaggtcgccaagctcttcctcaagcacggcctggccgtcaccgtggtgctcatcgacccgcaggtcgagtccacggacttctcctccgccgtcgcccgcgctagggcctccaacccctccgtcgccttccacgtcctgccaacgccgcccgccgattccaactccgacaccgcgcccaccaaccccgtcgtccagattttccggctcctgaaatccatgaacgcccccctcctcgacttcctccgctcgctgccctccgtcgacgcactcgtcctcgacatgttctgcgtcgacgcccaagatgtcgccgccgagctcaagctgccggtctactacttctacgcgtcggccgccgccgacctcgcgctcttcctcaacctgccgactatgctcgccggcagtaaggtaaaggagctcggcgactctatcatcacttccccgggtgttcctccgttgaaagcttcggacttacccgaggttacacacaacgatgaagtactcaagaccatcttaggcatgttcgaccgaatgccagattccaatggaattctcattaattccttcgagtcgctggagacgcgcgcggtgcgcgctcttaaggacgggctctgcgtccctggtcgtgccacgccgccggtctactgcatcgggcctttggtgtcgggaggcggtgaccaggagcacgagtgcctccggtggctggacgcgcagccggaccagagcgtagtgttcctctccttcggcagcatgggcacgttctccgttcagcagctacaggagattgcaaatggattggataagtcaggggagagattcctgtgggtcgtgcggagcccgcgcaatcccgactacaagtacggcgattcgctgccggagcccgatctcgacgcgctcatgccggaagggttcttggagaggaccaaggacagaggactcgtgatcaagtcttgggcgccgcaggtggaggtcctgcgccacagggcgaccggcgcgttcatgacgcactgcggctggaactcgacgctggagggcatcacggcagggctgccgctgctgtgctggccgctgtacgcggagcagaaggtgaacaaggtgcacatagtggagggaatgaagctcggggtggagatgagaggctacaacgaagaggtggttaaggccgaggaggtggaggagaaggtcaggtgggttatggcgtccgagggcggcaaggcgctcagggagcgggtggcggcggcgaaggatgcagctgccgaggcgctcaaggaagggggctcgtctcacttggcgtttgtccaattcctcaacgacctggacatttccatagcccctaccgtgtagcattgatgtgaaacttgtaaactttatttaatgttcgatttgtagtagcgggctatctcaggtaccttt

SEQ ID NO: 267 - DNA, 996 bp, Sorghum bicolor
tgtttgaatttcgctgtattctgtaatgtaaatagaacgaaatttattgtgtaaaatgaaatttcaataaaataaaaaaggagtcttcatgtcccgttatcgagggcctcgtttaaaaaaaatacgccgtctgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcgctggaaaagcgaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtcaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctcttaattcgtattttcccgttcacttagcagaaatagattaaccctaggatccttttttcttttttgttatttcctcgatgtgtattttacataccacagtaatttgctatagagaatttctattaattaaaggcattattgttggaataaattgttatttaatttgatacattgtgatcgctaacattgatgaattaagagaaacggaaagagagggattcgaacc

SEQ ID NO: 268 - DNA, 1171 bp, Sorghum bicolor
ctttcccagttcacacggacccgtgtgtgagcgcacccctcctcgtgctcctatggaggccaccccgatctccgtgaaaccaccgtcgccggcgctggcggcgccacccccggccacgctggggcccagggacatgccaacgcatgccgtcggagggaccgagctggagccgtccagcatgaaccagctggcaatagccccggaccccaagcggcagagggtagaggaggctgcggatggtaacgggtgcaagcattgcgcctgcaagaagtccagatgcttgaagctctattgcccatgtttttctggaggtggttattgttctgataagtgtggctgccaaccatgtttcaacaaagaagctttttcagaaacagttcagactactcgcaaggtgttactttcaagacagaagcgtatgtcaatgaaaattaataggagacctgaggcaaatgctgaacctatggaagatgctcaccattcttcttcttcaactccaccaaggagaggttgcaactgcaagaaatcaagttgcctaaagaaatactgtgattgctaccaggatgggaccggatgttccttgttttgccgttgtgacgattgccagaatccttttgggaaaaatgaaggcataatagctgatgatagtaagcgctatctatatactggtgctgatttggatcacagcgagggtgaacatgactttgttgtggagcgctcgcctcgtctacaatcacctatctcgaaggagtcttctttccaccaaaccccacctcatcttagggtctcaagcagagacacacatgtgttcccacaggcgatatcccagtggcaggcactgccccgctcgtggcagcattgtgccaacaagaggaacagcaatgacagggtgatggacgactctgcaaactacaagaactcaaaccatgactggcagctatccaagcacgaggacagctacagcatatcgaagtgcgtccagatcctgaacggcatggtggagctgtcacaggtggagaaatcagttgcccccgatgtcttcctgcagccaggcaaccgggaaattttcatctccctcagcggcgatgtgcgcgccatgtggctgaagcgcaagattcagcacctggcctagggtgggttgccttgtgccgtccttccgagtggagattag

SEQ ID NO: 269 - DNA, 902 bp, Oryza sativa
ggaagatggagcctgatcagagtggtgctgagcagacttctccacgtgggaatgattgggaagttgtccaacttactgcatcaacatatgcatctgcacctggaccaagaatgtctgagccttctgatgaggctgaagtcaagggatatgacacaaaaggggatgattcagctgcagcactgttgatgtctggtcatttctcggtttcaccgagtgaggttgagagtctccttaggggcactgacggcaaagagcaccagaaggagctttctggccaagatgcagtttctgccgaaggtgatgacgaaaaattccaggacacctgtgagcataaactgaaggatgaccttcactggattccatcctttgacaaagggaaaaacctttccctggttgacatggagtttgataaagcattccaagggatgggtttggttggtgaggaaccacttgggttctcatcatctcgttacaatccaattgatgctaacaatgagaagaaaactgaggagccaactgtgcaaaatgtgaaccgtgtcattgattcatccaaggttgttgcatctagtgaacaaaacaaacctgatgattctgaatttccacacgaagcttcatggaagaagcaactcttatcactgtacaagaatgtgaggaaaagcaacaaattctggcccatcgttgttgctactgctttggtgggagtcacatgtttttggaggcgctggcagaagggcaagttgcagcatcagccggtcaaattgtatcccagcagcaatgagaaaattaaccaagctgtaggaccgttgaatcgcatcaaggacatccttgttgccaacaatcacccagctccagctatccatggacatgctcgattgagctgattatgctcaccaagtccctga

SEQ ID NO: 270 - DNA, 1368 bp, Glycine max
ggtaacagcagaagaatgctccgttcaactccaattccggcaccgtacaattcggtgccagttctctctcgcgcccgcacgtgtcactctctagcacctgcacgtgccgttcattcccattcctctttcgtttcgcggctcgtgttcccacaattccggcaatacatcgtaaatgttcccggccgagtgtttgtcgcggcagccgcaaagaagcaacggcgcggcggcgctgaactcgctgtaacggacgacggtttcgacgatgacgaggagtacgacgacgacgatttttatgatgagtacgatgatgatgatgatgatgatgatgatgaagaagaagagtttgatgatgatgaagatgatgaggggatgctttcattggagaagatgaataaatggtttgagaagaagccgaggggttttggcgaagggaaagtgtacgacacttcggttgaggataagctgctcgaggaaatgcgccagagtagaatagcgcaggctgagaacttgaagaagcttatgagcaacccagtaaaacatgcttccaatgaaagtgttcaaaagaagaaagatgcagaacttgttccaattggaggtcgagtgtgcttggtgaacctaccaaagaaaaagaacatccataaagatctgaaatcagctttgcaagggattcctggcataattaatatagtcccagctgttactggaaacaagaagacgagggacccaatctgcaagggttttgcatatgttgatttcaagcgtgaagaagatgcagttaggttcgtagagttatacactggacaaactattacttttggtaaaattcagaagcagataaaatgtgagcttctaaatgtacagtcttcatcttctctgaaattaagcaaaaaccttagtgctgctccgcaacttgtggccgctgcctttgaagaagattcaaatgaggattctaacttggatggttctgcccgtagttcctgggatgagaccaattcttcagatgatttggatgacctggactatcagatgaatggagaagaacaggaagatgaagaggataatcaagagtctgtcactgctttgggggtagatcatgatgataatgtggaaatgaggatcgatcctgaaaatatttcacttccctcagagcaggttgacagaaaccccgcagctgtgcagaagtcgtctgccaaggttaaacaggagaatgcccgtaagaaaaaaccaatttccaaagagaaaaccaaaaaagttttagatgttcctggatcctcaagaaggttaaagatcagggagaaagctgtattaagtgaggttttctccaagtacggattaaaagctacacttgcttcaaaagataattagtag

SEQ ID NO: 271 - DNA, 962 bp, Solanum lycopersicum
cagctaagcgttgacagttgagaagcagattcagtagttcatctgctcaccaacactgattaattcctcataaatacccttctttcttcaaatacccaattggtttttttttttggtatttttttttatacttttcaaagttttaagctttttggagtccgtcaatggctggagttttatcagttctaagacgtatttacctcacactttacaattgggttgtcttttttggatggtttcaagttttttattttgctgtgaaaactctgaaagaatctgggcatgaacatgtctatgatgctgtagagaagcctttgcttttagctcaaaccgcggccattttagagatacttcatggtttagtgggtttggtaagatcgccagtatcagcaacgcttccacaaataagttcaagattatatgtaacctggggtattctatggagtttccctgagcttcggtctcatattcttgttagttctctagtgattagctggtctataacggagatcattcggtattcattttttgggacaaaagaggcatttggctctgcaccttcgtggctcttgtggctaaggtatagtaccttcttgttgctgtatcctagtggcatcacaagtgaagttggtttgatatatagcgctctgccttacatcaagggatcggatatgtattctcttaggatgccaaacaaatggaacttctctttcgattactactatgcaggacttgttgccctcggtatctatgtcccaggtagtcctcacatgtacggttacatgctcgggcagagaaagaaagctctctccaaatcgaaaaaggagtagactcaattgaaatgtagctgttggagattgcaattttaatcttaatcaatgtatttcacctgttcaatttgttctttactaatttagacaatggaacaatttgcatttctctgatggaaatcaagtggttga

SEQ ID NO: 272 - DNA, 1133 bp, Oryza sativa
tcgccatggaggccaccccgatctccgtcaagccgccgtctccggtggcggcggcgccaccgccgccgccggtgcaggtgccggtcccgccccctccgcccccgccgctaccaccggcggcggccgccgtggagcccctgcccccgcagccggtggccgtggtggtggcagaggcggagccctgtagcatgaaccagctggcgctcactcccacccccaagcggcagaaggtggaggagagcgcggatgggaacgggtgcaagcattgcgcctgcaagaagtcgagatgcttgaagctctattgcccatgctttgctggtggaggttattgttctgaaaagtgtggatgccaaccatgcttcaacaaggccttatatgcagaaacagttcagaccactcgcaaggtgcttctttcacggcagaaacggatgtcactgaaaattaatcgaagatctgaggcaaatgcggaagctgtggaagatgctcatcattcttcttcttcaactccgcctaggcgaggttgcaattgcaagaaatcaagttgcctaaagaaatactgtgattgctaccaggatgggactggttgctctttgttttgccgatgtgaggactgcaggaatcctttcgggaaaaatgaaggcataatggcagaagaaagtaagcgctttttatacactggcgcagacctggaccacagtgaggatgaacaagactttatcgtggaacgttcacctcgcctgcagtcaccaatctcaaaagagtcctccttccagcaaactcccccgcatatcagagccacgaacagagatacacacatgttcccgcaggcgatatcgcagtggcagccccgctcatggcattgctccaagaggcagagcaacgaccgggtgatcgacgactcaggggagtacaagaactcgaatcacgactggcagttggccaagccagaggacagctacagcatatcgagatgcgtccagatcctcaacggcatggccgagctatctcaggtggagaaatcggttgcccccgatgtgttcctccaggcggggaaccgggaaatattcatctcgcttaacggtgacgtccgggccctgtggctgaaacgcaagatccagaacctgacttagtag

SEQ ID NO: 273 - DNA, 926 bp, Triticum aestivum
ggaagatggagcctgaccagagtggcaccgggcgaacttctccccgcgggagcgactgggaggtcgtgcagctcaccgcttcgaactatgcatctgcacctggtccgccgagaactgagccttcggacgaggaggctgaaggccaggtgtatggcgcagaggggggtgattcggcagccgcggcactgctgatgtctggtcatttctcggtgccacagaatgagcctgagagtctccttgtggaaactgatactagcatagagcggcaggaggcgcgcggcagccagtatgcagtttctgacaagggtgaagatggtatgtacgaagaccagcaggagaaactgaaggacgatggtcttgaccggatcccgtccttcgacaaaggaaaaagcctttcctctgttgatatggagcctgacaatgggaacgcgttgcacggtgttagtcaggctggggaagaaccagtcacattctcatcatctggttacagtgcaacggacgccgagaaagaagctaccgagagtgccattgagaagaccgaagaaaaaccaccgctccaaaatatcgaccctgtcactgattcgtccaatgttgttgcttccggtgaggagagcaagcctgacggttctggagccccacgcaacgcgtggtggcagaagcaacttatatcgctgtacaggagcgctaaggagagcaacaagctctggcctatcgttgtggctgctgccgctttgatggggatggcgtatttccgccggcgctggcagaagggcaagctccagcttcagcaggtcaaattgcaacctgccagcagcaaggagagaatcaaccaggccaccgtaccgcttaaccgaatcaaggacattcttgtcgctggcaaccatccgagtccggctactcacggaaatgctcgattgggctgatga

SEQ ID NO: 274 - DNA, 1307 bp, Zea mays
agttgcgcagcaataactcccgctgcccaccggctcacctgtccttcatccgccccgatccgactccaaatcaattccaaattcaatccggtctcagtggttggcccgccgctgccagtgccagatcgaatcggactctcggctcgtgtgcagcccaccggcgagacgccgaagctatattttcatgccatctgatccgatgcgtgtggcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctatgccgccgtcgagaggccgctgcagttcgcgcagacagccgccatcatggagatcgttcatgggctcgtagggttggtgaggtctccggtctctgcaacccttccacagattggatccaggttgttccttacgtggggtgtcttgtggagttttcctgagacccagtcacatcttcttgttactaccctggtcataagctggtctatcactgagatcatcagatactctttctttggaacgaaggaggcatttggctttgcgccttcctggttattatggcttaggtacagcacctttatgttgttgtatcctactggtatctctagtgaagttggtctgatctacattgccttgccttacatgaaggcatcggagaaatactgtattaggatgcccaacaaatggaacttctcatacgattacttctattcatctgtccttgccctcctgatctacgttccaggaagcccacacatgtaccgttacatgctctcccagaggaagaaggcgctatcaaaggccaaagcggcatgatgatgccgcgcaagggaatcggtggactggtttgcgtgatggatgccggaacatgttcaagttttcgacatcccctgtagaatctagtggtcgggggatatatattactagaatggggctcttcatatgaactgccccgtatgcgtaatgtgttgtaccggagtcatcatttcagatatcagctgttgcgtggttaaatcgtagtttgcttccggatcacccatcagttggggggtggatttccatgttgattatataaggcaatgcgttccgcatccttccctcaactggtgctgtgctctcttgtttctagcg

SEQ ID NO: 275 - DNA, 1773 bp, Zea mays
gaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagagtggtgctgtgcccatctttgtcaagctactcaactccctcagcgaggatgttcgtgaacaggctgtatgggctttaggtaatgttgctggtgactccccaaagtgccgtgatctggtacttggtcatggtgggctataccctttgctgcagcagcttaatgagcatgctaagctttcgatgcttaggaatgccacatggactctctccaacttctgtcgggggaagccacaaccaaactttgatcaggtcaaaccagcattgccagcactacagcaccttattcactctcaggatgaggaggtcctaactgatgcctgttgggcgctctcatacttgtctgatgggactaatgataaaatccaagctgttattgaatctggcgtgttccctcgccttgtggaacttctgatgcatccttcggcctctgtactcattccagctcttcgcacggtgggtaacattgtaactggggatgacatgcagactcagtgtgtcattgacaatcaagcacttccatgccttttgaatcttctgactaccaaccacaagaaaagcatcaagaaagaagcatgctggacgatctcaaacatcacagctggtaacaaggagcagattcaggctgtgatcaatgcaaatataattgcacctctggtgcaactcctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgagaacatcctgaaggttggcgaggcagagaaaaaccttggtgcaggtgatgtcaatgtctatgcacagatgattgatgatgctgagggcctggacaagattgagaacctgcagagccatgacaacaccgagatatatgagaaggctgtgaagatgctggaatcctactggctggaggaggaagatgatgccatgccctcaggcgacaatccccagaatggcttcaactttgggaaccagccctctgttccatcaggtggattcaactttggctgaagatgcccatttggaatggccgctgtgccattatgccttggctagtgctc

SEQ ID NO: 276 - DNA, 843 bp, Zea mays
agaaagcaggagcaccaattcggcgcatagccaagccaaggaaatggcgcactaccaccccgtgtccgcggacacttaccaagacctcgaggctggcttctccggccactcctcctcccctctgaagcccgcggcctcgccgaggcggcccggccgcatgttctgcgacccctgcgacgacggcgacgagctccacggccgccaccactacctcgacatctgcttccgctgccgtaaactcctgtccggcaacagagacatcttcatgtacagaggtgacctgccgttctgcagcgaggagtgccggcaggagcagatcgagatcgacgaggcgcgagagcagcggctgaagcagacggggcgggccgagcagcagcggcagcggcagcagaagcagagcccccagaggatccccatctgggcgtggtaggatgagaaaaattttgggcgccgggaaaacgaacgaacgtagtaggatttagctgcacctcaagaagaaccccccaagcaagggcgacttgctgcgtgtggaaacaaacggccgtggatcaccgccggctcgacgcaggaagaaggccacgcgccacggcacaggccgggcagggcagggcatccaaccggctgcgtctttttaccttcgttggttgacgaaaccgaatgacctctctcctcctgatctccgaaagatggagatggaggggggttggtttgtgcgtgagtttttgcacggttgcacgagtgaaatggtgtgcgtacgtgctgcgtctggctgggatctatcgccgtgtaattaaaccctgtcgatacggtatgaaacaagcgagaggcctaaacaagtccctc

SEQ ID NO: 277 - DNA, 1161 bp, Solanum lycopersicum
aacttcgcttcatttagttcagtttagttttagtttaggtttattctgtaaaataaaattcaataaaaaaaaaatagaaataagaattcattcgaaatactaaataagaataaggagtctttatgtcgcgttaccgaggacctcgtttcaaaaaaatacgacgcctgggggctttaccaggactaactaataaaaagcctaggaccggaagtgatcttagaaaccaatcgcgttccggtaaaaaatctcaatatcgtattcgtctagaagaaaaacaaaaattgcgttttcattatggtcttacagaacgacaattacttaaatacgttcgtatcgccagaaaagccaaggggtcaacaggtcaagttttactacaattacttgaaatgcgtttggataacatcctttttcgattgggtatggcttccactattcccgcagcccgtcaattagttaaccatcgacatattttagttaatggtcatatagtagatataccgagttatcgctgcaaaccccgagatattattacggcaaaggatgaacaaaaatccagagctctgattcaaatttctctcgattcatcccctcatgaggaattaccaaatcatttgacccttcagccattccaatataaaggattagtcaatcaaataatagatagtaaatgggtcggtttgaaaataaatgaattgctagtcgtagaatattattctcgtcagacttaaacctcagacttaaaccaagggttcgcaaaaatttcttccctttaggcgaagtaaattaacccaaggttaagtaagttaagtaagatcaatccgagtttgatctagatttcccccatttttgtatcatagaccaaggatctattttcattccttgtctattcttttctttccagtattttgattatgattatttttgagtattctattttacgcgtcacagcaattaggaattgagaatctatatctttagatcaaagaagggtctagctgttggaataatggtatacaatgctatttgagtccttgttgttagtaaaattggtgaattaagcgaaggtacggaaagagagggattcgaaccctcggtaaacaaaagcctacatagcagttccaatgctacgccttgaaccactcggccatctctcctacataa

SEQ ID NO: 278 - DNA, 959 bp, Sorghum bicolor
aaagtcgaccgagagaagatgcgctgcgccgccgccgcgcttgcggtcgccctcatcgctgccgtcgccggcgcagccgccgcggggtcgccggccgcgggcacgtgcgcgcggaggggcgcgccgccgttcctcgacgccgtcggatcccgctgccccttcgtccggatcgagccgtccccgcctctcgaggtgagaggagaggctgttgatactgagttgaaccttcgaaggaggggtgcttcatacttcattctcttttatgctgcatggtgtccattttcgagcaaattccaaccaacatttgaagctcttagcacgatgtaccctcagatacatcactttgctgttgaagaatcttctgctacaccaagtttgttttcaagatatggagtccgtggtttcccagccattctttttgtaaatgagactacgatggttcgatatcggggttcaaaagatcttaactctctggtcaatttctataaagagactacaggtctcgatccaattgcatatattgatgttgtccaccaagagagcacaggaagcttgagctcagttatgccatgggatcgttctctgcgtgaatttgccaaagatgagccatatttgttagctgcagttctttttatcatcctgaaggttgcagcgcacttcatacctgttgtcatgtctcatctgagagctttcttagttgtccgtgtccaaaacttgaacctagggatccgtaggggatcaaaccagctcttggaacgagcattgaatgttcttgatatgaggaggctttggagcaagctgagactgagcaacaaggcaacggacttgaggaagggagcaagtaatgcacgagcttgggcttcctcatttgcttctgtttcactgggtgaaccatcatcttcgagacaagcgtagccattttggagatgtttgttagggtagctgctcacgaattcttt

SEQ ID NO: 279 - DNA, 626 bp, Oryza sativa
gcagcctcgattctcgacttttcttgctgtggggagaagaatcgcgattgcgcgaggggatttcttgctgctcggagatgccgcggattccgctgatcaagttccccaagaggaatctcaagatcccatccccacccccaccagcggcgcaacctgcagatcagcacgcgtccctcttgtcccgattgggagttaaatcagaggcaccatcttcttccggggagattaaaaattaccgctttagatcagatgtgccttccccaccttcttatacggctgttggagggccagcttcactccttcctaaacgcaagccactgtcagaggaagaaattgaggctatcatgcaaggtggtatctactgatattgcatccgatgaataagataccaaaccttttaaatggggtcactagagccatgtcgatatggaccttttcgttgtactccctttttggtgtcaggaagcagctgccctgatactcctttttttgagtattgccaaaatgaccaattcgtgaaaactgaacatgcaatgcatcggttgtttgccaaaatacattgatcatggagttatgccatgcaactcaactaattgtcttattccattgctccaaatgttctgaga

SEQ ID NO: 280 - DNA, 828 bp, Hordeum vulgare
aacgaaatgccactgctacagctacagctgccgaccgcgtgctgcgccgccgcggcgtcggcccccttctcgttctcgcggccgccgccctcccggctgcgctcgtcgcacgtcatcttcgccttccctcgcctgaggaaatacggccgccggagccgcgagccggtgcccaccaccctcgacgacgacgaggacgaggaggcggatgaggacgacgacgacggcgtggaggaggcggttgacgaggacatctttctcaagaaccggcccaagccggccggtttcggcgtggggaagacttacaccaccgacgttgaagagcagcttctccgggagatgggcctcggcggcgccgggcgcaagagcaaatcggctccgcccaagagcgtcaaaaccaacggctcggccacagaaaccagcgcagatgtcagtgatgatggcgttcatgttcgtatttggaacctcccgaaaaagaagaacatacataaggacctgaacctggctttcaaagggtttcctggcttggtaactataaacccagcaaactctggaactaagaagacccgtgatcctatttgcaagggttttgcatttgtcaaactggagtcagtggacgctgcaacgaggttcgttgaactgtattctcgtaaagctgtgtcgtttggcaaggttgagaagccaatcaagtgctgtattgttgaagggcacgcctctacggatccttcaggtccagcatccagtagtcaggcaccagggtcgaacccccaacggttggtagccgtaagatgagtggcacagttaatctgtcatcgatccagttgccactga

SEQ ID NO: 281 - DNA, 1393 bp, Arabidopsis thaliana
gaatttgtaagatcgggtggtgctatttaaatccaatatcagaaacacgtcgaacgagaccaatagagctagcttctgatacatttcgactttggcgtttctcgatctgttgtttctgctcccaaataaaaataaaaaaaaatcggatcggggatttccccaaatcgtaaaattaggttttgttcttcatttctagccctagcttagttttatcgttatcttattcattaaggtttgattctacctttgtttcgcttccctcctcgaattttgcaattccgttattaaaggatcctagtttttctggctcttgtactacgtcaagtttcatggattctcgagtttcgattctcttcgtctgtgcaatagccgtgtcatgctttacgtctgggtctgcttcatcaccagtggacttttccgtttgcaattacgaattcgagctgtttcgattcgatttagaggccaaatgtcctccttctctgtatccaactcctcctattgaggtagatggagactcactagacaggctaatggcttcacaacatggaaatgcttatatgtctgtactcttttatgcttcctggtgcccattctcacgtgctgtgcgccctaagtttgatatgttgagttccatgtttcctcaaatacaacacctagctgtggagcattctcaagcactgccatctgtcttttctaggtatggtatccatagcttaccttcaatcctgatggtaaatcaaactttaaatgctcggtaccatggtcgaaaggatcttatatccctgattgagttttatgaagaggcaacaggcctccaacctgtccagtatgtggctgaaggggaaccaacaggcttaaatgccggtgatggtaacttgatcacatggttgcgcaaggggacatctattagagaaatattcaaacaagatccgttcttggtactatctctgctgtttatctgtttacaaatggcaatccttgtcttccccatagctgaatcccgcatgagagcgttatgggcttcttacgttgccaatttgaacttgggaagatttggagagataagccaactgttcaaccgtggtattcacatggtcgatgtgaggaggttatggttgaaactaagtctcgtcaaaacaagaaacttccatgaaagggcaaagaacgcacaagcttgggcttcatcgctggcatctgtctctctaggccaaacttcatcagaccaatcctgatctcaagggtaagatcatgtcagtattgggaagagatgagcttttaagtgtgtgctggaaatctgagagttcctttaatgaatgttatatgacttatttgagtttgatttgtctgcaacgaagcatgtaaatccaggaacagctttgcttctgtttgtgaa

SEQ ID NO: 282 - DNA, 3557 bp, Zea mays
aaagtcgacaccagcccaccatctacgccgcctgttctgatgccgccgcccacgcgaggccgtggccgtggccgtggccgcggccgcgggcgggggcgcgggaggccaagtaaggacaccgttgctgaggactccgcgcacgccaccgaggaaagtggcgaggaaaacctccaggagaaggtgcaggaaggtagcaaggtaaacctcacggagaaggtgcaggaaggtggcgaggaaaacctcaaggagaagttgcaggaaggtggcgaggaaaacctcacggaaaaggagaatgaagggctagtggaggtctcaaaacccccccaaaggcgtcggaaggatcctgttgcagacccctcttctcttgagtctagtggtttcatgcgatttcgggagaggaggaatgcttcagcggttcaggagcaggggcctaagaagagaaggattactgaggattcaaacatgtgccatcagtgccagaggaatgatagcggaagagttgtacggtgccaaggctgtgccatccgaaaaagaaaatacagatattgtgtgaagtgcattaaacgctggtatccacatttatcagaggatgattttgtgaacaattgcccagtttgtcaaaataattgcaattgtaaggcttgtctgcggggagacataacccgagccaactcgaggaaaaaaaagaagttactgcaaataaattctggaggatatagtgtatctgaacaagataaaattaaattctcaatgcgtattgtgcactttttgcttccttggctgaaacaattccatcaagagcagatgcaagagaaaagtgccgaggctgcaactaaaggtattgatgcagacaaactggaggtccctctaaccatttgtggaaaaaaggaacggatatactgcaacaactgcaggacatctattgttgacttccacagaacctgcaataaatgtaactatgatctctgtctccagtgctgccaggagcttcgtcgaggccttgtttctggtaatgatgccaaggttgatggtggaggcaagcaagattttctatcgggagttagtcatgataaaatcataagcaaagggccatctgatggacagaatgacatgttgatagatagtgtagttcctggtgaaaacaacacttctagcttgagacagtggagtgtgaataaagatggaaccataccttgcccaccaaatgcatttggtggttgtgggagctctcttcttgaactgaagtgcttgtttaaagagaagtttattgctgaattactggagaaagctaattcagcgctcaataatgaaatggaggtgaagatagaaggatcaaaatgtccctgcttcactgaatccggtgacatggatgatggtatatcacggaaatcatcttgcagggagaattcctgtgataactacatatattgcccaaccgctatagatgtccaaaatggaagtttagaccatttccaggagcattggttgaagggtgaacctgtaattgtccgtgatacacttgcgttgacttctggattaagctgggaaccgatggttatgtggcgtgccttacgagaaaagaaagagaaagttgagaggctctcagttcttgctcttgaatgcttgggttggtgtgaggtcgatgtaaatattcatatgttttttgcggggtattcaagtgggcttgttggtccagacgatttgcccctgttgcttaagcttaaagattggccaccacatagttcttttgaggagcggctgccaaggcatggtgcagagtttatgtctgcattgccatttcgtgaatacactgatcctaaatggggtcctcttaatctggcagtaaagcttcccgataatgttaataagccagaccttggtccaaagacttatattgcatacggtgtttccaaagagttgggaattggtgattctgtcaccaagcttcactgtgatatgtctgatgcggtcaatatcctcacgcatactgatgaaataaaactcaaagcaaaaaggattgccgcggtggaaaagaagaagcggtgtttaggaatgaagattctatctaccaaggaagcaagtggaggccttcaacggtgtgcagattatgttggtatgccaacagctcccagtgaatctaacaaggagccaaggcctgaagagtgtgtaaatgaactgggcattaaacaaccagtacagcatgttgcttccgaggagcaggaaggagttcaagatgatgccaaggcagatgcaaatgttatgaatgtttcttttggtaagggaaaatcagaagattcttttggcacaattaatggtaccaacagtggagataaaatagaatctcctagtggtttagcagaaagaacattgactcagcctaccactaagggttgcagtaagcagcgtggccgtagttctaatggtagaggaaacaggactaaaaaaatagaagaggggaatgcgtctggactaattgctgtggctcccgagtcagaagatgatgatgatgccccatttatagatggaaaccaagcagagggtggtgcactgtgggatatttttcgacgggaagatgtgagcaaactgcatgattatctaatgaagcatgcagatgagtttagacattgcaactttgagccagtgaagcaggttactcatcctatacatgatcagtgtttttatctaacaattgagcacaagagaaagcttaaggaagaatatggagtcgagccttggacatttgaacagaagctaggtgaggcagtatttatcccggcaggatgtccccaccaggttagaaatttgaagtcttgcataaaggttgcactagattttgtttctccggaaaatgtccgagagtgcatcaggttaacagaaggtttccgtctgctgccgaagtggcataaggtgaatgaagataaactggaggttaagaagatagctcttcatgcattcaatcaagctattaaagatatcactgatgaatcatctaataacaatgaaagcaaatggatccggagatagtgaggatcatgaaggccattgaatccatgcttgatgtcatggaagttagcacaacccgcattcgacatcttgctatcgagaacctgaatgaaaaccgtagtggcttatcggatgccgacaagataacaaaacctgattttagtgtattatgcatgatattagtaccttatataatacgtagcttggagaaaaggccattcaccgtttctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaaggatatggaaatggagaaagagcgcatgtatgcatgtgtaggtcagggagtggctcggatcagccttgagtcaatttccactgcgttttcttcggttatggatgagcacgaggagtcccgggttt

SEQ ID NO: 283 - DNA, 704 bp, Arabidopsis thaliana
gtccattaacgtctggatttcgattgtcaagaagttttgtaaaacgcaaactccgataatctttctctaatctccgatcgtgttttcttagtgagatggcggaagagaaggtaaaagatgaagctatgcaaataatgggaatgtttcaaattcttccgagacttgtcgtctttgatctcgattatactctctggcctttctactgtgagtgccgttcgaaacgagaaatgccatctatgtatccacaagcaaagggtatattgagtgctttgaaagagaagggtatcgaaatggctattgcttcgagatctcctacttcagatattgctaacacatttcttgataaattgaacattaagcccatgtttgtggccaaggaaatatactcaagttggagtcataagacggaacattttcagaagatacacacaagaacgggagtgccgtttaccgcgatgctcttcttcgatgatgaagaccgaaacattaaatcagtttcgaaaatgggagtgacaagcatccttgttggtgatggggttacgcttggagcatttagacaagggcttactgaatttactcaaaatcataatagtatcgagaagaataaacaggtttggcgtgacaagtattctggaaagcctacatcatcggagacagacaaagattaacattcatttgtgagagttatgatccattggtggtag

SEQ ID NO: 284 - DNA, 743 bp, Solanum lycopersicum
cgcggcactaagaaatactctccaatcttcttcttcttctctctcaactgtaaaacaacaaaaaatggcggcttctgcacggcgatcaaccggaccggtgctccgttcattatctcccgccggcagattttactcatcgtcatctagaacttcgtcgtcttctgcttcatcgatccggtttacactggaccgtgaaacttccccaagccggtctatttccgtaatgaaccggcagaaaacactggcttcttctcagaagaagacgtgtatgtgttcgccgacgaatcatccaggttcgttccgttgtagtatgcataagaaaatggatattcgacggagtagtagtactagccaaacggcgtcgaattcgattcgattgcatatgaggcgatcggcgatgacgaattcgttagtgcgaatcggaactgttgaaggtgagcttgttaaaagagctttagcggctttgattcgtccttcttcgcatcaacagcgtcgccgttccgatttccaacgccgacctagtcgactttccgttatttccagttccggtgactcataagtcagttattctttctctagaaatttcattcaacaacgcgtgctgcgccgattcttagcgcagatctggccggatctccattgtttccggtgccggtgatacgtaggacgtgaatagagctgttagaagtttgcttttctgttgaatgctgacctcagcaatcgatgtctggccgtgaagtaac

SEQ ID NO: 285 - DNA, 374 bp, Zea mays
ttccgatgtgctgctacgtgggcaaggccaccaagatcttcctgtgcctcgtggcggcgctcctggtcgcgggcctcgtcctcggcttcggcctggcccgccacacgtggagagccgaaaggacccggcagcaaccggactgccgctggcccgactgccagcagcagcaccagggcggcgaccccccgctcgtcccggatgccgtcaccacgcagcccaacccgctcacgcagccggccgtcgccgcgttccccggtgccaccgccaccccgtcgccgtccgccgccgtcgccgcgccgcccacgggcgtgccgtactttggaccacctggcccgttcgtcgtgggcctcggcccagctgctcatgcgtgatga

SEQ ID NO: 286 - DNA, 599 bp, Oryza sativa
gtgaattgtgggtgagagagcggtggccggacgagctcgccggagaggaggaagaagaagaagacgacgagcttagctttgcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcgacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttctgcattttaagctggtctagccttctgtgcc

SEQ ID NO: 287 - DNA, 3046 bp, Sorghum bicolor
actggtgaagacactgaagcagcagctgcagggagagaagcaccgggcgccatggcggagacggcgctgggcatggccaccacactggtgggcagcgcgctccgcgtcgcctcatcagcagcaaaggaggaggatgagcctgctgcttggggtgcacgaccacatctggttcattagcgatgagctaaagatgatgcaagccttcctcagagcagctgatggagcacgtgagaacattggggtgttgaaggcgtattcggagctgatccgtgatttggcctatgacattgaagatagcctagaggagttcatggtgtttatcaagaacaagagccttgtgaaacaacttctcagcttacgtgagcgtcatcgcattgctgtccagatacgcactctcaaactaagagtccaggaggtgagccaaaggaacacaaggtacaatgcaatcaagctcacaccatccacctccactaatgtgataggtgacacagagttcacccggaatttcacagctctaaatgttgaggaagcccagcttgtgggtttggatgagccaaagaagaaactgatggaattaataggcatattggatgaacccaaggaacatgaatcctccaatactggtccaagagtggtatcccttgttgggatgggtggcattggcaagacaactctcacgaagaaggtgtttgatagcaacgatcttagtgacaagtttggcactcgtgcttggatcacagtgtcacagtcattcgagcaaaaggagatttttaaggagatggtgaagcacctctttggagctgagtcattgcataagctcttagaagatcatcaagggcaacaggtattggaagtacatcttgctgactacctatccaaacgactaaaggaaacaaggtaccttattgttttggatgatgtttggaccattgatgcatggaatcgaattaaggttacttttcaagatagtggtaaggatgatagttgtgtggtagtgactacaaggaatcaaacattagctaaatactgtagtcccccatcacacatccaccaacctgacttcctagggaaagaagaggctagaaccttgtttctggaaaagacaaacagaagtcttgatgaactggagaaaggtgacaaaaccaaaggaattgttgaaaaaatattgaataaatgtggtggactaccacttgccattttgacaattggagccgtacttgccaataaggacactgaggagtgggagaatatatacatgcaactcccctgggatcttgcaaacaatccaagccttgatgcgctaaggcgagtggttagccttagttacaaccacttgccttcgcatctcaagccttgctttttgcatctcagtatctttcctgaagattttgagattgaaaagaaacacctagtgaataggtgggtagccgaagggttggtagcagatgacacaacaacaagaacacttgaagaagttgctgaaaattacttctatgagctcatcagccggagcctgattcaaccatctaagttagatatactgggaaacgtgaaaacatgcagagttcatgacattgtgcatgatattgcggtgtcaatctctaggcaggagaactatgcattcatacatggagaacacacctccaacatatcaacaagagtaggcatccgacatctatcatgtgttgctagcaggaaactgaacactgctatggatttaagctgtgtccggtctttaactgcgttcagtaagcctctagagctaaaatccttagtttggtcatccaagttcaagatgttgaggattctggatttaaaacatgctggatttacggcaatccaacaagatataaaatacatagggttgttgctacacttgaagtacttgcactttccaaagcgtataaatagtagtgtttatgcacttccaaagtctataggcaatctgcttggcttacagactctagacctacaaagatcaagtgtttcgaccctaccaatagaaatcactaagctgcataaccttcgcagccttcgatgtagcaaggtacctaattatgtttatttcaatccagcgcaacctacgacggagtggttcacggatgccatagaatgtttaacgagtgagagtggtgcaactgctgacctgcacatggccttgtctagttgttggtctaattcatccggcattaagttgcccaaaggagtgggaagattaaaagagctacaaatactagagaaagtggatatcaagcgaacaagtcggaaagcaatcaaggagctaggggaactaactcagccgaggaagataattgtgagagggagaggagcctccaagaaaaactgcaaggcattctgtgaggctgtgccaaaactgtgctccctccgttccctcaatgtgagtaccatggagagtaagaaagcagctgaggcgctggatatggtggtttcttttacatcccctgtctcttctcttgagcgtctcaaattgaaggggcttctacagaagatacctgcttgggttggtgaatgtgagaacttggtgaaggttgacttaaaatattgtcagctcaaggaattggtggccttggctgaactgcgcaacctggtacagcttcgtcttaaaaaagatgcattcgatgcagagaatttagtgttccacgagcatggattcccaaagctcaggatcttaatcataaaggatcattatgcaatggcactgaaggaggtgacctttgagcagagctcctcgcccaacatggaaacaataggcatcttccattgccatttggaagcagggatcaatggtatcaaacaccttccaaaactcaagaagatttgtattaacaacaatgatttggggaagcaaagtagcatgttacaagaggaagtggagaatcacacgaatcaccctgtgctgcaaataattccgggctccgcttttgatccaggacagaatttgtactcttgatctgccttcatgtctgcacagtccaagctcctgcacatcatcatcggcaggagcctcccttcttcgtaatcatca

SEQ ID NO: 288 - DNA, 712 bp, Triticum aestivum
aaagtcgacttgctaccagcacctaagctccaatggagggtgagaagaactcgtccggggacctgatgtccagcagcaagctggtcgcggaggccgccaagacggcctacgagaagaagagcgtcgagggcatcgacaaggaaaaggtagccgccgcctccgccgacatcctcgactccgccgccaagtacggcaagctggaggacaagccggtggggcagtacctcgagaaggctgaggggtacctgaaacagtacagctccggcggcaccgagaaggagaaaaccgacgcacctgctgccgctgacgcaccgaagccggatgcacccaaggaggcagcgcctgcgcctgcccctgccgcggaggaagagaaatcgtccgatgggttcggtctcgacgacgtcatgaagggggctgcatcgctgtcggggaagaagagtggcgaggaggagaaggagagcggcggcggcggcgggttcatgaagatggctcaggggttcatgaagtagaagtctggtttctacatctacatgcatgtagctcttgttaagtttgtgcgctgcgttacttctgtattttgttactctataacgttgtggttgtgcttaattatgttagctgctgatatctggttctgtaaagtttcttaagtcatgtctgtctgtattgatgatcaataatccagttgtgctagctaccctttggatccttt

SEQ ID NO: 289 - DNA, 560 bp, Sorghum bicolor
cgtagatggatcgccaccagagcgcgatgcagggcagcagtggtgccaacggcgccggtgctgccgtgcaagagtggctctaccctgctggcggctggcagccggagcaggccgtcgtcgtcggctcgttcctcacggagctgctggaggacgcgccggtggcggaccagccgccggaggacgtcgaccggctgagccgcgtcatccggtccctggaggctgagatccgcggaggtggtgggccgccgccgtcggcggccgcggcagacggtgggggcacggcggatcgtcacgtgccgggagatgtccataacggcgggctccaggactacctgctgctgccggaccttgatagcatccccagcccgtgggtggcagaagcgccgccgtcgttggagttctgggcggaggtgccggcggcggtggggcatgatatgggcggctggtacgtcgacggcgatggcgtcatggtcgggtacgagttcagagagcagtgctattacggctacagcgagagcccacacgttgagcaagtgtacagccccttgtgggaatgatga

SEQ ID NO: 290 - DNA, 2022 bp, Zea mays
ttagcttcacaggaaccaggaccagcgaggtctctggctctctgcaacttgccatggggaccgcaacggcagcaatggacaggaatgcagatggagagcagggcaagaggaagaagaagggaggcttcaggaccatgccgctgatactagcaagcgaagtctgcgaccggtttgccacggccggcttcggcgccaacctgatcacgtacctgacgcagcagctgcacctcccgctggtggaggcctcgaacacgctaaccaacttcagcggcacgtcctccttgacgcccatcctaggcgcgttcgccgccgacgccttcgccggccgcttctggaccatcatcgcagggtccgtggtgtaccagctcggcatggtcggcgtggtggtgtccgcggtcctcccctcgctccggccgcccccgtgcgacgacccgccggcggccaccccgtgccagcgcgcctccgggtggcagctcgccctgctgtacctctcgctgctgctcacgtcgctgggctccggcgggatccggccgtgcgtcgtggcgttcggcgccgaccagttcgagcggctggacagcgccgaggaggaggagaaggccaaggccaaggcggaggcggagcggaagcggcgctacttcaacctctacttcttcaccatggggctggcggcgctgctggcgctgacggtggtggtgtacatccaggagaacgtggggtgggggtgggggttcgggatcccggccgtgggcatgttcatgtccatcgtcgtgttcctggtcggctacccgctctacgtgctggtcaagcccgggggcagcccgttcacgcggctcgcgcaggttgtcgcagccgcgttcaagaagcgcaacgccgccgtgcccgaggacccccgcatgctgtatcaggacaaggagctcgacgcgctcatctccaccaacggcaggctcctacacaccaatcagcttacgttcttcgaccgggcagcaatagtgacggcgggcgacatctccccgtccgggcaaccagacccgtggcgcctgtcgacggtgcaccgcgtggaggagctcaagtccatcgtccgcatgctgcccatctggtcggccggcatcatgctggccaccgccagctcgcacaactacaccttcaccatcatgcaggcgcggaccatggaccggcacatggggccccacttccagctcccgccggcgacgctgtccatcttctcgaacgcggccatgctcgtcaccctggccttgtacgaccgcgtcttcgtgcccctggcgcgccgcgtcacgggcctgccgtccgggatcacctacttccagcgcatgggcatcgggctggccatctccgtgctcagcgtcgccacggcggcgctcgtggagaccaagcgccgcgacgccgccgcccggcacgggctcctggacagcccggccgccgtcgtcccgctcagcgtgttctggctggtgccccagttcgccgtccacggcgtcggcgacgccttctcgtccgtggggcacatggagttcctgtacgaccaggcgcccgagagcatgcgcagcagcgccgccgcgctcttctggctcgccgcctccatcgggaactacatgggcacggtgctcgtcacggcggtgcagcgcgccacgcgtgggcgcggcgagtggctccaggacaacatcaaccgcggcaggatcgacaactactactggctcgtcacctgcatcacgctactcaacttgggctactacctcgtctgcttctatttctacaccatgaagccgctggaggtggcggatgactgtgacaaggactgtgagctctcctccctccagaaaaatggcagtggcgcggcgctagtgtgatggtgtaattaactggaagactagaaagcaagaatggtcttgttgttaataactagctatatacaatcagcagcgctgcaatgcacacggattacaatttactatagggatattgtagtgtatatcgagagtttataactataagctgtggtcgagcatg

SEQ ID NO: 291 - DNA, 380 bp, Triticum aestivum
tctccatggaaatctacggtgacctcgaggccggctgcctcagccactccgtctctcccatcaagccgacgtccccgccgaggaaggccgtgcccggccgcctcttctgcgacccctgcgacgacgccggcgagctcctcggccaccaccactacctggacatctgcttcaactgccggaagcttctcgcaggaaacaaagacatcttcatgtacagaggtgacacgcccttctgtagcgaggagtgcaggcaggagcagatcgagatcgacgaggcgagagagaagcgctcgaatcagaccgggagggcggaggagcagcggcagagacagcagcagaagcagagcaccccgaggatcccggtctgggcgtggtagtag

SEQ ID NO: 292 - DNA, 737 bp, Sorghum bicolor
cgctctagtcgctccttccgccggcgagtggccgttgctgcagcgaggagaagagagcggagatgggcgacgagcgggtgaaggcggaggcgctgcagatcctgggcctcttccaggtgctcccacgcctcgtcgtcttcgacctcgactacaccctatggcccttctactgcgagtgccggtccaagagggattcgccgagccttttcaggcacgccaggggcatcatttacgcgctcaaggagaaggggatcgacatggcgattgcgtctcgctcgcccaccccggacaaagccaaggtattcctcgacaagttggagctccagtccatgttcgtcgcccaagaaatattctccagctggacccacaagactgagcatttccaaaagatccagaggaaaactggaattccctacaaatccatgcttttctttgatgacgaggacaggaatattgatccggtatcaaatttgggggtgacgagtgttttagtagagaacggggtgaaccttgacatgtttaagctgggtctcagtaactttgcaacaaaatatgctgcctccagcagaaaggaagacgaataacctctaggaaaagtgatacattagaagaaaataccttcaaaacattgtacttgaatttcttgtgatcaattgccactatattcatggacaatttgtggatgaaggatgaccacacagacttagcttttgaactgatgcaacgcctgtctagta

SEQ ID NO: 293 - DNA, 809 bp, Hordeum vulgare
ctcctcacaaatatctcgctgccggggcaggccaccgtcgcgcgcggcataatagcacggcgctttcagacagcctcctccgccaccaccggcaccgcccgcgcaattaacgccaccgctaataacgagcgcggccgcggcccagcaataccaacacacaccaccggcagcataccggtcgatcgactcgacatgtcgtcgaggccgagcaggagcgacgcgcacctgtccccggtggacgaggcggtgagggtggacgaggtgcgggggtactacgacggcgcggctcccaagcgccactccaagccctcccgcagcgaccactccgccgtgtacaccgacgcgctcgccggccccggcgtcgacggctcccaccccgagctcgacaagttccaggacctcgaagcccactccgagaaactggtgtgcgagggcgggaaggccggcgaggagttcgtggagacggagtactacaaggacctcggctgtgtcggcaagcagcatcacacgactgggacgggcttcatcaaggtggacaggcccgccggcggctcgttcgagctctctgaagacccgggtgcgacggagcgccatgcttcctccaaggggaaccccgccacaaacgactggatcccgtcagctgacacggtgtaccaggaggcgtcagacaagcccaacagaagcgacagctgagccgggcgatgatctacagccaacatgatcagatgcgtatgacttccggttaaatcggctattaaaaaaataaagggcgcgtattcgtgtatgtcagccatttgttattgggattc

SEQ ID NO: 294 - DNA, 454 bp, Solanum lycopersicum
ctccaatctacttcaacaatggccaacagtattcattccattttctccccctttttcatcatcaacattattttcctctctttctcatgttacacgttagcaggacgcgatatcgcaaaaatcaacgataaaatcaaacaccccgatacgttctttccatacgatggaacggtcctaattcccggtatagggagggttgttgtcccacctaaaggcacccatgttaatccgtttacgtataaccctatcaccggctctaataatggcaacggtttagttattccaattcctggctctggcactggcattggcattggctcttacattccaggtggtgacgatacatttattcctaaccctggagtcgaagtccctagtggtggtacaattcctgtaccaccataggtatcgtcattaataaaaataaaataaaaaaggacagtctgatgcatgc

SEQ ID NO: 295 - DNA, 1201 bp, Sorghum bicolor
aaagtcgacgtaaattacccggacagcgaccgcgaccggggacctcctccctccatcgaaccccaagcgcggcgctcccgttgtcccgcacccgctctaggccatgtcgcccgccgccgccaccaccacagccttcgccgcggtctccgtcgccatccccaaccctactgctccatcccgcggccgcgtgcgccttccgctacgcggggtccccgccgccgcacgccgcgccgtcgcctcgatggccgtgtccgcccccaggtccggcgccgccgcctcgttcctcgagcgccgcgagtccgagcgcgctctccacttcgtcaagtaccagggcctcggcaacgacttcatcatggtggacaacagggattcgtcggtgccgaaggtgacgccggaggaggccgcgaagctgtgcgaccgaaactttggcattggcgctgacggcgtcatcttcgtcatgccgggggtgaatggtgccgactacaccatgaggatcttcaactctgatggcagcgagccagagatgtgtggtaatggagtccgttgctttgctcggtttatagctgagattgaaaatctgcaggggacaaatagcttcactattcatactggtgctggaaagatcattcctgaaatacaaagtgatgggcaggtaaaggttgatatgggtgagcccatcctttccggaccagacatccccacaaaactgctacctaccaagaacaaagctgttgtccaagctgaattggcagttgagggcttaacatggcatgccacatgtgttagcatgggcaaccctcactgtgtcacatttggtgccaaggagttaaaggttgacgatttaaaacttagcgaaattgggcctaaatttgagcatcatgaaatgtttcctgctcgcacaaacacagaattcgtacaggttttgtctcgctcacacctcaaaatgcgagtctgggagcgtggtgctggagcaactcttgcctgtggtaccggtgcttgtgcagtggttgttgcagctgttcttgagggtcgagctgagcggaaatgtgtagttgatttgcctggcgggccattggaaattgagtggagggaggatgacaatcatgtttacatgaccggtcctgcagaggccgtcttttatggatctgttgttccctaggtactggggaccaaggtagaagggttggcttagggatccttt

SEQ ID NO: 296 - DNA, 703 bp, Solanum lycopersicum
gcgataccattgttcattcatcaataaccaacaaatttcctcatatatatatataatcaattcgttcgcacttcaattattttattaatcgaaagatactagttcattctatggatccaacacaagccaagagcacatccggatcgggtcattcatcgacccataagcccaacagccacccgaagccatctaaatctgagctgatgtccagcgccaagctagtagctgacgccgccaaagcaaaactccatcacgatccaaaacaatttgagaaatcggagctcgccggagctgccgctgacctcctcaacgccgcttcacagtacggtaaactagaagagacagggatcgggaaattcgtcggaaaagcagagacttatctccataaatacgaaacttctcatcattcaacaaccaccgctaccgccgcggcgactgcacatacgcagtcatcggggcatacaagtggaggaaaacatgaaaaatcaggaagtggatatggcgagtatattaaaatggcggaaggacttttgaagaaaaattccgatgggagtcagtcgtcggaatctggtaaaaaaggagattatctgaagatggccggagattttttgaagaagcattgaactgtttaattttgcgctgaaaattctatttttatgttggataaatgtgatttgtattttgtgtggctaggcttcattgc

SEQ ID NO: 297 - DNA, 339 bp, Triticum aestivum
cctgccatgtgggcctcgccggggaggctgccggcgatggaggaggaggaggagtgcgaggcgggcgcgggccaccgggcgccgatggcgtcctgctggggccgcttcggcctggcggcgctgtggcacaggctccggcaccttttcctggcgcggcggagggcgcggcacggccgctccatcctcggcgccggcgggctcaactacgacccgctgagctacgcgcagaacttcgacgacagcagcctcgagctccacgagccggacttcacggccaggttcgcgcccgcccgcaacgcctgctcgcccaggcgggcatgagcatgacgacgcgccact

SEQ ID NO: 298 - DNA, 2973 bp, Solanum lycopersicum
ttgaatttcggtaattgggttcttctcaaaattcaaaatttccaacagccttgagcttctggatattgatggcgaccccagaaaccgcagctactccagcaacccctactgagaataatgagatggtgccgaaaaatgagatgatacatgagcatggtgatgagatggtgccgcaaaatgagatgatacatgagcatggtgatgagatggtgccgcaaaatgagatgatacatgagcaaagccatgagattgtgccggaaaatgagatgcaaaatgagatgatacatgagattgtgccggaaaatgagatgcaaaatgagatgatacatgagcacagccatgacattgtgcctgaaaatgagatgcaaaatgagcacagccatgagattatgccggaaaatgagatgatacgtgagcacagccatgagattgtgcgggaaaatgagatgatacctgagcacaatcatgagatagtgccggaaaatgagatgatacatgagtgcagtcacgagacagtgccacaaaatgagatggtacatgagcatagtcatgaaatggtgccagataatgagatgacacatgagcacactcacgagatggtgccggaaaatgagatgacacatgatcataatcacgagatggtgcaggaaaatgagatgacacatgagcataatcacgagatggtgccggaaaatgagatgatgcatgaacatggtcatgagatggtgccggaacatgagatgatgcatgaacatagtcatgagatgatgccggaacatgagatgatgcatgaacatcatatggtgcttgggcatgagatagtccctagcaatgagatggtcccggatgatgagatgatcccactaaatgagatggtccttgctgaaccacaacccaactatatagaaacacctccaaacaatccagaaacacagcccagcaagcgtaggaagaagaagtcaatagtttgggaacacttcaccattgaaaatgtcggcggtggaactagaagggcacaatgtaagcagtgcaagcaatcatttgcatatagtacaggttcaaaagtagctggcactagtcacctgaaacgccatattgcaaaaggaacctgtccagttgtcctacgtaaccaacagaataatcaattgagcccatatagtacacctcctaagatgagtggatatggtggtagtactgatgcaccaaaacggcgttataggactgcatcttctccttaccttgcttttgatcctgaccggtgccgtcaagagatctctaagatgatcatcatgcacgactatccccttcacatggttgagcatccaggctttcttgcttttgtgcagaatcttcaacctcgttttgatatggtgagcttcaacactgtgcaaggagattgtgtggcaacttatcttagagagaagcaagccattcagaaggtcattgagggagtgcctgggcgtatctgcttaacgctagatatgtggtcctcctgctacactgtgggctatgtgttcataaccgggcagtatattgacagtgagtggaaaattcacaggaaaatactcaatatcattatggaaccatatccagattctgacacggctttcagccatgctgttgctgcttgcctttctgactggagtatggaaggtaagttgttttctgtcactattaatcaaccgttgggtgatgcttctgttgataatcttagagctttactatctgtgaagaaccctcttgtgctcaacggtcagttgttggtcggaagttgtcttgctcgaactttaagcagcattgcccaaggtgcatttaattttttgcatgaaactgttaagaaagtaagagatagcgtcaagtatgtgaaaacatcagaatttcacgaggaaaagtttattgagctcaaacagcagcttcaagtgccaagcacaaagactttggctcttgatgaccagactcaatggaacaccacatatgagatgttgttagctgcatcagagttaaaggaagtgttttcatgcttggatacatctgatcccgattacaaggatgccctgtcaatggatgattggaagcaagttgaggttctttgtacttacttaaaaatcctctttgacactgccaatcttctgactgcaccaacaattccaacaaccaacacattcttccatgaagcatggaagattcaattggaactggctcgtgctgcagcaagtgaagatccatccataagcggtcttaccaaaacaatgcaagaggagtttgataaatactggaagagttgttgtctaatattagctattgccgttgtaatggatccacgcttcaaaatgaaacttgtagaattcagctttacaaaaatatatggtgaagaagctgccacctttgtgaagttcgttgaggagggaatccacgagctcttccttgaatacgtggcacttcctctgcctctgaccccagcttatgctgaagaggtagatgatggagctttgaagcaggagaatggtgggggcggacttacagattttgatgcctatattatggagacaacaagccagcagtcaaggtcagaacttgatcaatatttggatgagtccttgttgcctcgtgttcatgagtttgacgttgttgggtggtggaaactgaacagaatgaagtacccaactctgtcaaaaatggctcgtgacatcttgtctgttccagtttctactgtaacagctgattctgtgtttagcacggtaggcaaagagattgatcgctacaggtgttccttgcgacctgagaccgtggaggccctcatttgcgccaaggattggcttcaaaatgcatcagtaaataccttacatgcaccaataaaaatggaagtccccatttaggttttttctgtgatgttaaatacttgtctagaatagcctttgtagctgatttctgttttctttgagactgttataacatttgtctcctccgtgtcac

SEQ ID NO: 299 - DNA, 1121 bp, Solanum lycopersicum
aatagccgttccacctaacatctaatgaaatttggccggcaaaaattaaacaattaaagaaaagactattatatgaagtcactctactaaagttattataaaatcccatacaaacttgatcaatcttcttacaaataaagcaaaaaatggaagaaatagagcacaaatacattgaagtgaatggtctaaagctccatatagctgaaattggaagtgggttttctccagttgtggtgttcttacatggattccctgaaatttggtattcttggaggtaccagatgaaagctgtagctaaagcgggttacagagctattgcacccgattacagaggatatgggttatcggatcaaccaacccaacccgagaaaaccacattcctcgatcttgtcagtgacctccttgcacttcttgatgctcttaatatctctaaggtttttctcgttggtaaagactttggatcttttgtcatttcgtatttttccattctccacaaggagagagtctctggatttattgttatgggggtgccatttttgcctccaaaacctcttgagtttaaaaaaggcctccctgaaggattctatatttcgagatttgggatacctgggagagctgaagctgattttggtcgtcttgacgccaaaacagtagtgaggaatgtatacattcttttctccagaagtgaattaccaatagccaatgaagatcaggaaatcatggacattgtgcaaccttcaactcctctgcccccttggttctccgaggaagacctggctgcgtatggagctttgtacgaaaaatctggattccgaactgcattgcaggttccctataggtcactgcatgaacaagtcaacataacagatccaaccgttcacgttcaagcactgtatattaagggagagaaagattatttcctcaaatttccaggcatcgaagattacattagtagtggagtcctcaaaagtttagtccctaatctgcagatagttaacttgccagaaggaaaccattttgttcaagaacaactacctgacgaggttaatcaactcgtgctcgaatttcttaccaaaaatagtaaggttcagtaagtcctcattgttgttgttgctccgtag

SEQ ID NO: 300 - DNA, 811 bp, Solanum lycopersicum
gaatgttatagtccatttgcagagcaacaatggcgggactcactaatctcaagctatctctgtttcccaattcgtgttcactctcctctctttcatcaaacccatttcttgtttctacctccattttccgcagaacatcccactgcttcccaaagatattcgcgttttccagcaatgatattaaagtgggcagcaacattgaagtggatggatctccttgcaaggttatagagtttcttcatgtaaagcctgggaaaggggctgcattcgtgaggaccacgctgcgcaactatgtaacagggaatagcgttgagaaaactttccgagctggaagtaagatagaagaggcaaatatctacaaggagacgaagcaattcacctacaaggatggtgcccagtatgtcttcatggatctgacctcttatgaagaatatcgtctaaatgaaaaagaagttggagataaagcaaagtttctaaaagagggcatggactgcagtttgcttttctggaacgggaaggtgatcgactttgaattgcctataacagtaaagttgacagtggtggacgttgatccaggcgtcaaaggtgacactgcccaaggtggatcaaagccagcaaccctcgataccggtgcaattgtaagcgttccattattcataaatagaggagaggaaattatggttgatactagaaatggacaatacatgagccgcgcataggtttgcttcaggatacaattttgttacaactgaaactttttgtatctatatgtattagaacctagtatttgcaggagtaacattgaagaccc

SEQ ID NO: 301 - DNA, 1064 bp, Solanum lycopersicum
aaagtcgacaaagtagcggtaccggaaaatgtgttccactaaacaaaaacagaagcagaacctccacaatcagcgctccgtcgtgcctacctctacctccgcctcaggcggtgacggtggcggtggtggggactggagggaagaatccataaccggcggatcacttaagcatgtggatttggacaagggcaaaaacggttgggcatcaccaccgggagacctattcaatctgcgagggccacactacttgacgaaaaaggcgaaagtaccttctggcgcgtggcttctacagcctgccggagtggattggctccgatctaactccaagctcgaccacgtcctggctcgacacgacaaccgtgtgatgaacgcgctgaagaaatctcactctgaaggaaagtctctgaaaaccttcatagtcgccgtgaatctccaagtcccagggcgtgaccaacacagcgctgttttctacttcgctacaaacgacgatgagccgctcgaaccgggttctctcctctatcggttcgtcaacggcgatgatgcgtatcgtaacagcagatttaagatcgttaaccggatcgtgaaaggaccgtggatcgtgaaagccgcggtcgggaattactcagcttgtatactcggtaaagcgttgaattgctactatcatagaggccctaattacttcgaaatcgacgtggatatcggtagctcagcgattgctagcgctattttgcacttggcgctaggttcggtaacgtcggtgacgatcgatatgggttttctggttgagtcacagacggaggaagagttgccggaaaagttatttggggcagttaggatttgtcaaatggagatgagctcagctacgtttattgatacgacgtcgtcaaggaaggtattaccgactgctaatttacataatccttgcaatagtagcaaagtccaagctgaggagaacggtgagaacaaagatgattaagaagaaattaaaacaaaattacttcatattattcttaggggaaaaaaattgttggtgcaatccatgtagatagatgtctaaggatcct

SEQ ID NO: 302 - DNA, 2137 bp, Zea mays
ggcatcgacgatgaacggcggcggcgggcggcggcggtactcctcggagcagctcctcttcgacgttccgtccaatgccggtgccggccggtgggcacagcagtccggtggagtgcggcgcggggacggagagatcttcgtgtcggtggagccagcaacgccggcgcggctgcgcggaggggacgccgcggctggggactcgccgggacagaggcagcagctcagtcccgggttgctcgatctccatgctttcgacacggagctaatcccggattttcaagtaccagggatgtatgatggtgcccaaaagtttggctatggaggaggtctagatgaatctgatatgagattcacagcaaacaagctgatgagcaagtctgctgtttttcctgatggtaactacctgaaggccttcacagagaaagagaaggcagcacctgtcgcgaaaatcaaagtggtggtgcgcaaaagaccacttaacaagaaggaagtatcaaagaaggaagaagatatcatagacattgaacaaagatcaaactctttgactgtacatgagactaaacttaaggttgatcttactgaatatgtcgaaaagcatgagtttgtattcgatgccgtcttagatgaagatgtttcaaatgatgaggtttatcgtgaaacagtggagcctgtggttccttcaatttttaatcgaacaaaggcaacttgttttgcttatgggcaaactggcagtggaaagacatataccatgcgtccccttcctcttaaggcttcccaagatatcttgaggttaatgcaccatgcatatcgaaatcaaggatttcaattgcatgttagcttctttgagatatatggtggcaaattatttgaccttctcaatgataggagcaaactttgcatgagagaggatgcaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgctattaaacgccgtgtggatggcaatgactccaaaccacccagacctgttggcaagctgtcatttattgaccttgctggcagcgagcgtggtgctgatacatctgacaatgataaacaaacaagaattgagggtgctgagatcaataaaagtttgcttgctttaaaggaatgcattagagcacttgataacgatcagactcacattcctttccgaggtagcaaattaactgaagtcctgcgtgactcattcattggagactcacgcactgtcatgatatcatgcatttctcctagttctggctcttgtgagcatactctgaacacattgagatatgcagacagagtgaagagtttgtcaaagggaagcaatgccaagaaagatgtgtctttggcagtgcctttaagagagtcgagcccttccccactgccttcagttgtaccctcattctctgcatctgaggtgatgaatgatatcaccgagagaaacaattttggttggcccaagcagcagtatgttaaagaacggcctgctccgacatttgttgaacgaatgcccaaagtgaaggatgccgtggagttcgcaacatcagacggtgcttatttgaagggacaaagaagccagggctgtatggcaccaaatatagctgaaataccggatacaatgtaccagcagagaaggcaaccagcaaggaaggctaaagataccgctttgcggaataatatgagaaattccgttgcttacccaactagaagtgttgagccagacgaagatgatcatctgaataatcttctccaggaagaggaaggcttggttagtgctcatagggagcaggttgaagcgactctggacatcctcaaagaggaaatgaacatattaggcgaagcggatcagcctggcttccaacttgacgactacaacattacgagactaagcagtatactctcgcagaaggcggctgggattgtggacctacaggctcggttggagcagttccagaggcttttggatgagaacaatgtgctgctatatgctcagagcccccggttgtagttccatctgttgccttag

SEQ ID NO: 303 - DNA, 452 bp, Triticum aestivum
cagccatggcgctcctcctgtcccccaccgtctccttcctcgccccctccccctcctccgctcctcgtgcccgagctctctccagctccaccgccaccgccaccgccgccagcaataatgccttcccttacctcgcctcgagacttcagtgcaagactggcgcctcagtcagccatgtttctcttgccaagaagatgcccgtggttgtccacgcttctgcagaggctggtccaactgatgcggcagagcaaccagagaagccaaaaccagtggcttcgatcgaggacatgccgttcgagtccaagcagcggatgatcctggagcagagggcacggatgaaggtggccaagaagctgaggcagcggcgcaagcggctcgtccaaaagaggcggctgaggaagaagggcaggtggccaccgtccaagatgaagaagctcaagaacgtgtgatga

SEQ ID NO: 304 - DNA, 477 bp, Triticum aestivum
aaaggatcccacccgcagccaaatggcgaagctgctgccggccggcctcgcgttcctcctggccctcaccgcggcggcggcgctggccccgtccccggcctcggccttgaagggcgccggcgggctgggactcggaggcgcggcggccgtggtgatgcgccggggcgggcggacgtgccggggcacggttggcgagtgcatggagtacttcggcgtggacggcgagggcgagggcgaggtggcggcgatggctggcaagcggcgggtgctgcaggacgggtccgggtacatcggctacgacgcgctgcggcgggacaacgtgccgtgctcgcagcgcggcgcctcctactacaactgccagcccggcgccgaggccaacccctactcccgcggatgcagcgccatcacccagtgcaggggctgattctcttcattaaaccctgcttcattccttcttactacctgcatgcctcatca

SEQ ID NO: 305 - DNA, 2604 bp, Solanum lycopersicum
tgggcactgtgaaactaatctgttcatcgaatcgttgatttatagagacggagagagagagaggtgtatcagctgattgattgtgctttggaggtgtggaaatttgttgtttgtggaagaagaggatattggatttaatcggagattgaagtagtgaaaaaacatgaatgcagttggaaggcaaagatctggaacgtcaacggcgcatcaccagaggcaatactctgataacttcctggagacgtcatctaatggaagatggcttcaatcagctggtcttcaacatcttcaaacttcaaataataatgttcctcaggctccacagggacaggaatatggatactatggtggagctcaagggtcgagaatgcttagaggtgcacagaggacatatagtggaggaagcgatctctttgcggagcctttgacgccgccggggaattatcgacattcaagccagagaaggaatggtgacgaagaagtatgtcccaatgagttcagtcctggactcttagatctacactcattggatactgagcttctaccagagatgcctgttgctgggttgtatgatgctccttccatgcatcattttgctcgagcaaaaagctttgatgactcggagcaattccttgcaaacaacaagcaaactggtcgagttcggggcttgccagagagtaacgtctctaagagttttgctgttgataaagacaaggccagcaatgtcgcaaagatcaaagtggtggtgcgtaagcgaccactaaacaaaaaggaattaacgaagaatgaagaagacatcgttgaaacacgtttcaactctctagtagttcatgaaactaaactaaaggttgatctgactcaatatgttgagaagcatgagtttgtctttgatgctgtgctaaatgaggaggtttcgaatgatgaggtataccatgaaacggtggagcccattgtcccaataattttccaacgcacaaaagctacttgctttgcatatggacaaacaggaagtggcaaaacgtatactatgaaaccactacctctgagggcatctagggatcttttgaggctcattcatcatacataccggaaccagggctttcaattgtttttcagtttttttgagatatatgggggaaagctctatgacttgcttaatgaacggaagaaactttgcatgagagaggatggtaaacaacaagtatgtatagttggattgcaagaatacagggtctctgatgtggagatgattaaggagctcattgacagaggaaatgcaactagaagtactggcaccactggtgccaatgaggaatcatctaggtcacatgctattctacagctttctgttaagaggtcagctgacggtagcgaatctaaacctccccgtgttattgggaagctttccttcatagaccttgcaggaagtgaacgtggtgcagacacaactgataatgataagcaaaccagaattgaaggagcagagattaataaaagtttgctggcactaaaggaatgcattagagcccttgacaatgatcaaaaccatattccttttagaggcagtaaattaactgaagtgctgagggactcttttgttggaaatagtcgtactgttatgatatcttgcatttccccaaatgcaggatcttgtgagcataccttaaatacattaagatatgctgacagggtgaagagtctttcaaaagggaacaactcaaagaaggatgtctcatcctcaacactgaatcttaaggagtcgacaacattatctttttctgcagttgtaccttctacatcaacatttgaagatgataccggtgattcatggcctgaacaaactgacaaagatgaatatgatgaagatttctatgaacaagagaagccaatgtcgaagaagaatgagaagcttgatggttactctatctccaattcagaagataaaatgaagagagcaaatgctcagacaaagtggaaggagccacctagaacagaggcaaagtattcaaactcggatgatgatctgaatgctctcttaaaggatgaggaagatcttgtgaatgcgcatcggaaacaagtggaggaaacaatggacattgttcgagaggagatgaatctattagttgaggcagatcaaccagggaaccagctggacaattatatttctcgattaaatgcaatcctttcacaaaaagctgctggcatcctagagttgcagaaccagttagctcattttcaaagacgtctaaaggagcacaatgtacttgtatcttctggcaactgaagctctaattcagtatgcatacaaatttcagatgttgtgcacatttgctttggggacgaggtgttgttgtagatccactaatggacccataggtgttggtgtagaaaaaacacgtggcttgcaacattcacatgctggtttcttcagaagagtttttgaagccttctgttaagttacacaagaatcttgtcattgtttattcattttctcatttgaaaagaagaaaaatacgatagatgctttggcatggctttaaggctttgtgttgctaagattattaagtgttgattgatctgccgtgtggaagaggcatttgctat

SEQ ID NO: 306 - DNA, 2336 bp, Vitis vinifera
ttggatctgttaaccaaggaggtgagtagaatttggtggcctaatgagtaaggaacagaagagagggaagcaggagaaatcctcggaggctgccgagaaggtggttgttgcggtgaaggcgtcgaaagaaatcccgaaaactgctctggtatgggccttaactcatgttgtgcagcctggggattgcattactctgcttgttgtcgtccctgcacaaagcccaggtagaaaattatggggtttcccaagatttgcaggggactgtgcgagcggtcaccggaaatctcattcaggagcaagttcagagcagcaatgtgagattacagattcttgttcacagatgatccttcagcttcatgatgtttatgatccaaacaagataaatgtcaagataaagattgtctctggatcaccatgtggggcagtttctggagaggccaaaagaacggaagctaattgggttgtattggataagcagctcaaacatgaggaaaaatgctgcatggaggagctgcaatgcaacattgtggttattaagcgctcccaacctaaagttctccgcttgaatttggttggatcacctaagatggaatctgaaacagcctgtcaattgccttctgaaccaggtgaaacagctgaaaaacattctaaaaccaagaatgactcgatgaagtccattcgggggccagttgtgactccaagcagtagtccggagttggggacaccattcactgcaactgaagttggaacttcatcagtatcaagctcagatccaggaacctcaccattcttcaactccgaagtgaatggagacctaaagaaagaggaatcatcacatacaaaagaaaatttggatcttgatgaatctagttcagacactgacaatgaaaatttatctccatcttcaagtgttgggttccaaccttggatggcaggtgttctcacttctcatcatcaatcctcacaacatattgaacaaagttcaaagaaatccagggataagactcaacctcccacgtctaaagctttgctagataagttctctaaaattgatcgtgatgctagaattggaatgatgaactataggtcagaactggacttcagtgggaacgttagagaagcaatttcattatccagaaatgcgcctcctggtccacctccattgtgttcaatatgtcaacacaaggctcctgtatttggaaagcccccaaggtggttcagctatgccgagctggagcttgctactggtggattttcacaagctaatttcttggcagaaggcgggtttggatctgtccacagaggggtcctacctgatggccaagcagttgctgtgaagcaacacaaattggctagttctcagggtgatgttgaattttgctcagaagtggaagtcctgagctgtgctcagcaccgaaatgttgttatgctgattgggtactgtatagaagacagaagaaggttgctggtttatgaatatatatgcaatggctcactggattctcatctatatggacgccatcgagatccactagaatggtctgctcgacaaaaagttgctgttggagctgctcgaggtctgcgttatcttcatgaagaatgcagagtgggttgcattgtccaccgtgacatgcgacccaacaacatcctcatcacccatgattttgagccactggttggggattttggcctggctaggtggcagcctgatggagacacgggtgtggaaacaagagtaattggaacatttgggtatttggctccagaatatgctcaaagcggccaaatcacagaaaaggctgatgtatattcttttggggttgtcttggtggagcttgtcacaggacgaaaagctgtggaccttaaccggcccaagggtcagcaatgcctcactgaatgggcacgtcctttattggaagagtatgccattgatgaactagtagacccacggctgggaaactgttattcggagcaggaggtctattgcatgttgcatgcagcatccttgtgcatccggagggatcctcatgcaaggcctcggatgtcacaggtgttacgcattctggagggagacatggttatggactcaaattacatggcaaccccgggttatgatgtgggcagccagagtgggcggatttggtcagaccagcatcaacattacagtggtccaatattaaacgaggcatatgaagaattcagtggtaagctgtcccttgaagcgctaaggtcagccttctgggagaaggataagggcaggaggacttcaagcgaagacaaattgtaaggctaggagtgctacatgtatgggaatgctgaagatgcatttgcctatt

SEQ ID NO: 307 - DNA, 1883 bp, Zea mays
aaaggatccagtgagtgattgcgaatgtgaccgacgacgggctcatcttcttctcttttacactagagcatgatgcatgggcaggagctgtcctatgactcctatccctcctccttcctagccatggacgacatgcaccgccaactccaagcaccaccagcctgccaaagccacagcagcagcagcagcatcttctttttctttttcttagcagcggtcatcatctactgcgtcgtgatcatcagacgattgatcaaattccaagggaggaggagggtgaagaatgatcatgcagcagcagcagcagcaccaccaccaccaccaccaccgagaaggggtagccgctggtggtggtccgtcgtggagacgctggccttcctgtccgccaacagcagcggcaggggcttctaccacttcgtggaggctcgccaccgcaggtacggtcccggcccctgcttccgcacctcgctcttgggcgccacccacgtgttcgtctcgtcggccgacgccgccaggtcgctcctgggcgccgagccagccggcttctcgaagcgctacgtgcgcaccgtggcggagctcctcggcgagcacagcctgctgtgcgcctcccacgccacccaccgcgccctgcggcgcgccgtggcgcccctcttcaacgcgcaggccacggcgtccctggccgccaccttcgacggcctcacgcggaggctcatgaagcgcgactggagcagcagcactggggccgtggtggtgctcgacgccgcgctggacctaacattcgaggccatctgcgacatgctcatcgggaggacgctgcggcccgatgcgaggaggcggctgcagagcgacgtgctggccgtgacgcgggccatgctggcgttcccgctcaggctgccggggaccaggttccacgcgggcctccgggccaggaaaaggatcatggacgtgctcaggcaagagataggatcaagacagagacagatcatggacatggaggaggaggaggaggagcagcagcacggcgacgactttctgcagagccttcttcttctcaggagtaggaggaggaggcggagccagcagcaacaacaccttttaccatcgtcgtcagctcatcataacgacgacgacgacctcttcctcactgacgaccagattctcgataacatcttgacgctcatcattgccgggcaggtgacgacagcgagcgcaattacatggatggtcaagtacctggctgacaacaaagtcttccaagaaaccttgaggtcagttcagctggagctgaagcagcagcagcagcaggaggaggcagatcatgatctcctccaacatctcaacagcatggagcttgcatacatgacggttaaagaatcattgaggatggcgagcatagtttcctggtttccaagggtagcactcgaggactgccaggtcgcagggttccacatccacaaggggtggattgtgaacattgatgcgagggccctacactacgatgcgacgctctaccacaaccccaccatgtttgatccttcaagattcaaaggcgggcatagcatgcacacgaagcagccgtacagcttcctggtgtttggagcaggcgggagaacctgcctggggatgaacctcgccaaaatcatgatgctcatttttctgcaccaccttgttacaacatggagatgggagatggccgacgacgaccccagccttgagaagtgggcaatgtttcccaggctcagaaacggatgccccattcacctcgcacgcatatgatgattaagcatgcactagctaccagaggaaactagtatatatcttctgtaaccctaaaccacaatgcaaccacaaagcaccgatgtgatgtgtactttggtaccttt

SEQ ID NO: 308 - DNA, 816 bp, Triticum aestivum
ttccttatcaccatcactcaggctgagttagcggcgcgcccaaggaagaaacggagaacgaaaacaatggccgccctccgccacctcgccggcgccacccacaaccaccgcatcgcggccaactcctcctccctcttcgacctccagcggccgccttcctgcctcgccgcggcgcgacccctcagcctcgcgcccctccgctcccgcttcacccggctttacgcgctgtccagcaacgacatcaaggtggggttcaacctggaggtggacggcgcgccgtggaagattcttgagtttctccatgtcaaacctggaaaaggtgccgcttttgtgaggacaaaaatgcgcaattatatcactggcaacacagttgagaaaacctttcgagctggaagtacgatccaggaagcttctatttcaaaggaaaccaaacaattcacctacaaggatggctcccagtttgtgttcatggatttgacgtcctttgaagagagccgcttaaacgagtcagatgttggcgacaggcagaagtggttgaaagaaggaatggactgcactttgttatactggaatggacggatcattgattttgatcttcccatcactgttaggctgaccgtaaccgaggctgatccagggcaaggtgacagtgcacaaggaggaacaaagcctgcaactctggaaacaggagctgttgtcaatgtgccgtctttcgttgatgtaggcgatgatgtcctaattgactcgagaaccgggcagtatatgagccgggcatagagtggaagtggataccagatgagatgccaacagtgaaga

SEQ ID NO: 309 - DNA, 1580 bp, Triticum aestivum
cggccatggccgggctgcggcttcttgtcggggcgctttggctgctggcggtgctgcgggagggcgcggcggcggaggcgggggccgtcgccgtggacgggcggcgcgccattgcggccacgggcgaggacttcgtctgcgccaccctcgactggtggccgccggacaagtgcgactacggcacctgcagctggggcaacgcatccctcctcaacctggatctctccaacaaaatcctgctcaatgccatcaaagccttctcgccgctggtgctccggctgggcggctcgctgcaggacaaggtggtgtacggcacggcggaccggccggggccgtgcgcgccgttcaacaagagcaagtcggagatgttcggcttcacccagggctgcctgcccatgccccgctgggacgacctcaacgccttcttcgagaaatctggggcgaagatcgtgtttggcctgaacgcgctcaacggccgggtgccactgcagggcggggccatgggaggcaactgggacaccacgaacgcggcgtccttcatccggtacaccgccggcaagggctacaaaatctatggctgggagctcgggaatgagctcagcggcaccggcgtcgggaccaagatcggcgtggctcagtacgtcaaggacgcgatcgccctgaagacgacggtggacgccatctaccggggcagcccggagaagccgctggtgctcgcgccgggcggcttcttcgacgcgcgctggtacggcgagttcatcgccaagaccaagcccgacatgctcaacgtggtgacccaccacatctacaacctaggggcgggggtggacagggacacacagctgatggacaggatactcaacccgaagacgctcgacggcatggcgggcccgttcagggatctccaggggctgctgaaagccgcagggacgtcggccgtcgcctgggtcggggagtctggaggagcttacaacagtgggcatcaccttgtcaccgacgcatttgtgttcagcttctggttcctggatcagctcggcatgtcggcgaaattcgacaccaagagctactgcaggcagagcttcatcggcggcaactacggcctgctgaacacaaccaccttccagccaaatcctgactactacagtgctctgctgtggcatcgcctgatgggaaccaaggtgctggaagccaagttcacgggcaccaacatggtccgcgcctacgcgcattgcgcaaagcatgctccggggataaccctgctgctcatcaacctgcacgtcaacgcgacgaaccacgtctcggtggcgggccgcggcgcacacgccggaaggaagcacggggggaggtttgctcagccgcccggggcggcgagggaggagtaccacctcacgcccgagggcggcaacatccagagccaggtgatgctgctgaacggcagggcgctggccgccggcgccgacgggagcatccccgggatggagcctgtcaaggtggacgcggcgcggcccatcgccgtggcgccccggtccatcgtgttcgtccacatgccggattaccatgcccctgcgtgtgcttagtag

SEQ ID NO: 310 - DNA, 1202 bp, Solanum lycopersicum
aaaggatccttcaattcgcattgctactctctactcatcaatcactctttctctctttggctgtatacgattcactctcgtttttttcaatttccctcctctttttttgtatcaatggcggaggcgacggagatgccgtacattgagttgaataccggtttcagcattccggcggtcggtttgggaacgtggcagtccgatcccggtgtcgtcggcaaagccgtggagactgctatcaagatgggctaccggcatattgattgtgctcaaatttataaaaatgagaaggagattggtgaagtattgagcaggctgtttaaagatggtgttgtcaagaggcgagagctattcattacatccaaactctggaacactaatcacgcacctgaagatgtaccagtcgcactagacaaaactcttcaagacttgcagctggaatatgttgacctgtacctaatccattggcctgtcagtatgaaacctggctcggttgactttaaacctgaaaatcttatgccaaccaacatacccaggatatgggaagcaatggaaaaagtttatgattccgggaaggctagagttattggtgttagcaatttctctactaagaaactggaagatcttttgcaagtagcacgcactcctcctgctgtcaaccaggtggagtgccatccttcgtggcaacaagccaaattgcgggaattatgtaaatccaataacgtgcacctctctgcatattcgccgcttggttctccaggtacaacatggcttaaaagtgatgtgctaaagcagccagctgtaatctcagttgctgagaaattgggcaagactccggcacaggtttgtcttcgttggggcattcagatgggtcagagtgtacttcctaagagcacacatgaagcacggattaaagagaaccttgatgtactgaactggtctatacctgatgacttgcttgccaagttctctgaaattccacaggcaaggttgctgaaaggtgcttcatttgctcacgagacgcatggccagtacagaacacttgaagagctgtgggatggtgagatttagggtcacaatatgaattaactgttgaatccatttgtctcagagatttaagcttcttgtgcacttccttttcctttaaacttttggagataggtgaattgtcaaaccattagatgtacgtttccttgcggtacctt

SEQ ID NO: 311 - DNA, 643 bp, Triticum aestivum
aaaggatccgctcctgcacctcccttatcgcggtggattggcctcctctcctctatcttgttggccgcccatctcgactctccaaactctcagctccctccctcgcacacgccgttctcgaatggcggccacctccggcctcacggccaccgtcacctcccctccggccgcccttagagcctcgcctcctcccgtcctcttcctccgccccatctctcgctgctccaggctccattccctcaaggccaaggcagcagcaaaggaccaggacgaaaagaagcccgaagctaccaaaaagaaggcgtacagtcttgtttgcactgcctgcgaagggaacggcgcaatcgcatgcacccaatgcaagggaggtggggagaatttggaagaccattttggtggccgattcaaagctggaggattatgctggctttgcagaggaaagcgtgaaattctatgtgggagctgcaatggcgctggcttcttgggtggatttatgagcactgccgacgacacttccgaatgaaatgcttatgttgttattttttgcttatgttgtatttggcaaattttgggagatctgtaacatttttacttgtatcccccccccccccccccccaaggaatgtgtcccttaggtaccttt

SEQ ID NO: 312 - DNA, 496 bp, Triticum aestivum
ctccattgccttgctttctctgcctgcctcgaggagctagctagaaagcgagaaagaaacccgccggcgccggagaagaggaaggggagggagagggaggatgtcggactgggggtcggtggtgatcgcggtggtgctgttcgtgctgctgtcgccggggctgctgctgcagctgcccgggaagcaccacttcgtggagttcggcaacatgcacaccagcgccatggccatcctcgtccacgccatcatctacttcgccctcatcgcgctcttcgtcatcatcatcggcgtgcacatcaccactgactagacaccggctgagctccatcaccccggccggccagctccaattaagctgctcttcctttttctttttttcatccatctgactcccgcctctctgttttgttttgttctggtcttgctgcttgcaagtacttgtagtagtgtatgtgatcatgttcgtttgttgtccttggtaattaaactcgcgtag

SEQ ID NO: 313 - DNA, 1013 bp, Triticum aestivum
acttgttccagccagccagagctctcgcactcctctgccgctataaaatcgagagcctcccgggcgagccgctctgtatccagccagcagcaggcctcggcaactacttggtttttgttcctctctgagtcgcggcaaggcaatcaaccgaggccggctggtcggttgaggaaggaggccgggggcgcggcatggagtccggcggtgaggagcaggcgaggcagaacggccatggcggggacggcggcgacccggcggagtggaagaaggtggccgagctccgggccgtggtggaggcgcaggaccccgcagccaaggaggaggacgacttcatgctgcggcggttcctgcgagcccgggaccacaacatcagcaaggcgtcggcgatgttcctcaagtacctcgcctggaaacgagccgcccagccgcgcggctccatcactgaggccgatgtgcgcggcgagctcgtgcaggacaagctctacgtgcaaggcttcgacaagacgggccgccccatgatctacctcttcggcaaccggcacttcgccgccaagcgcgacctcgaggagttcaagcgctacgttgtctacattctcgacaacacctgcaccaagttgccggcggggcaggagaagtttgcgtccgtggtggacctgaaggggtgggggtatgccaactgtgacattcgggcgaagctggcggcgttggagatcatgcagaactactacccggagcggctgggtcgggtgttcctgatccacgtgccttacgtgttcatggcggcgtggaagatggtgtaccccttcatcgacgacaacaccaagaagaagtttgtctttgtagctgacaaagacctcgactccacgctccgggacgctatcgatgtatctcagctgcccgagcagtacggcggcaagctcagacttgaggggtacaagagctcgtcgacatgcaactgattcatgtattatggatgtccaattgtgcgcaagtatgtaacattgccacgctag

SEQ ID NO: 314 - DNA, 1155 bp, Sorghum bicolor
aagcttccagtgcctcgcgccgcagccatgagcgacggcaaggacgccctcgacctctccgctatcggcgccgccctccccaactcggccgagctcagcgcggaggacaaggctcaccttgtggcgtcgatcaagaacacgctcgagggattggcgtcgcggcataccgacgtgctcgagaacctcgagcccaaggtcaggaagcgcgtcgagaagctcagggagatccagggccaacacgatgagcttgaggcaaagttttttgaggagagagcagctctagaagctaagtatcagaagttgtatgaaccactttactcaaagcgttacgaaattgtcaatggtgtggtcgaggttgagggtgtcacagaagaaagtgcagctgaaactcctgcagagcaaaagggtggagatgagacctctgctgagccaaaagaagaaaaaggtgtaccagctttctggcttaatgcaatgaagaatcatgaaattctagctgaggagatccaggagagggatgaggaagctctcaagtacctcaaggacatcaagtggtacaggatcagtgagccgaagggctttaagcttgaatttcactttgatacaaatccgttcttcaagaattcagtgcttacaaaaacatatcacatgattgatgaggatgaaccaattctggagaaagccattggtactgacattgaatggtaccctgggaagtgcttgacacaaaaggtgctaaaaaggaagccacggaaggggtcaaagaacactaaacctatcacaaaaactgaagattgtgagagcttcttcaacttcttcagtccacctcaggtccctgatgacgatgaggaaattgatgaggatacagctgaacagttgcagaaccaaatggagcaagattatgatattggatctaccatcagagacaagattatcccacatgctgtctcgtggttcactggagaggctgctcaagatgaggactttgaagttatggatggtgaggatgacgatgacgaagatggtgatgatgacgaagaagacgaagacgacgaggatgaagatgatgatgattatgacacaaagaagaccaagggaactgctggaggggaagggcagcagggcgaacgacctgccgagtgcaagcagcagtaataa

SEQ ID NO: 315 - DNA, 602 bp, Sorghum bicolor
gaggtaatagctgcaggctcacgcctcacctagcttctccggctggccttcgttgttccccagcaatttcgtcagccactcctccatatatccagccacaagtcaaacacaagacacacaattaattaagcgatcgatcatcatcaggattcaggaggccaggcggatcgacgacgacgagatgtcggactggggccccgtggtgatcgggctggtgctgttcgtgctcctctcgccggggctgctgatccagctccccggccgccaccacttcgtcgagttcggcaacctgcagaccagcgccgtctccatcctcgtccactccatcatctacttcgcgcttatcaccatcttcgtcatcgtcatcggagtgcacatcaccaccggcaactagctatctacctacctataatatcatatctcgattattcaatcaccaccttgattgcttgttgtagattcaatcatataaatcgtcgatcctattcttcattcgcttctttctttctttctttctttctttcaaattcatgcatctgtattactacatcatatatacatgtcttcctacctacttctgactcctctctgtccttcacagc

SEQ ID NO: 316 - DNA, 517 bp, Zea mays
ctccgtcgcattcaacacgtacgccatggcgcgcctgctccgcgccgccgccgtcctggcgctcctggccgtctccaccgccgcgctgtcggcgccggcgtgggcgggcggcgtgtccgccggcgacctggcccatctgggcgccgccgtcgtgattcggcgcggcggcgggcgggcgtgccgcggcggtacgacggtgggcgagtgcatggagtacctggacgtggacgccgagggcgaggccgacgtcgccggcatggccacgggcggcagcaagcgccgggtgctgcagggcggctccggctacatcggctacgacgcgctgcgccgggacaacgtgccctgctcgcagcgcggcgcgtcctactacaactgccagcccggcgccgaggccaacccctactcccgcggctgcagcgccatcacccagtgcaggggctgatcgatgcatgcatggtttcacattccattctccggcagcagggtaaatcggttgctgctagcttcattcatgtag

SEQ ID NO: 317 - DNA, 800 bp, Glycine max
cttggactcagttcagtttcacgaccgatcctacaatggcgacagtcacgttttccttttccgctaaaaccctaactctaccttatcaccccaaaaccccaatctccaactttaccccggtaacgaatcttcgcctccctccttctatcgtgacccgaacccgcaattgtaaccggattcgggcggcgctggatggggatttctcggcgaaaaggagcagcagcagcaacaacaacgaccagagggagacgataatgttacctggttgtgactacaaccattggctgattgtgatggagtttccaaaggaccctgcacccacccgtgaacagatgattgacacgtacctcgacactcttgccactgtcttgggaagcatggaggaagctaaaaagaacatgtatgcctttagcaccaccacttacactggatttcagtgcactgttgatgaagcaacctccgagaaattcaagggtttgcctggggttctttgggtactgccagactcctatatagatgttaagaataaagactacggaggtgacaagtacataaatggggagattattccttgtaagtaccctacctaccaaccgaaacgtagcgcaccaaagaatgagagtagaaggtatgagagacggagagatggccctccccctgaccgcagaaggccaagacaagaggccgctgcctccgattcatcctctacatgagccttgcaggtgagtttcagttttgctgatagtaactaatgccaagtgaaagctgctccttatcacagctctatcatgctcatggtc

SEQ ID NO: 318 - DNA, 1140 bp, Triticum aestivum
ccggactactgtcgttgttaccagcaagccggcaatctccatccacaagctctaaagtctaaagaaagaacgggcaatcagaaagccttccaagaagtgacgcgggagaggagcagggcggcgcaagccatggccatggtggagcagcggatcgagcacagccacctcgccatcagaggcctcaacctccacgtagcgcaagcaggcacaggcgagctcgggacggtgctgttcctgcacggcttcccggagatatggtactcgtggcgccaccagatgctggccgtggccgccgccgggtaccgtgccatcgcgccggactggcgggggtatggcctctccgaccagccgccggagccggaggcggcggcgtacagcgacctgacagaggatctcctcgccctcctggatgcgctctccgtccccaaggcttaccttgtggcaaaggatttcggagccatgctagcttatgattttgctcttcgtcaccccagccgcacatgcggtgttatgtgtttgggcatcccttttcttcacggtggctcctccttcactgccatgcccgaaggcttctatatactgcgttggcgggaaccaggaagagcagaggcagactttggcaggtatgacgtcaagcgagtcgtgcacaccatctacattctcttctctagaagcgaaatcccgacagcgaaggaagatcaagaaatcacggatctcgcggacctgtcgactccccttccagagtggttcaccgaggaggatcttgcagtctacacgtccctctatgagaaatcaggtttcgtgtatccactgcagatgccatacaggtctctccataagaggcaaccaatcgaagacccaaaattcgaagtcccggtgttcgtcgtcatgggggagaaagactacgtgatcaagttccccggggtcgaggccgtgttgaaaaatggcaccatggagaagtttgcgccggatctgaagatcacttacatccctgaaggaagccatttcgttcaggagcagttcccggacaaggtcaacgagctcctccttggcttcctcaaggaccatcctgtggcttgacacacggggtctataagtctattatgcttggcctgcacttggttgagcaccctactctag

SEQ ID NO: 319 - DNA, 1066 bp, Triticum aestivum
tgacacatcggcacttggctgcgtcgaggcgctctgcagttcgcgaccagctaccctgcagtactgcgccaccaccctccggccatggccgcgccccgccccaccgtcctcgtcaccggcgccggcggccgcacaggccaaatcgtgttcagcaagctcagggagagatccgaccagttcgcggcgaggggcctggtgaggtcggaggagagcaagcagaagatcgggggagccgacgacgtctacgtggccgacatcagggaggcggagcacctggcgcccgccgtgcagggcgccgacgcgctcgtcatcctcaccagcgcctcccccaagatgaagccggggttcgaccccaccaagggcggccggcccgagttctactacgaggacggagcctaccctgagcaggtggactggattgggcagaagaatcagattgatgctgccaaagcagctggtgtgaagcacatagtcttggtgggatccatggggggaacaaatcccaaccatccattgaacagccttggcaatggcaatatactggtctggaagcgcaagtctgaacagtatctggcagacagtggagttccttatacaatcataaggcctggtggtctgcaagacaaagatgggggagtgagggagctgattgtcgggaaggatgatgagcttctccagactgacactaaggcaattcctagggctgatgtggctgaagtttgtgttcaggccctgcagtatgaagaggtgaagttcaaggcattcgatttggcttcgaagcctgaaggtgagggcaccccgacgaaagatttcaaagcgctgttctcccaggtcacagcccggttttgaggcatcagttaaggagcataagtgcatttctaagcttataaggatcttaatgtctttgagtgtgtatccttgtgcattatgaagttgctgactgatgtaattgcacaatcggtttatcaataatgctgaaaatagcctcctatggatgcatggagattggagaagcaatctatgcattttcccgagattttctccgaggagaaggagtcagcaaaca

SEQ ID NO: 320 - DNA, 1459 bp, Triticum aestivum
gctatctctgagccgaggagactcgccgccagatgctgcccaccggcaggagcaggcctcagcccaggcccgcgcccagatcttggtccttctcagacatggacttctctgatccgaagcgcaactccaggtacctcagcaagatcatcatggtcgcgctcctcacggccatgtgcgtcgtcatgctcacccagccgccctgccataggaaggctcccagcgtgttctccatccatgaactcggagtaacacatgtgttggtgacgggtggcgctggctacataggatcgcatgcggctcttcgattgctcaaagactccttcagagtcaccattgtggataatctctcaagaggaaatatcggggcggtcaaggttcttcagaacttgtttcctgatcctgggcgattgcaattcatacatgctgatttaggcgatccaaaagctgtcaacagaatattcgcagagaatgcatttgatgccgtcatgcacttcgctgctgtcgcgtatgtgggagagagcacgcttgagcctctgaggtactatcataacatcactgcaaacactttggttgtgctagaagccatggcgacgcacaatgttaaaaccctgatctactctagcacatgtgccacctacggggaacccgagaagatgcctatcactgaagaaactccccagtttcctataaacccatatggcaaggccaagaaaatggcagaggatatcattttggacttctccaagtcgaggaaatcagacatgtcggtgatgatcctgagatacttcaacgtcatcggttctgacccagaaggaaggctgggtgaggctccaccacccgaattgcgtgagcatggccgtatatccggtgcgtgcttcgacgcggcactaggaataatcccaggcttgaaggtcaaaggtaccgactacgaaacggccgacgggacttgcgtaagagattacatcgatgtcaccgacctggtggatgcccacgtgaaagcgctcaacaaggcagagagaggcaaagttggcatatacaatgttggcaccggaagaggtaggtcggtgaaggagtttgtggaggcttgcaagaaggcgaccggagtcgacatcaaggtcgactacttccctcgccgccccggtgactatgccgaagtgtacagcaaccccgcaaggatcaaccgcgagctaaactggacagcccagcacaccgaactccaggagagcctcagggtcgcgtggacatggcagaagaagcaccggagtggctatgcagactcgggtcgatatattttttgactcaactcacagagatagcagttacacataatttatatagcgtgtatggtcatttgttcaattcctgggattttatttatatatgggaagttcaccagttcgttataaatatcgacatgttctttcactgaacagtaatggtcgccagctattaagttcat

SEQ ID NO: 321 - DNA, 1809 bp, Triticum aestivum
aaaggatccttctccgatcctcacgaaaccgccgcgcccttctcccacccgcgcccttccccgctgggccatgcccctgccgccgccgcagcagcagccgcgatggcgcgttgcggcgtggaggtgatcgccagcaggggctgctccaggctgatcctccccgggatgcagccctcctcggcttccgccgcctcctcctccgtctcggcctcccgctccgccgcggccgcccggcgcccgcccgacggccccttcgccggcctggtcgtctgcgtcacggggctgtccaaagaggcgaggagtcaggtgaaggaggccgctgagaggctgggaggcgagtacagcggcagcttgcaccccaaatgcactcacctcgtggtgcagagcttcgccggccgcaagtttgagcacgctctcaagcatggtcccaggaatggcctttttgttgtcacgctgggctggtttgtcgattgtgttcgaaggaacatgaggctggatgaatccttgtacagtatcaagaacattggggagaacggtctgctgctcggggaatccaaccggcttgttggactgcctgtcaatgagaagtcatgccttccaccaatgatttttcaagacaaagcatgctcagacacaacacataagcgccagcttcaggctcatagagaagaacctgaagatgatgtgttcgtttttacgaatgacacaatctacattgaccctgggatatctggtgagatgaagaagaagatatcggatgctgctacgagtgaagatgcaaaattattggaccactggtttattggttgtcatgccacatatgttgtgtgtgaggatgcttctgtcaagagatatgttggtcactcagataacattgtaacaccgttttggatcttgaaaacagtgaaggaaaagaacttgcagcgcctggtccatttgtcttcagacctagctagacatgtcgcagtggttctcgaaaatttccacacatctcgagagaatacgaaacttgggagtgttccttctcttaactccagcgagctgccaacccaaggggagatagatgagactcatcaggaaaggcaaaaatttgtcgaggcagcgaaaaaggatattcgagaccgtcgtgttcgccgtatgcagtcatgtgaagtaccaatccatccgctcacacctgtcacacttctggattcaatctgctggacaatatctgagccggtttcatctgcaagtatttatatggattcttcatggtctgaagatgccgatgagcagcaaagcactacttattttgatgcagatggggatggaaaggatcgagaccagtcagctgataatttgtctcgcccgctaagagaaagtgagagaagcgaggtgatttttaagaaccatttctttaccatactcttccctctcgatcgttttggcgagcttggaccttcttcgaggacattcttcagcaatggtggcttcacacgcgaacaagtgttggatcacatctataatttctaccaggagaatatgtcaaccgacgagataaatgtagccctgcacacggattcacggcatgccgatcgacttcgttccctgtacgcaagcgctgaatgcgcagaacgaggctttgtagtagcattcaaaagaatagattttttgggaagccggagaagtttcgaggcactaaagcgccttagcagagagaacaatagcaatgtatatgagcttgtgattagggcatgaaccgcacccctactcggtgccatttagtaaaatttgtttgttgcttacaggatgtactgtgccggtaccttt

SEQ ID NO: 322 - DNA, 337 bp, Triticum aestivum
agctgaaagcaatagcaccaagcacctagctcagcagcttggatttcacagcaccagctcccatggccagcttcgccacccagctgctggacgtgttctacgacctcgtccagcgcgtcaccggctacagcgcccgcgccgaggacgacaaggatctacagaaacatagcaacttggcaactacggaggctttccggacggaggaagttatcgagatcaggtccagaaatcacccggatgtaccaggagggtcaggcgctcaggtgaattaacatggatggtatgtagagctagctagcctctacgtacggcagagacatccgtgtggtttctgata

SEQ ID NO: 323 - DNA, 1072 bp, Triticum aestivum
gtacgagcgctgaaggcatggccagccacttcgtcctcagcaccggcgccaagatcccgtcggtcgggctcggcacctggcagtccgagcccggcgttgtcggcgacgccgtctacgccgccgtcaaggctggttaccggcacatcgactgtgctcaggtctacggcaacgagaaagagatcggattcgccctcaagaaggtgttcgacgagggcataaccagccggcaagatctcttcatcacctccaagctatggtgcactaaccacgcgccggaggacgtgccggtggcgctggacggcacgctccaggacctgcagaccgactacgtggacctttacctcgtacactggccgatccggatgaagaagggcgccggcttcagcccggagaacgtgatcccggccgacataccggcgacgtgggcggcgatggagggcgtctacgactccggcaaggcccgcgccatcggggtcagcaacttctcgtgcaagaagctggaggatctgctcgccgtcgcgcgcgtgccgccggcggccaaccaggtggagtgccaccccgtctggcagcaggccaagctccgggacctctgcgcgtccaaagggatacacttctccgcctactcgccgctgggctcgccggggacgttcaaagcattcaccgtgctggagcacccggtggtggtgtcgacggcggagaagctggggaagacgccggcgcaggtggcgctgcggtgggggatccagtcggggcacagcgtgctgcccaagagcacccacgaggagaggatcaaggccaacttcgacgtcttcgactggtccattccgagcgacctgttcgccggcttctctgaaatcgaacaaacaaggctgatccgcgggaaattctggactcacccggaaggcctgttcaaatccgaagaagagatctgggatggtgaaatatagtctgaacagaacagtcactgttccttgagcggaggctgccaagtgctgccatggcaacagaataatgcggtagtaataatcagcagtcgaaggagctcgagcttcgctgctgctggtatgtagag

SEQ ID NO: 324 - DNA, 1652 bp, Solanum lycopersicum
cccaatgcatatcaacttctccctttgagctcatttattatcacaatttatttaactatttttttgttcaaacaaaattattatcaatggcaaatttgatttcaaaatcaacaaaatttaaccattttcttcaaaacacaagagtttgtttcttacgatcgtttacaacttctgccgccggcgccggtgctggtggttatattaagccggcggggagtttttccggcgagtctgccgccatttttcggccggaacgttaccagtccggtaaagctggagagcaactagatacaattgactatgaagaagatgaaaatcaggtgatggattttcctggtggaaaagttccaattactcctcaaatgaaatttatttcagagtcgtctgagaagagattaccttgttatagagttcttgatgatgatggttatccacttccagggacaatctttgaggaggtgagcaaagaattggcaataaagatgtatagttcaatggtgacacttcaaactatggataccattttttatgaagcgcaaaggcaggggaggttgtcgttctatctcacaactgctggagaagaagctatcaacgtagcatctgctgctgctctttccttagacgacttcgtgttacctcagtacagggaagtaggggttatattatggcgtggttaccccttggaacaggttgccaatcaattgttcggaaacaagtttgattatggaaaaggaaggcaaatgccctgccactatggttctaatgagctcaactacttaactgtttcttcgccaatagcaacacagattcctcaggccgtgggcgttgcttattccctcaaaatggaaaaaaaggaggcttgcgcagtcacttattttggagatggtagcaccagtgagggagattttcatgcagcattaaactttgcagcagtattggatgctcctgttgtctttatatgccgcaacaacggatgggccattagcactcctataaaccaacaatttcgaagtgacggaatcgcctctagaggacaagcgtatggtgttagaagcattcgtgtagatggcaacgatgccttggcaacttatagtgctattcgtgcagctcgccaaatggcaattaaggaacaaaggccaatattagtagaggccatgacatatagagtagctcaccattcaacatctgatgattcaaccaagtatcgacccgttgaggaaatcgaacactggaaaacagcaaaaagtcctatatcaaaattcagaaaatacattcaaagaaatggctggtggaatgatgaaaatgaatctgaacttcgcggagacatcagaaaacaggtgttgcaagctattcaagcagcagagaaggtggataaaccttcattgaaagatttgtttacagatgtttatgacaaaatgccattaaatcttcaagatcaagagaaatttgttaaggatgctgtaaaaagatctccaaaagaatatccttctgatgttcctatataagcttatagtgtgttatgataaggggcagagctacagcttcgcaatcaattcattcgtgttgcgtaatatgtataattaattaattagtaaactctgaatcaaaaactcgtaaactcaaaatctcaactcggtttctgaatagctagc

SEQ ID NO: 325 - DNA, 1054 bp, Solanum lycopersicum
aaatcctcttctcagttctgctgagtaaaaaaatcacacaaaaatgggcgatcagatagctaaaggtgaagaattcgtgaagaaagctgagaaaaaactaagcggttggggactgttcggctccaaatacgacgatgctgcagatttgttcgataaagctgcgaattgcttcaaactcgctaaatcatgggatcgagctggagcagtatatgtcaaactagcgagttgtcatttgaaattggatagcaaacatgaggctgctggtgcttacgctaatgctgctcattgctacaagaagacaaatatgagagaggcaatatcatgtctagagcaggcagtacacatgtttctggacattggaaggctaaatatgtctgcaagatattacaaggaaattgctgagttatatgaacaagagcaaaatttggagcaggctatcacttactatgagaaagcagctgatcttttccagagtgaggatgtaacaacaactgcaaatcagtgcaagcagaaaattgcagaattctctgctaaattagaaaaatatcaaagagcaattgagatctttgaggagatagcacaacactccatcaagaacaacttgttgaagtatggagttagaggtcatcttctgaatgctggtatttgccaactttgtagaggtgatgttgttgcaattaacaatgcattggagcgatatcaggaactggatccaacattttcagggacacgcgagtgcaagttgctagtggatttggaagctgcaattgacgaggaagatgttgcaaagtttactggttgtctcaaggaatatgatagcatgacaaagctggatgaatggaggacaacacttcttttgagagtgaaggaagcgttgaaggcgaaggagctagaggaagatgatcttacttaaattattcttatatgaaactggtttgtaaattgcattatttgtgattcctattattttctacttggtgattgttttctcatctcatgctacttaatttttaacaatttcattttgtactggttgagtttgagttccatattg

SEQ ID NO: 326 - DNA, 2792 bp, Zea mays
acgaaatgctgtctttttctcgttcggccatcctctcctacctactgtggtgtcttctatttctcacattggcaagcagcaatggcgcggtcgccacagcaaagccgaaggctgggtgcgggtacaagctggtctcccttgttcagctgcccaacgggggaggccttgtgggttacctgcaggtgaagcagcgcacctccacttatggtcctgacatccctcgcctcaggctctttgtcaagcacgagaccagggagagggtgcgcgtgcagattacagatgcagataagcagaggtgggaggtcccctacaacctgctcccaagggagccagccccacccgtgaccggcggcaaggtcacgggcgcccccttcacgggcgccgagtaccccggcgaggagctggtgttcacctatgggcgcgacccgttctggttcgcggtgcaccgccggtccactcggcagccgctgttcaacaccagcgccggcgcgctggtgttcaaggaccagtacctggaggtgtccacggcgctgcccaagaacgccgccctgtacgggctcggcgagaacacgcagccggggggcatccggctgcggcccaacgacccctacaccatctacaccacggacatttccgccatcaacctcaacaccgacctctacggctcgcacccggtgtacatggacctccgcagcctgggcggccgcggcgtcgcgcacgccgtgctgctgctcaacagcaatggcatggatgtgttctacaggggcacgtcgctgacctacaaggtcatcggaggtcttctcgacttctacttcttctcgggcccgacgccgttggccatagtggatcagtacacgtcgatgatcggccgtcccgcgcccatgccttactgggcattcgggttccaccaatgtaggtgggggtacaagaacctttcagtggtagagggcgttgtggaaggttaccgtaatgcccagataccgctggacgtgatctggaacgatgacgaccacatggatgccgctaaggacttcacactcgatccggtcaactacccacgccccaaactgctggcgttccttgacaagatccatgcgcaaggcatgaagtacatcgtcctcatcgaccctggcattgccgtgaacagctcctatggcgtctaccagcgtggcatggaacgtgacatctttatcaagctggacgggcagccatacctcgcccaggtgtggcctggccccgtctacttcccggacttcctcaacccgaacggtgtgtcgtggtggatcgatgaggtgcggaggtttcatgatctggtcccggtggatggcctctggattgacatgaacgaggcctccaacttctgcacgggcaagtgcacgattccgaagacgcaccagtgccctattcctgacaccaagacaccatggctctgttgcttggattgcaagaaccttacaaacacgaggtgggatgagccgccgtacaagatcaacgcctccgggcagactgcccgtctcggcttcaacaccatcgcaaccagcgctacacactacaacggcatcctggagtacaatgcgcacagtctgtatggcttctcgcaggccattgccacgcatacggcgctgcaagggctgcaggggaagaggccgttcatcctgacccgctccacgttcgtcgggtcgggggcgtatgccgcgcactggaccggagacaacaagggcacgtgggaaaatctccgttactcgatctcaaccatgctcaactttggcatcttcggcatgcccatggttggctctgacatctgcggtttctacccgtcgccgactgaggagctctgcaacaggtggattgagctcggggccttctaccccttctccagggaccatgccaacttcgcgtcaccgaggcaggagctgtatgtctgggactccgtggcgaagtctgctcggaacgcgctcggcatgcggtacaagctgctcccctacctgtacacgctcaactaccaggcgcacctgaccggggcccccgtggcgcggccggtgttcttctccttccccgacttcacgccgtgctacgggctgagcacgcagttcctgctcggtcccggcgtcatggtgtccccggtcctcgagcagggcgccacttcggtgagcgccatgttcccgccgggcacctggtacaacctgttcgacatgagtaaggtggtggtgtccaggagcggggccccagtgaagctggacgcgccgctgaacgagatcaacgtgcacgtgtaccagaacacgatcctgccgatgcagcgcggcgggttcgtctccaaggacgcccgggcgacgccgttcacgctcgtggtcgcgttcccgttcggggcgacgcaggccgacgcggagggcgcggtgtacgtggacgacgacgagcgcccggagatggtgctcgcggaaggccaggcgtcgtacgtgcgtttccacgcgagcgtgcgcggaaaggccgtgacggtgcggtcggaggtgctgatgggaagctacagcctgcacaaggggctggtcgtcgagaagctctcggtgctgggtctggagggtaccggcaaggaccttgccatccaggtggacggcacggacgccactgccgtcgcgacgtcgagcccttactttgcagcaggtggcaacgcgaagctgcagggggaagaaggcgtcgaggatagtaagaacggcgtcatggtggagatcggcgggctggcattgccgctcgggaagagcttcaccatgacatggaacatgcggatcgaagcatagtag

SEQ ID NO: 327 - DNA, 965 bp, Zea mays
aaaggatccgatgtttgtttccattccatcggtggcacgagacaggagacgccagggccatagctagagcctagagcagcagcagaggcttgacctgaagctccacccgccatggcattcacgcccgctacggcctgctgcaaggcttccctggcgctggcaccgcgggcgtcgccccgcggcccggcgtcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtcgccaagggcagcgtgccgccgaacttcaccctcaaggaccagaacggcaagcccgtgtcgctgaacaagttcaagggcaagcccgtcgtggtttacttctaccccgccgacgagacgcccggatgcacaaagcaggcgtgcgcgttcagggactcgtacgagaagttcaagaaggccggggcggaggtgatcggcatcagcggcgacgacgcggcgtcgcacaaggcgttcgcgcagaagtaccggctgccgttcacgctgctgagcgacgaggggaaccgcgtgcgcaaggagtggggcgtcccctcggacctgttcgggacgctgccggggcgccagacgtacgtgctggacaagcagggcgtcgtgcagtacgtctacaacaaccagttccagcccgagaagcacatcggcgagacgctcaagatcctgcagaccctctgatccgatcaacctcctcactgttctgggccatgctctgcattcgtcgctgtaaaagtaccggactatgtagtagtgtagtgtatgtaaccaagagctgatgacctgatgttttgttccatccttcagtgagtctatctatcacacgattctggctcgtttgatcgaccagcatcttcctgtttgtcatgggtaccttt

SEQ ID NO: 328 - DNA, 2189 bp, Zea mays
tggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcggcccggaaccgcgcgtccgtcgctcgcagcctgctgctggagtgcgagtgcaggaaccaccgccccgccgcccccggcgccggggagaacacgctgctccgggccgggtacggcggctgggtgctctacgcggcggcgtcggccggggacgccgcgttcgtgcgggagctgctggagagggacccgctgctcgtgttcggcgagggcgagtacggcgtcacggacatgttctacgcggcagccaggggcgggagcgcggacgtgttcaggctgctgctcgaccacgccatgtcgccgaggtgctcgacgagttgccggaacggcgaagccagcgccaggcgcagctccgtgttccggcttgagatgatgagccgggccgtccacgccgcggcgaggggcgggagcgtggagatgctcagggagctgctcgaggagtccagcgtgtcgacgtatctcgacatccgtggatccaccgtgctgcatgccgccgctgggagagggcagctgcaggttgtcaagtaccttgtggcctctttcgacataatcaattcgactgataatcacgggaacacagcgctgcatgtagcggcctaccgagggcaccaacctgtcgtggaagccttggttgctgcgtctccatcaaccttgtcagttgtcaacaacgccggtgacacgtttctccactcggcagttacaggattcaggaccccaggattccgacggctcgaccgccagttggagctgatgaggtacctcatacgcgagagaaccgcggatatccagaagatcatcaacctgagaaacgacgcgggccttacagctcttcacctggctgtggttggctgcgcacacccggatctcgtcgagctactgatggccaccccgtccatcgacctgaacgctgaagacgctaatggcatgaccgcgctggcgctgctgaagcagcagctgcgctcagcgacgtccgaccggctcatcaagcagatcgtctctgccggaggggtcttgaactccagcatcctgagaacccggtcagccatcgcttctcagatcaagatgcagggcgggatcgcgagcagccccggcaccactttcaaggtatcggatgcggagatattcctgttctccggcatgggagcggcggagtctctgaggccaagctcctgctccagcaacgggaaggatgatgaccctactcacgcagacgcagactgcgccgagaaccgtggatcgtcggagaagaggctgagctccgcgagccgggccaaagaccgcctcaagatgatgctgagatggcctcgccacaaggacaagacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtccccgacggacactttcctgaggtcctcggtatcgtccacgccgcagccgctggcgaagctgaaggacatctgcctcgacgacgagatctccatggtgacgccgcccgccggcaggctgaaggatagtgacgacgccatggaggacccctcgtgctccaacaactcgtccatggacgacggctgtggcgccgggacggcagagagcgcggcccggaagcacgggtgcggcaacgggaggctcatcaacatctgctttggcgcgcagggcctcaccgtggaggactcggcgagcgggcagcagacgagcaagatgttcaagcagcagtgcctcagggtgtcctgattgacggcgtggtgtctcgactacaacagcgtggtgtgatt

SEQ ID NO: 329 - DNA, 572 bp, Oryza sativa
gttcaaggttcagccgagttcgatcgaaaaaccaccgtgcgtgtttgttcgatcgatcgatggcggctcggggaagaggcagtgcatgcaacggggcagccgttcttggcgcggcggcggcggtggtgatcgtcgggttcctcgtgatgagcgccgcgccgctcgccgaggcggccaggtacaccgttggcgacagcagcgggtggaggttctacgccgagggctgggccaagggcaagaccttccgcgccggtgacgtgctcgagttcaagtacaacgcggtggtgcacgacgtggcggccgtggacctggcggcgtaccggagctgcacggtgccgaagggcgtcaggaagatgcggagcgggcgcgacaaggtgacgctccgcaagggcacgcactacttcatctgcaccgagccggggcactgcaaggccggcatgaagctcgccgtcagggccatctagctagcctattctgttggctcgcaaaagaaaatggtcagtctgagctagtccgccctgttcgattgctcgttagtcttttctcaatgcgtagccatgtgtgtgactgta

SEQ ID NO: 330 - DNA, 807 bp, Oryza sativa
aaaggatccactgcagcgagagatcagtagggagagggcaatggcattgacggtgcggctgcacacggcggtggcggcggtggccgtggccgtggtggtggcgatggggatggcggcggcgcagatgtcgccggcgggggcgccggcgccggcgggcgggatcagcccggcgtgcatggacgcggtgctcaacatgtcggactgcctgacgtacgtgatgaacgggagcacggcgcggaagcccgacgagccgtgctgcccggagctggcggggctgctcgagtccaagcccgtctgcctctgccagctgctcgccggcggcgccagctcgtacgacatcagcgtcgactacaagcgcgccatggcgctcccgggcatctgcggcctcgccgcgccgcccgtcaccgcatgcgcgcttcttggagtacctgtgcctatggcgccttctgcatcgccgatggcaggcctcgggccatctactgaaccacaaatgcctgagaaatcgccgtcggcctcgccgtccgagtcgagtaaccatgctcccggccgcttcaccgccctcgccgcggtggtcctcgccgttgcagccgccgggatggtttagaaaatgcctggattttcggccgatcgatctcaagatttagcccgacgattcttgtttattcttgccacacatttggctgtgtattaatttacaacacgttacagtacgtatgcgcaatgaacgatatttttctgctttgctttaaattcttataattaactagtaactcttccttgtcgtaagttgctagagcaggtaccttt

SEQ ID NO: 331 - DNA, 869 bp, Oryza sativa
atcccttctccatggcatccgccgtttcgctcctcctcctctcgtccccgcgcccgctccgccgcgcggcgccggtgccagcgctacgctcccaggcgcgccaccccttgctcctcggccacgcgggcgagaccgcgctcggggtatgggccacgcgcgcccgcctgcccgcgccgccgccgcgcgcctccaacccgaacaacgacaacgacaacagcggcgccgtggaggcgcccgaccgcctggtggccgccgtcgcctacctctacccgttcctcgacggcgtgcaccacggccgcttcctcctcgcgcagttcccgctcttcagcaccctgctcagcccgctcgcgccggccgcgcgcctcttccgctcctccccgctcacgcccttcctcctcttcctcaccctctacttcgccgtcgtgcgcaaccagcaggccttctcccgcttcgtccgcttcaacgccatgcaggccgtcgcgctcgacgtgctgctcatcttccccgacctcctcgtgcagtccttcgcgccctccaccggtggcgggatcggcttcgagctcttccagagtatggagagcaccgtgttcctcttcctgctcgtctgcctagtctacggcgggggcgcgtgcctgctagggaagacgccgcggctgccaatcgtcgcagatgcagccgagcgccaggtgatgtgatgagcttttgtcaaatcttgctggtgaaaaggaacaaaggaaaatgatatacacatccatctcgatgcctcattgatgttagtagatcgcaaattcacaagttcagtttagtacagtgattatttacagctgtagtaaccaatttaatgaatggagttacggaaggttggtaca

SEQ ID NO: 332 - DNA, 1549 bp, Oryza sativa
gaggttcacgagtacagtgacgcatacagagacatgggctccatcgcggccgacggcgacaagccgcacgccgtgtgcatgccgttcccggcgcaggggcacgtcacgcccatgctgaagctcgccaagatcctccaccaccgtggcttccacatcaccttcgtcaacaccgagttcaaccaccgccgcctcctccgctcccgcggcgccgccgcgctggacggcctcccggggttccgcttcgccgccatcccggacggcctcccgccgtccgacgccgacgcgacgcaggacgtgcccccgctctgccgctccaccagggagacgtgcctccctcacttcagccgcctcctcgccgacctcaacgccaacgcctcccccgagtccccgcccgtcacgtgcgtcgtcgccgacgacgtcatgagcttcgccgtcgacgccgccagggagttccgcgtgccgtgcgcgctcttctggacggccagcgtctgcggctacatgggctaccgctactaccgttccttcctcgacaagggcatcttcccgctcaaagaggagcagctgacgaacgggttcttggacgcgccggtggactggacgccggggatgagcaagcacctgcggctcaaggacttcccgtcgttcttccgcgcgacggaccccgacgagtacatgttccacttcgcgctccacgtgacggagcggctggcggaggcggacgccgccgtgctcaacaccttcgacgagctcgagccggaggcgctcgacgcgatgcgcgcgatgctgccgccgtcggtgtccatccacaccatcggcccgctcgggttcctcgccgagcaggtcgttcccaaggggagccccctcgacgcgctgggctccaacctgtggaaggaggacgactcctgcttcggctggctcgacggcaagccgccccggtcggtggtgttcgttaactacggcagcgtcacggtgatgacgaacgaggagctggttgagttcgcgtgggggctcgccaacagcggccacgacttcctgtggatcgtccgccccgacctcatccacggcgatgccgccgtgctgccgccggagttcatggagtccgtcggggggcgcggcctgctggcgagctggtgcccgcaggaggcggtgctgcggcacgaggcggtgggcgtgttcctgacgcactccggctggaactcgacggtggagagcctctgcggcggggtgccgatgctgtgctggccgttcttcgcggagcagcagaccaaccgccggtacagctgcaccgagtggggcgtcgccatggagatcgacgacgacgtgcggcgcgacgcggtggaggccaagatacgggaggcgatgggaggagacaagggccgggagatgcgccgccgggcgggcgagtggaaggagaccggcctccgcgcgacgcgccccggcggccgcgcgcacgccagcctcgacgcgctggtcgccgacgtcctcctctccggtggcaaggctcggtaggacaacgtgcactagtgccgcctgttgcatgctactccct

SEQ ID NO: 333 - DNA, 943 bp, Oryza sativa
aaaggatcccctgcccatttaaatacccatactgtgcttcttggggagagagaaggggagagagagagagagagagaatggcattgcagcaacgaccggggatgctcggcattggctgcagcaacgtcttggcacgagcaagggtgcagcaatgtctagcagcggcgtcccactccaatatgccatgtctacccgtcctcctgcatgtcaatggcagcaagaagcagggtagcagcttcctttcttctcagaggatcggcttaagtaggaggaggaggaggagggacctgagcggcgtcgttgtcgcggaagtgagcgccgccgccggtgtcacgccggcgtcgtcgtcgtcgtcgcctggcggcatcagcgtcagcgatgttctttggccctccgccggtgcattcctagcaatggccgtgctgggaaggatggatcagatgatggcgtacaagggagtatcattgacaattgcccctctcggagcagtctgcgatgtgcttttcaccgctccaggctcacctgctgccaagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccagctgcaagcttgcctctcttgtttattgatggtccaaagtttcaccacttgcaactctggtatgccctttttcctggagctgcaggctgcataattctttgcttgattcaagaggtggtgatttacctgaagaagaatttcaagttttgattcaagcggtgcattacttctcgtagcaatgacatgactaaaattcaagattgtaccacaatttgctagaactgcattggggagaaatggaggaaatgcagattggtaccttt

SEQ ID NO: 334 - DNA, 2321 bp, Oryza sativa
ctttcacaagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactccactggcattgctgaaacagcagctgcgctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacaacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgc

SEQ ID NO: 335 - DNA, 1202 bp, Triticum aestivum
tcactcccactgaagcagcggcggaagaagaagaagctagaggacatgggggcgcagagagctctcctcgcgagcttcctgctcgccgcgttggtcacccaggccttcgtctccgtctcggccaggaccggcccaacggacaaggcaagccaagatgacgtgaagaagccggactgcgtgccgtcgctcgacccgcacaatttccccggccacgggggcaccaccgtgccgcttccctcgcacgggggctcctccggcacgcccccctaccacggaggttccggcacgacgccgtcgcacggcggctccggctcgactccgtcgcacagcggctctgggtcgttgcctgacccgtcgcatggcggatacgggacgccgccttcgcacgggggctctggttcgttgcctgacccgtcgcacagcggaggttacgggtccactccggatgcgccgtcacacggcgaaggcgcgtacgggagctccccgacgccttccactggcggtgcctacggcagctcacccacgccgtcccacgacggaggcgcctacgggagctccccgacgccggcccacgacggaggctcctacagcggaactccggctgcaccgtcgcacagcagccacgggtctgtgacaccgacgccgctcatcccagtcgaccccaacagcctcgggacatgcgactactggaggacgcaccccatgcagatctggtcggcgctggggagctggccgagctcagtgagccacttcttcggcgccgccggtggcgcggtcgccggcgggccgagcatgagcatccaggacgcgctggcgaacacgaggaccgacggcgccggtgcgctgctgcgcgagggcaccgccgcgctgctcaactccatgacccgtccggggttcgcctacaccacccagcaggtgagggacgcgttcgcggcggccgcggccggcggcgtagacagcgccgcggcggcgcaggcggcctcgttcaagaaagccaacgaggggaggaaggcgtagatcgaccggatcgccatggagagggctttagctagctggctacctatatttgtggcatgtctgcatgcatgcgtttaggccggacggacgtgtgcgttttgatgtgcgttttgatttggttgtttcgtttgagttcatggtttggttgtgtacgttggtgtcttcgtgggctagcttcgatctat

SEQ ID NO: 336 - DNA, 1715 bp, Triticum aestivum
caggtgtctctctctgggctcccggcatcggcggcgggcgggcattgggagggagctcacggccccggcggcgggcggcggagtgggcgggcgcgggagcaagggagggagctctccggcggccatgccgcgatccggggcgtgatcccgccggggattgctggcccgggagcgccgcggcgatgaacgggccgagcgccggcgccggctccggcggcgaggggccgctggtgtaccaggcctggaaagggaacaatgtatttttcctccaggggaggtttatatttggacctgatgcgagatccttgtttgtcaccatgttcctcattatcgctccagtaacagtcttctgtgtgttcgtcgcgaaagaattgatgaatagcttctcttatggcctggggttaccggtgatggttgtggcagttgtattcacggcatatgatttgagtcttctatttctcacttctgggagggatccaggaatcatacctcgaaatgcacatcctccagaacctgaaggttttgaaggcaatgctgaagttggagctaaccagactccaccattgcgtttgccccgagtgaaggatgttgttgtgaatggaatcactgtgaagacaaagtactgtgacacctgtatgctgtaccggcctcctcgatgctcccattgctctatctgcaacaactgtgtcgagcgatttgaccatcactgcccatgggttgggcagtgcataggacttcggaattacaggttcttttatatgttcgtcttctcgacgactcttctctgcctctatgtctttggattctcctgggtgtacattattaagatcagagatgcggagcagataacaatatggaaggcaatggcaaagacccctgcgtctattgctctggttgtctatacgtttatcgcggtttggtttgttggtggcctctcagtgtttcacttgtatctcatgagcactaaccagacaacatatgagaacttcaggtatcgctatgaccaacgggccaacccatacaacagaggagtcgtggagaacatcaaggagatcttcttcacgccgatccctgcttccaggaacaacttcggcgccagagttccacaggagcagggcctgaggcctcgctcgacgaacggtttcatgagcccaaacatggggagagctgttggcgacatcgagatgggcagaaagccggtggcatgggatgagcccaggatggcagcagagataggcgacctgggcggtctgggcaacttgctggaggacaaggatggcaggttccgcaacgcatcaccagatctaagccgtgacgccctcgtggtcggaggcttggatgagcaaggctcctcggtgatgaacccaccacggacgagctggggagtcgaagcgggcaggtgatggtaactggccaatgtggccatgtaagcagctatagtggaggactaaggggtgtatgttagtgccagcttgttcgtagtttggtgtccggttgagactcggggtcgctgatgttgttattaggcctatgacctgttgttgttttgctttgcattcatgtatcagtggtttttaagcagattgttggtgtgtgaggtctccagttcagtagaatcttaattgtgtctgtatatagtttggagtggtgaacccggaaatggattggtttgctttggcttccgttgtcaaagattgtgaaacggcattgtacct

SEQ ID NO: 337 - DNA, 760 bp, Solanum lycopersicum
aacaaatatctttggccatcctcaacaatggccatcaccaatcttttatccaccaccattacactcaaacactcgccatttcttctactgaaaccctcaacaaaactcagaaaccctaaaaggccaacaattcgagctcaatctaagaacgacgactcagtagatggtccagatcgtttaatctccgccataacttacttctaccctttctttgatggtgttcagtacggtaaatatgtaatcacacagtttgctccaatacaaacacttattcaacctttagtaccagctataagggtttttaagagctttccgcttaacgggttgttggttttctttacactctactttattgttgtaagaaatcctaattttagtagatatgtcaggttcaacactatgcaagctattgttcttgatgtgcttctcatttttcctgatttgttggagaggagtttcaatccaagtgatgggtttgggttggatttgatgatgagctttgatagtactgtgtttttgtttcttttggtatctttggtttatggtacttcgtcttgcttgttgggtcagctacctagattgcctattgttgctgaagctgctgataggcaagtgctatgaactcgtaattttacttgtttatgaggtttcatcctctttgtacacttaattatgttttgctttagctgacaattaatatctatttcgttccgaaagtaaatgtttatgctctttagagccttgttcatgcatatcattt

SEQ ID NO: 338 - DNA, 1160 bp, Zea mays
aaacggaatcccagatccacccctctccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccacctccttctgcgctccccgaccttccatgccctcctctccccgcatcgcctcgacgccttcttcctcctttccccgcggctcgccgtccacccgctgtcccgccgcgtccgcactatgcccgcgttcgccgcgctctctcctccttcctacccgctcgtctcctccccgtccccatcactccttatcacctgcgcctcactccagttcctcccgccgatccccgacggagcctacctcctatccgctatcgtcccatcgcgcggctcctccacctcctgcacccttgtcgccgtcatcaccggcgcagccgcgcgttcttacaccctggacaccggcgatccctccccgcagtgggcgtctagaggcgatctcccgctgtctctcacgctcctggaaaacgccgcggtctccggtgaccgcagcaaactcttcgtcctcggccgtggccccgaggcgctcttggtttttcatctcgtgacggggacatgggaggtgctgcctgttgtgatgccacaaggtctcactacggcgcacctgtttctttttgatgcaagcctattcttagtaggtggtatggagagctttggagtagtcgatcgggtggtggtctggcggttggacgacgataaggcggaggaggtgtggtggagggaggtgagcgtgatgccaacggaggttttcgatgagttgctagctggtaggtttggcagattctggcattttcaggctgcagacagattggggattgtttgcttgtacaatgctgtggatcggaggctggtcatgtttgatgcggctgatggcatgtggacagtgctgccacgattgtccgcgttggatgcatgcgagagcttcaggtggtttggacatgtcttggagccaggagttgaaatcttgatgggactacgttgacatcccgatgaagatttcatgctaacatcattaaattcataaagctagagttactagaagagctgtatgcaaatccct

SEQ ID NO: 339 - DNA, 1464 bp, Triticum aestivum
aaaggatcccgcacagaatcaaacaatggccacgtccgcaacggcggctcggcacatggtcgctttgccgtacccgggccgcggccacatcaaccccatgctcgccgtgtgccgcctgctcgtcgccgcggacggcgccctcaccgtcaccgtcgtcgtcacagaggagtggcacgggctgctggcctccgccggagtgacccccacgctgccggaccgcgtccgcctcgccaccatccccaacgtcatcccctccgagcacggccgcggggccgaccacggcggcttcatcgagaccgtaaactgcaagatgggggagcccgtcgagcggctgctcgaccggctggcgttggagctggggcggatgccagatgctatcgtggccgacacgtacctgcagtgggcggtggcggccggcgcgcggctcggcgtgccggtgtgctcgctttggacccagccggccacgttcttgttggcgctctgccatttggacctgtggcgaccagcggttgaaggtttcagcgaagaagaactaagccgcaagtcgttggagcaatatgtaccgggcctctcatcagtgaggttgtctgatgtcaagatcttcctcgcttgggaggggccaatcaaaatatcagcggaggtgttcgtcaaagtacgcaaagcgcagtgcgtcctatttacctccttccacgagctcgagcccagttccatgagcaaaatagcagagttacttccctgccccatctatccaatcggccctgcaatcctgcgtgcgccggacaacggggagagcgcccgtgacgaggagcaccggcgctggctggacgcgcagccgcagaactcggtgctgtacgtctcgttcggcagcttcgtcgccatgccgcccaagcagttcgaggagatcgccgtggggctgtgcgacagcgcggtcaggttcttctgggtggcccaggacagggccaccgccggcctgcgggagatgtgcggcgacagggggttggcggtgccgtggtgcgaccagcaggaggtgctgcgccacccgtccgtcggcggcttcctcagccactgcgggtggaactcggtgctcgaagccgtgtgcgctggagtgcccttgattggcttccctgttgtgtgggatcagctggtgaatgcccggatggtcgccgacgaatggaagaccggcatcaacctgaggcagcagaggggaaaggatgggatcgtgagcagggccgcggtctctgatgccgcgaggaagctgatggatttggacagcggcgctggccaggagatgaggagaagggctgcgcagctgcgcgaggcttcccgtggtgcggtcctcgaaggcggctcgtcgcagcgttctctcagcggtttcctggaggatcttgttgaggggaaattggaggtcgctgaaagttctgcgtgaattcttcgtttactccagtcagtgattagggtaccttt

SEQ ID NO: 340 - DNA, 2454 bp, Oryza sativa
tgtttctgagctgctccaagaagcagagctctgtccatggaggaggagcagagcccgaggctcgccgccggcgagccggagcgcaagctcgaggacggagtcaccgacgccgaggaccccgggtgcacgggcaatgcggccatgagctcgctggagcagccgcttctgaagcggagcaacacgctaacggccagccacctcgccatggttggcgccaaggtctcccacatcgagagcctcgactacgaaattatcgagaatgatctgttcaagcacgactggaggaggcgatcgaacgtggaggtgctgcagtacatcttcctcaagtgggccatggcgttcctcgtcggcctcctcaccggcgtcatcgcgtcgctcatcaacctcgccatcgagaacatctccggcctcaagatgctccacatggtgcagctcgtccgcaagaaaagatactgggccggtttcttgtatttcgccggcgtcaacttcggcctgacgttcatcgccgccatgctctgcgtcgtcttcgccccgaccgccgccggccccggcatcccggagatcaaggcctacctcaacggcgtcgacacgcccaacatgttcggcgcgccgcagctcattgtcaagatcatcggtagcatctgcgcggtgtcgtcggggctggatctcgggaaggaagggccactggtgcacatcggcgcgtgcctggcgaacttgctgagccagggcggctccggccggcaccgcctccggttgcggtggctgcgctacttcgacaacgaccgcgaccggcgcgacctgatcacctgcggcgcgtcgtcgggcgtgtgcgcggcgttccgggcgcccgtcggcggcgtgctgttcgcgctggaggaggtggcgacgtggtggcggagcgcgctgctgtggcgcaccttcttcagcacggccaccgtcgtcgtcgtcctccgcgggttcatcgaggtgtgcaggaacgggcggtgcggtctgttcggcgagggcgggctcatcctgttcgacgtcggcgacgtcgccgtccggtaccacgccggcgacctcctcccggtgaccatcgtcggcgtgcttggcggcgtcctcggcgcgctgtacaaccacgtcctccacaaggtgctccgcgtgtacaacctcatcaacgagaagggccgcgccgcgaagctcgccctggcgctcgccgtgtgcgcgctcacgtcggcgctgctgtacgtgacgccgttcgccgtgccgtgcacgccgtgcgacccggcgttcggcggcgcgtgcccgacgctggggaagagcggcaacttcaagcggttcaactgccccgagggccactacaacgacctcgccaccctcctccacgccaccaacgtcgacgcgacgcggaacatcttctccacgggcaccgccggcgagttcaggctcgactcgctgctcatcttcttcgccgtctactgcgtcctgggcctcttcaccttcggcatcgccgtcccctcggggctcttcctccccatcatcctcatgggctccgcctacggccgcgtcacggcgctcgtgctgtcgcggttcgcccgcatcgaccacggcctatacgccgtgctcggcgcggcggcgctcatgtcggggtccatgcggatgaccgtgtcgctcgtcgtcatcttcctcgagctcaccaacaacctcctcctcctcccaatcaccatgttcgtcctcctcatcgccaagaccgtcggcgacgcgttcaaccccagcatctacgagatcatcctcgacctcaagggcctcccgttcctggaggcgaagccggagccgtggatgaaggacctcaccgtcggcgagctcgccgccgccaagccccgcgccgtggcgctccaggtggtggagcgcgtgtccacggtggtggaggcgctccgggcgacgcggcacaacgggttcccggtgctggaccggccgcggcccggggtatcggagctgcacgggctggtgctccggtcgcacctcgtcgccgcgctgaggaagcggtggttcctgccggagaggaggaggacggaggagtgggaggcccgcgagatgttcagctcggcggagctcgcggacaagtgcggcggcgtggacgagctggagatctcgccggaggagatggggatgtacgtggacctccacccgctgacgaacacgacgccgtacaccgtggtggagaccatgtcggtggcgaaggccgtcgtgctgttccgctccgtcgcgctccgccacatgctcatcatgcccaagttccaaggacccgagatatctccaattgtggggatcttgacaaggcaggacctgatagcacacaacatcctcggtgcatttccacaccttgcaagcaagaggaaaacacattgagaggaaccatttttgagagttaatccatctttattgtcttgaagccaaatatcagagtcacctgca

SEQ ID NO: 341 - DNA, 693 bp, Oryza sativa
ccaaagaaagaaaagctcgactcgagctcgccgcgattgaatcgcgcatgggcacggcggcgggcgacgcggcggagcagccaccggctgcgccggaggcgaagagggcggcggctccacggacgctggtgttcacgtacggcacgctgaagaggggcttctccaaccacggcctcctccaggacctggcccgggacggcgacgcctccttcgtgggcgccgccaccaccgcgccgcgcctcccgctcgtctgcgggccctaccgcgtccccttcctcctcaacctccccggcgccggacaccgcgtctccggcgagctctacgccgtcacgccgcgcgggctcgaccgcctcgacgagctggagggcgtctcccgcgcgcactacgagcgcctccccatctccgtcctcctcgccgagggcgcccaggtcgacgccgtcgcctactacgcgcaccgcggctacgccgacgacctgtgggcgcgcagcggcaagaaggggtacccggagtactcgccggccgtcgccgacggctacatccgccgcaaggatcggccgcagcagctcaccttcctggagcagattcgggtgttcgtctcatcgcagtcatcgtagaacccatcaattaatctcttttcttttcttaatctatttttcttctctttgcaatcactcctcctatttgtgcgatagc

SEQ ID NO: 342 - DNA, 1304 bp, Solanum lycopersicum
ccctcgtgtactgtcctctttctgcattgcggctagggtttcacctaaaaaatccctatttttgttgttgtttgtgtactgattttacaactgatttgatggatattcgaatgaactagcggttgacgcggtgggtttcacacatacgaaggtaaaaagggtttttgtagctcttgaaaatggcggatttgaacccctttgatttgcttggtgatgatgataacgatgatccatcgaagctgattgctattcaccagcaaaaagttgatccggcgaagaaagcctcagctccggcgccggcggcggctaagaaacagccggcgaagctccccactaagcctcctccccctactcaagctgtcagggaggcaaaaacagaatctggacgtggtggaggtagaggtggtggacgtggctacagctgtggtcgtggtggaggtgggttcaatagggaaggatccaacaatgagaactttgctcgcaacagagaattttcaggtggtattgctgcgcctgaatacgtggaaggaggaagaccctctgaaagacgcggtggttatggtggaccccgtgctttccgtggtggtagacaaggtggttttggtaatggagaaatgcctgagggggaccggcctcgtaggacatttgaacgccgtagtggtactggacgcggaagtgagataaagcgtgaaggtgctggccgaggaaactggggaactgaagcagatgaagttactctgatgactggtgaagttgctgatgaaggtgagaaaaatctgaatgtggagaaaccctccaccgaagaagaagcaggagttgataagaaggaaaatccagctgctgaagctgcggacaaggagcctgaagataaggagatgacccttgaagagtatgagaagttgctagaagaaaaacggaaggctttgcaggcgcttaagactgaggaaaggaaggtcgacaccaaagtatttgaatccatgcaacagatttcaaagaaatccagtgatgaaatctttgtcaaattgggctccaaggataagagaaaagagtctgctgagaaggaagaaaaggcaaagaaggcggtcagcattaatgagtttttgaagcctgctgagggtgagaggtattatgcacctggtggtcgaggtcgagggcgtggccgcggttctagaggttacagtgaagccaacacgatgagcaatgtggaagctgctcctcccattgaagacccaggtcacttccctacattgggtggcaagtgatgtgcttttttagtgcttttctaccacgtccaagaggcatag

SEQ ID NO: 343 - DNA, 1637 bp, Zea mays
gtgatagtcttcagcccagctcgctctgcagtcttcgcgtagcaaaaacaatggccacagcggcggcagctcggcacgtggtcgcagtgccgtaccccggccgaggtcacgtcaaccccatgctcgtcgtgtgccgcctgctcgccgccgcggacgctgccttgagcgtgaccgtcgtcgtcacagaggagtggcacgcgctgctggccgcagcgggggtgcccggcacgctccccgaccgcgtccgcctcgccaccatccccaacgtcatcccctccgagagggtccgcggcgccgacttcgcaggcttcgtcgaggccgtgcatatcaagatggtggcgcccgtcgagcggctgctggaccggctgtccctggagcggaagccggacgccatcgtggccgacaccttcctggcttggggcgttggggttggatctgcgcgggggataccggtgtgctcgctgtggacgcaaccggccacgttcttcttggcgctctggcacctggaccgttggccgccggtggatggtcatcaaggggaagaaggcctaagctgcaggtccctggatcaatatctcccgttcccagccctcgcgccggtaaaatgttctgatatgaagaccctccgctccatggtgctgccaatgaaacggctagcgcaggtgttctccaacctgcgcaaggcacagtgtgtcctcttcacctccttctacgagctcgaaaccggcgccatcgatggaacatcgcaagtggttccatgccctatatatgcagttggcccttcaattccatatatgccactggaaggtgattcgggcgagtttcaccatgaagaagactacttcggttggctggatgcccagccaagaagctcggtactgtacgtctcatttggcacccatgtctcgatgccttcgtctcagctggaagaggtcgccctggggttgcatgaaagcacggttaggttcttctgggtggcccgggacagagctagcaccgccacccttgagcagatctctgctggtggcaagggcttggtggtgccgtggtgtgaccaactgaaggtcctgtgccacccctccgtcggtggcttcctgagccattgtgggtggaactcgaccctggaggccgtgttcgctggagtgccgatgcttgcctttcccgttgcttgggatcagctggtgattggccatctcgtggctgatgagtggaagatcggcgtcgacttgagggaacggagaagggaggatggtgttgtcggaagggccgcgatctgcgatactgtaacgaagcttatggatttgactgacgatgatagcctagagatgagaagaagggctgcggagctgagagaggcttcacgccgcgcagttcaggaaggtggatcttctcggtgttctttgaacagtttcgttagagatgtcatcgaaggaagactgaatgttgcagaaacttcacggtaggtttttgcttgaatttgtagtttcagggggacagaactgttgctcgtaggcagaaacgttgtgctcctgcaagtaaaggtacgtggctcctatcatgttcacgcatattcaccgccaccccactcgcaacaattattactggcttgaaatcacgattgccacagtacaggagta

SEQ ID NO: 344 - DNA, 697 bp, Sorghum bicolor
atcagatcgatccgcaccgccaccggccgcaggcaatcatctatgggcgcggccggcgaccccgctcccctggtgttcacgtacgggacgctgaagcgcggcttctccaaccaccgcctcctggaggagctgtccgcgagcggggacgccacgctggtgggtcccgcggtgacgtcggcgcggctgccgctggtgtgcggtccctaccgggtgccgttcctgctcaacctcccggtcccggctgtcgccgccgcgcaccgcgtgcgcggggaggcgtacgcggtgacgccacgcgggctggcgcggctggacgagctggaaggcgtcgcgacgggccactacgagcggctgcccgtgcaagtcgaggtcgaggtcgagggcgagggcgagggcgggacgagggtggtggaggcgatcgcctacttcgcgcaccggagctacgcgggcgacctgtggcggcggagcggggaggagggcgtacccgagtacacccacggcgtggcggcggggtatgtccggcgcaaggaccggccccaagggcagacgttcctggaccagatccgggtcttcgtatcctcctaagcttgcggatcattgatttgtgttttggttttggatggatccatcgatgtgtgatcacatcaatcaggatctactatcgatcatctccctcccttcccttgatcttgatgtatgc

SEQ ID NO: 345 - DNA, 1051 bp, Sorghum bicolor
atcggtagcaaaggcaacgcgcgcaacgcaaccgtgtcctcgtacggcagcagccggagagagagagaaatgggcgaccacgagggtcgcggggacgattttgagaagaaggccgatcagaagctctccggatggggcctcttcggcaacaagtacgaggaagccgccgacctcctcgacagggccggcaacttcttcaaactcgcgaagaactggagcagagcagcttcggtatacaaaaagattgcagattgtcatttgcagggagatagcaagcatgaggctgcctctgcttatgttgaggcagcaaactgctacaaaaagttctcaccacaagatgctgcacaagcacttaacaatgccgttaatcttttcctggaaatcggtagactgaacatggctgcaagatacagcaaggatatcggtgatatctatcagcaagaacaagatttagagaatgctgcagtctacctgaatcgagctgctgatctttttgatagtgagggacagtcctctcaggcaaacagcatgacacagaaaattgcagaaatatatgctcagctggaaaagtaccagaaagcaaccgagctctttgaagaaattgctcgtaaatcaataaacaataaccttctcaagtatggtgtcagaggcattttacttaatgcgggcctttgccaactatgtagaggcgatactgttgctataaataattcattggagcgctatcaggacattgacccaaccttctcggggacacgtgaatacaagcttttggcggaccttgcagcctctatggatgaaggagacgttgacaagtttactgatgctgtaaaggaatttgacagcatgacacgcctggatccttggaaaacaagtctccttctaaaggcaaagaatgagttgaagaaaaaggatgaggatgaggatgatctaacctaggctttgttctacaaaaggttccatgatttcattgaggatgccgtgaagtctttacacaagattgtttgacatatgtatggatatacaaaacctccttgataaatgctttccc

SEQ ID NO: 346 - DNA, 3065 bp, Triticum aestivum
aaaggatccggcaagtgatcgagtcaggcgcccaccgttgttgctgctccgtccgtcgtggactggcccgtggatagagaatggacgcggcgacgcggcgggcgcggctgctcctgctgctcgtggcggccaccgtgccggcggggctctgccagaccaacccggacgatgccgcggcgctccggtcggtgatgggcgcgtggaccaactacccgtcgagctggaactccggcgacccctgcggcgcgccgtgggacgggatcatgtgcagcggcaacgggagggtgacatcgctgcggctatccagcgccaacatgcagggcacgctcagcgacagcatcgggcagctcggccagctcatgttccttgacctttcgttcaacggcggtctcagtggtacgatccccgcttcgattgggaaccttgggaagcttacgacactaatcttggctggttgcagcttcagcggagacattcctaaagaactaggcaacctcctgcagatgacattcctggcgctgaattcaaacaagttgacgggcacaataccgcctcagcttggcctactctcaaaactcttctggctagacctggcagataatgccatcacaggaagtgtccctatctcaacaggaacgacaccgggccttgaccttcttaccaacacgaagcacttccatttcaacaagaaccagctatccggaacgcttacaggcctcttcaagtctaatatgaccctcatacacatattgtttgatagcaatcagttcacaggcccaattccgcgtgagcttggaagcattacctcgctccaagtactccgactggataggaaccaatttgcgggagcagttcctaacatcaccaacttggtcaacctaaatgagctgaacttggcaaccaacaagctaactggatcagtgccaaatctcagcagcatgaacgtgttaaatgttgtggatttaagcagcaacagctttaccgcgtcagcaatcccagcctggttcacaaatctaacaaatatttcttcaatatcgatgtcttctgcgagcctcactggcgaggtcccccaggaactcttcaatttgccccagctgcatgaagttctactgagcaaaaaccagctgagcggaacacttaagatggcggccggcatcagcgcacaactgcaaactgttgatctcgaacaaaacagcatagttgatatcgctggcacttcaaactacaaaaagacactgctgcttgcccagaatccagtgtgcgccgatacatctatacagttctgcagcgcccagcgacagaacgtggtaccatacagcactagcatggccaaatgtaacacggcacgtgggtgccaaagtggtcaggaccagaaccccgcaaactgcggctgcgcctattcgtacaatgggaagatggtcttcagagcgccgtccttcaaggatgtgtcgagcaccgctaactttcagcaactggaggaaaccctctggaggctactgggtctgcgtgaaggcgcagttttcctgaaccgtatcctcttcaacgaggacaactacctccaagttcaagtgagtctgttcccgtcgacggggacgctcttcaacgtgtctgaagtgagccgcatcgggtttcttctcagcaaccagacctacaagccgccgccaatattcgggccttacttcttcattgcagatccatatgtcccctttatagttgctggtggcaagaaatcgaagttcagtacagctgctgttgctggaatcgcagtggccggtggggttcttgtgattgccctcattttggtgggactgttcgctttgcgacagaagagaaggaacaaggaactaaaagaacgaagcaccgacccttttgcttcgtggggcgcggcgcagaaagacagcggaggagctccacagctgaaaggagcgaggttcttctccttcgaggagctgaaaagctgcacggacaactttgcagatagccatgagataggcgcaggaggctatggaaaggtgtacaagggaacacttgtggacggaatacgggtggcgataaagcgggcgcagtccgggtcgatgcagggcgcgccggagttcaagaacgagatcgagctgctgtcccgggttcaccacaggaacctggtgagcctgatcggcttctgcttccagcaaggggagcagatgctggtttacgagttcgtcgccggtgggacactgagggagaaccttgttgttagagggacgtacttgggctggaagaagaggctgaggatcgcgctcgggtcggcgaggggtctggcgtaccttcacgagctcgccgacccgccgatcatccaccgcgacatcaagtccaccaacatcctcctcgacgagaacctcaaggccaaggtcgccgacttcgggctctccaagctcgtcgccgacaccgagaagggccacgtctccacccaagtcaaaggaacattgggatatttggacccggagtactacatgacgcagcagctgtcggagaagagcgacgtgtacagcttcggggtggtgatgctggagctggtgagcgggaggcagccgatcgagaaggggaagtacgtggtgcgggaggtgaggcaggccatcgacccggccgaccgcgactactacggcctgcgcgccatcgtcgacccggcgatccgggacgccgcgcggacgcccgggttccggcggttcgtgcagctggcgatgcagtgcgtggacgagtccgcggcggcgcggcccaccatgggcaccgtcgtcaaggaggtggaggccatgctgctgaacgagcccgacggggaggggtccaactcggccgggtcgtcggccactgagttcgacggcgccggcaggggcgcgccctcgcacccgtacagcgacgtggagatcacccggtcgtcctacggcggcgccggggaggcgtccgattacatgccctacttcgaggtcaagccaaaataatagacacattgtacattcatttttggggtatagaaagtgtacattttgttccttctcgtgtcagcttgtgagttgtgacgatgaggtaccttt

SEQ ID NO: 347 - DNA, 445 bp, Sorghum bicolor
atctcaccgatcgcatccgcctctccacacgcatctccctctccaccttgccagcatccgcgcgcgcgcgcatctctccacgccatggacgggtcggcgttcctgtcgctgtcgccggagctccgcgacgcgctcgccaaggtggccgtgttcgtgctcgtccaggggctggtctacctcatcctccgcagctcctccgacgtcttctccaaggacggcggcgggctcaggtccctcagcttccgccccatgcgctccatgagcgtcaggcgcgtgctggctccgctctctgacgtccccgtcggcaccgacgagccctcgccttcgccgtcgtggtccatgtcgcccgccgcgtcgtcgtcgcgccgcagggctgcccgcgaggattgaaatggccgcaacttctgggtctgggcaccttggaatcggaggtagtttatttggt

SEQ ID NO: 348 - DNA, 2639 bp, Arabidopsis thaliana
caggcatgaacacttattccccactccaactcataccgacgcctattcatctcaaatcctcacgcgccgcctcaccgtcatcattacgcgtcgcttctccgttaattatacgcgccgcctcctcagacgactcacagtcagtcgaaaaccaaactctagaagtcctcgaatggcgtgccctctgcaatcagctctctccgttcgcttccacaaccatgggcctttccgccaccaaaaacgccgaaattccggtgggaaactcgccggaagaaagcaggaatctccttaacgagacctcagctgcaatagctgctatggagatgatgaaatcgcgaggattaggtctttctgaaatccaagacttgtctgatatcgttgagcgtgctgtgtccggtcaattgcttaccgttagagaactctgtaccgttcgaagcacgttaacggctgctacatcaacgtttcagaaactccgaaaagcagccattagtgataacagggttactccacttgtagatatactacagggttgtgatttcaaggatacattacagcagaagattagtttttgtatagactgcaacatgactatgattcttgatagagctagtgaagatttagagattataagatctgaacggaggagaaacatggagaatttggattctcttttgaagaaaatatcaactaagatttttctagctggggggattaacaagcctttgataacgcagaggagatcaaggatgtgtgtagctattagagctacacacaaaagtttacttccaggtggtgttgttttaagtgttagtagctctagggcaacatgctttatagaaccgaaagaggcagtggagcttaataatatggaagtgagacatgcgaactccgagaaagctgaggaaatggcgattttgagcattttgacatctgaggtggtgatggcgcagagagagatattgcatttgttggatagaatattagaacttgacattgcttttgcaagagcatcacatgcaaattggattaatggtgtctatcccaacgtaacttcagaacacacaaaaacactgggcttagctgtagacattgattctgcgcagcacccgctacttcttggttcagtattaggcagcccaaatggtggagacattttccctgtgccagtagacattaaagttgaaagcagtgccaaagtagtcgtcatctcgggtccaaacacaggaggaaagaccgctttgttaaagacattgggattattgtctcttatgtccaagtccgggatgtatttgcctgctaagaactgcccaaggttgccttggtttgatcttattctggctgacattggagatcctcagtctttggagcaaagtctttcaacctttagtggccacatctcacggatacgacagatacttgacattgcttcagaaaattcacttgtcttactagacgaaatatgtagtggaactgatccttcagaaggggttgcacttgctactagcatcctacagtatattaaaaaccgtgttaatgtggcagttgtatcaacacattacggtgacttaagtcgcttgaaggataatgagcctcgattccaaaatgctgcaatggagttctccatggaaactttgcagcctacatttcgagtactctggggaagtactggtctatcaaatgcattgagagtagctaagtccattggtttcaataaaagaatattagagaatgcgcataagtggacggagaaattgaatcccgagcaggatgtagagcggaaaggctcactctttcagtcccttatggaagaaagaaataagctaaagcttcaggcaactaagactgcagcttttcatagagacttaatgaacctttaccacgagcttgagcatgagtcgcatgatcttgaaaaacgtgagagggctcttctgaagaaagaaacgcaaaaggtgcaagaagatctaaactctgctaagtcaaagatggagagactggtggctgaatttgaaagtcaactagaaatcactcaagctgatcaatacaattccttaattctgaaaaccgaagaggcagttgcagagattattgaagcttgctgtcctatggatcctgattccttagaagaagaatacagtgactactcaccacaagctggtgaaaaagttcttgtaactggactgggagataagttaggtactgtggttgaagaacctggagatgatgatgatacagttctagtccagcatggtaagataagagtacgcataaagaaaaaggacataaagccccttcctcgtagcacaagtagccaaacatccaatcgttctctacgttcgaagagacagataaacatgaaagagctaggcagtgtgttgcagatgcaaagcgaaccagtgcggattcaaacgtcaaagaacacattggatctaagaggaatgcgggcggaagaagcggttcaccagctagacatggccatctcgggaagagactcgggctcgatcctatttattattcatggaatgggggcaggcattataaaggagctagtgcttgagaggttaagaaagaacactcgtgtctcaaggtatgaacaggcaaatcctatgaaccatggatgtacagttgcttacattaaatgatga

SEQ ID NO: 349 - DNA, 2009 bp, Solanum lycopersicum
aaccattgaattccaagaatgtagatatacataacaccacaaaacacacacaaaaaaaaaaaaaacactagtaaattttttttctttcatttttcactaatggcaagtgctactacatcatcatcaacaaataaaattcaagaatatgatgaggttacaagttacaaaaacaagaattgtgaagtttttgttaatagacaagaaattaaagatgcaattgctaaagcaattgaattaagagctttacatgctgcccttttacaacaacaacaagggaatagtcctatgaagaagttcccttcttctgcttctccaactctttcacttcattctcaccatttttcttctcaagattatcctattttcacaccaagctatgaagatgaaccattgccaggatacaaacaactacacttagatcacaatccaaactatgctgaagtttgggatgaatatggagtagtaaatggtaacaatgaatccgttttatcggattacagaaaggcgaattcgaccttcaaaaatggatttactaacagtctgatcaacttagaaccccacatgtgtccagctgatgatcagagatcggtcacgagctcgtgtactgatcatgtcactacgcgtaaagcctctcccatcgctcgttacatcaagtctcggagaaactcattaggggacttgaactctatctcatcttgcaacaagtgtaagcctgcaacaattagtactgaggttgatggtggtggtagtagtactagcaagagtggtaagaactcgaatgtcatcgtgccattgacggactcacatgtttctgttcaatcgcagccaaagagtaaaggcgggatgaacttgtcgtggctgttccctaagctaaagaagaaaaacaaggttgagatttcaccaaaccgaacagatcaatccgatgaggttttaaaggatcaccatatagggatggtttcaatcgagacgttgaagaaagagctaatggaagcaaacgagagcagagatgcagcgttgattgaagtctcgggaatgaagtcgtctttaggtgagctaaagcaaaagttagagtacttagaaacttactgtgaagagctgaaaaaggccttaaggcaagcaattcaagctacagagtcccctgtatcctccaacaagctaagaacttttcctaatggaaaatccatcgatggggacggagaaaatgtgatcccggttaatgatgaggtaatgctagaagggttcttacagatggtatcggagtcaagattatcggtgaaacagttcagcaagactctaataggacagattgaagcaacagacaatttgttaaccgataacttgaaccttttgcttcaaccttacaagctatctctcaactcgaagtactcgaaagcagtactataccacattgaatccatcataaaccaatcactttttcaagacttcgaaaactgtgtgttccaaaagaatggctcagcaaaacacttagaccctcaacaagatcgccacgctcagttctcatcatttgtcgcgctgaggaacctaagttggaacgaggtgttgaggaaaggtacaaagtactatagtgaagagttcagtaagttctgtgatcagaaaatgagttgcattatcgcaacgcttaattggacaagaccatggcctgaacaactcctccaagcgttcttcgttgctgctaagtgcatctggttgctgcatttgttagccttttcgttcaatccttccctcgggattctacgagtggaagagaatagaactttcgatatgcattacatggaggacgtcttcgcggataggcaaagatcacaaggtcctagcaaggttaaggtcatggttatgcctggtttttatgtgcatgatagagtacttaggtgtaaggttatatgcaggtacaaaaatgtatcatagttagggtttctcttttctcatttttcttgtttagtaatctaacttgtaatagtgttctcttgttgattatttgatttgagtga

SEQ ID NO: 350 - DNA, 719 bp, Solanum lycopersicum
tgttaagggttgttatcaagatttggaaaaaaatggctggtggtggagcatcgagtaaggcttcaaatggtggtcctactagggtgaggaagagggttgaagttgaatctgctgcttctgctgctagtcttaagcgtgctaaggatggaagtgcttttgctcgttgtgaagaatgcagcaaggatgtgcctatagcattgattagcttccacaattgcagtcttgatgcaaaaatcaagatgaatttggaggctcaagttgtggaaaatcagactgaagtgaagaaaccagcagcaaagagcaaggagaaatcaacagagccaaaggctaagagggaaaagaaacccaagaatcctaatgctccgaaacgccctcctagtgctttcttcgtgttcatgaatgattttcgacaggaatttaaggctgcaaatcctgattgcaagagtgtctccatggttgctaaggagggtggtgagaaatggaagtccatgactgatgaggagaaaaaaccatatcaggaaaaggctgcagagctcaaagcagcatatgagaaagccttgaagtctaacactgatgctgataattccaatgatgacgatgaggagcctgagaaggaagtaaaggaagagatagcagtagatgaggaagcgaaggaagagatagaagtagatgaggaatagagctgttagtttttgaactggtgtagcaaccatcttcaa

SEQ ID NO: 351 - DNA, 1660 bp, Oryza sativa
aaaggatccaaacgaccacctcacctcacgaaaccggcaatggcggccgccggagcatcggctctccggccacacctcgcccttctccccgccggcggcggtggaggcggaggcggcggaacccgtagctatgccctccaagcgctatccttcgtctcgcccctcctccctcattgcggccgacgacgccgctgcgtgctccgctccaaggcctcttcgtctccgtctcccccgccatcgccggggaaggaggcggtggctgtcccgacggcggagtcgtgcgtcaacctgggactcgagctcttctccaagggcagggtgaaggatgctcttgaacaatttgagaatgccctagagctgaatccaaatcctgttgaagcccaagcagcactatacaataaagcatgctgccatgcatttagggaagaaagcaacaaagctgcagattgcttaaggacagctctgcgagattataatctcaagtttggtactatacttaatgatcctgacttggcaccgttcagggcatcaccggaattcaaggaacttcaagaagaggcattgcgtggtggagaagatattggttctgggttccgaagagacctgaaactcattagtgaagtacaagcaccatttcgtggtgtccgaaggttcttttatgtggcgttaactgcagcagctggaatttcaacattctttaccattcctagacttatacttgcagttcaaggtggcgatggtgcccctgatctgctggaaactgttgggaatgctgccatcaatattggaggtattgttgtgctcgtggctttgtatttctgggaaaacaagaaagaagagcagcagatcacacaaatttctcgcaatgaaaccctttcaaggttacctgtccgcctgtcaaccaatcgcattattgagcttgtgcaactccgggacattactaggccagttatactggcaggttcaaaagcatccattactcgagcaatgcaaagagctgagagatatcggactgaactgctgaaacgaggtgttcttctaattcctgtgatctttggtgcttctcagaaagcccaaagtaagccaagaggctttggaagttcaagatctgctgcatcagctccttcagttggggatgactttgagaagcgtactgaatctattgcagcgaaatcacggttaaaagctgaagagcgatttaaggctgatattgtctctcctgaacaatgggaaagttggatacgtgaccagcaagagtctgaaggtgtcactcccggtgaagatgtctatataatcctccgattggatggtcgtgtcagaagatctggaagaggcatgccaaattggaacgacatattgcaggaacttccacgacttgaagaactgctgagcaaacttgaacgttgatgaaggtgtgtatacaactgcagtttgatcatccatatgtttctccattgtattattaattccctaatctatgtatagaccataccaatgtaattttgagggaaaattttgtttatgccactaatatatgaattcccaacttctgacgtactccactagttactgtgtgacttctcgtttatgtcactactatcaagccacataccattttttttcctgttttgctcccattctgtcaatttggggtaccttt

SEQ ID NO: 352 - DNA, 2205 bp, Oryza sativa
cagcgtagcactattccattcccttcatgctggttagcttctcccccttgttcgatgcctccggatccctaacgcttgcttctcccatgccactccactcccacctcctccttctcctgctggctctctccacgtcggtggttgctggctctgtctcctcctccccctcggtttgtgccggcggcggtggcggtggcggcgacgcggccatcgtcgcggcggcgttccggggcgtgcgcaacttccagctgcctccatgcggggctgtgcgggagctgcggctcccgtcgcggaacctcacgggcgccgtggcgtgggcggcgctcgccaacctgtcgggcctcgccgtgctcgacctgtccgggaacgcgctccagggcgccatccccggggggttctggcgcgcgccgtcgctccggcacgtcgatgtctccgggaaccagctgggtggggctctccgggtggtggaggctagcccgcggctcgagtcgctcaacgtgtccggcaaccggttcaccggcgtcgctggggcggaggcgctcgccgggctccgcgtcctcgacgtgtcggcgaacaggatccgggcggtgccgcaggggctgaggcggctggcgcgggtgaaccggctcgacctgtcgcggaacgcgatgcaggggaggttccccggcgacctcccgccgctcgccgggctccgtttcttgaacgtctcgtacaacaacttctccggcgtggtggacggcggcgccgtcaagaagttcgggcattctgctttcgtccactccggaaacacttcgctggtgttctccgagaactcgacggcgcggcggcctccaccgccgccttcgccgccgccatcgcatccacatagaagtggcggaaagaatgataccgcgacgccggcgaggaggacgcggacgaggagcaggaggaagcatttgagcgtcgtcacggttgcggtggtgtgcggggtggtgtccgtggccatgctgctctgtctcgtcgggtgcgtggcgtgcggggtgctgcgttgccgcaagaacagggggaaggaggcggaggaggagaagaggaaggcgcattggggcgggaaggacgaggaggaggtggtggccgtggcggcggcggcggcgaaggggggttctgctgcgccggtggtgctgttcgagcggccgctgatggagctcacgctggccgacctggccgaggccacgtccgggttcgggcgcgagtcgcagctcgcggagcgcggcggccgcagcggcgccgcgtaccgcgccgtgctcccgggcgacatgcacgtcgtcgtccgcgtcgtggacggcgccatggccgtcggcgaggacgacgaccccgcgaccgcggcgaccgcgttccgcgacctcgcacgtctccggcaccccaatattctcccgctccttggctactgcattgcagggaaggagaagctcctgctgtacgagtacatggagaaaggcgacctccaccggtggctgcacgagcttccagcagggcggcccgacatggaggacgacaccggcggtgacatctgggaggtggcggaggacaagcggtccatctccgactggccgacccggcaccgcatcgcgctagggatcgcccgagggctcgcgttcctgcaccaagggtgggcagggtcgggtcggccggtcgtgcacggtcatctggtcccaaccaacatcctcctcggcgaagacctagagcctcggatatccgacttcggccaccctagcgacacgacgccagagggggatgtgtacagcttcggcgtgctggtgctcgagctcataaccggccaagccggctgggacgaagcgtcagttagctgggcgcgggggatcatccgcgaccagaagggtctagacatcgtggacccgagagtgcgggacgaggcgggcggcgggccggagacgtcgacggtggagcgggagatggtggagtgcctgcgggtggggtacctctgcaccgcgcagtcgccggagaagaggccgacgatgcagcaggtggtgggggtgctcaaggacatccgggtggcacctgccagcagctcatccacttgacggtggtggagcagcgccatcgtgtgtgtccgtcgcaattgggacccgccgtcgcctgagaagagatcccagtgtggcagcctttcctgatctggtagacaagccttggtggtcggtagtagaaaca

SEQ ID NO: 353 - DNA, 2026 bp, Sorghum bicolor
gctagcccgctactacccagaaagatggcggcggcgatggccaggcgtgccgctggccttctccctctcctcctcctctcttcgcggtccggtgctcgcatagccctccaccgggcggtatcccagatccctccgcctcgctcctatcgcctactctcgcagcaagccaatccctccccatcctcatcattctccgcctccgcatccgcatcgaatggcacggctgcagagagaacccgggagctgcatctgtacaacacaaagtcgcggaaaaaggagcagtttcggccgcgtgatccaggcggggaggtcggcatgtacgtctgcggcgtcactccctacgacgacagtcacatcggccatgcccgcgcatacgtagcctttgacgtcctctacaggtacttgcgctatttggactatgaagttcgctatgttcggaacttcaccgacattgatgacaagataattgcaagagcaaatcagctgggggaagatccttttagcttaagcaaaaggttctctgatgacttcctgtcagtcatggccaatcttcaatgtttaccaccatctgtggagccccgtgtttcagatcatattcatgagattataaatatgattaaacagatccttgataatagttgcgcatatgtagtgggtggggatgtttatttctctgtagaaaattttcctgagtacggagaattgtctggtcggaaactagatgataatagagctggtgaaagggttgctgttgatgagaggaagagaaatccagctgattttgctctatggaaggccgcaaaagatggggagccatggtgggatagcccgtggggcccaggaaggccaggatggcacatcgaatgcagtgccatgagtgcgcattatttgggtcattcttttgacatacatggtggtggggaggatctcatctttccacaccatgagaatgagattgctcagagccgtgcagcatgttgtgacagtaccataaattactggatacacaacggttttgtcaatgtaaatagccaaaagatgtctaaatcacttggtaattttgtcaccatacggaaggttatagagatgtaccatccgctggctttgagaatgttcttacttggcacacactacaggtccccaattaactacacaatagaacaactcaatgttgcatcagacagattgtactacacatatcagaccttgcgtgattgtgaagagagttgtcagcagcaaggaagcaacactggaaattcattgcctcctaataccttaaattacatccaaaaacttcatgatgaatttgagacctcaatgtcagatgatcttcacacttcagtggcattggctgctatttctgagccattgaaagttatgaatgatctgttgcacactcgtaagggaaagaagcaggacaaaaggttggaagctctttctgccttagacgagaaaataagagtagtgctctctgttctaggattgctaccttcaagttatcatgaggctttgcaacagctgcgggataaagcactaagacgagcttccatcactgaggagcttgtgctgcagaagattgaagagaggactgcagcaaggaaggcgaagcagtatgaaaaatccgatgagatccggaaagaattggctgctgttggaattgccctcatggatggccccaacggaacaacttggagaccatctttgcctctttcagaggaagctgtggttgcgaaaacatgatctgcgcacaaaattccagtgcgacccgtggacaccagttctagtcggtaaatcatgggtttgctacatcgtgctactttttgtgacgaagaaaccaacggagttcctgagaaatcatattgtttgcacaattctctgctcccattagagctacaatagttatatgatcatattcggtaaaaaaaagatgtccgattttggttttcactttgcaccgagtccttgcctaacgattgaaatttaacatgacagcctttactacaagttctgtgaatgatattgccga

SEQ ID NO: 354 - DNA, 2774 bp, Oryza sativa
cagccatggcggccgccgccgccgccgccgccgcgaaacccaaccttcttcttccagtctccgtggctatcccctcttctagggtttctcttcccaccggcctcgtatgcagcgcacggtccccgccgccacgcctcagggccgccgccgccgccgccgccgcctcccaggccctaacgtcgcctgtcgcggcggagactccggaggcgaagcagatgcgggtagagacggaggccgccctggaatggggcggcgtgtgcgcgcggctggccgggttcgcctccaccgccgcggggcgcgccgcctgcggagaggggcgggtgcccgtcgggcggagccgggaggagagcgagcggctgctcgaacagacggcggcggccgcgctgctgcctgctccgctggatttcggcggcgtggaggacgtgtccgccgccatcgccgcggcggctggggcccggctgcttgcggtgagggagatatgtggagtcgggcgcagcatccgtgccgcacgcagggtgttcgaccaattgaagacgctctcagaggagacaccagatggaaggagctacactcctcttctggatataatgcaagactgtgacttcttgacagaacttgtgcaacggatagagttttgccttgattatactctttctgtggtccttgatcgggccagcgataaactagcaacaatccgcaaggagaggaggaagaacattgatatgttagaatctctgttgagagatacatccacaaagatcttccagggtggtgggattgatagccctgttgtcactaagcgccgttctaggatgtgtgtcggtgttaaagcttcacacaagcatctggttcctggtggaattgttttgagttccagtggctctggcgcaacatattttatggagccaagggacgccatcaggctgaacaacatggaagtaaagctctcaggtgatgaaagagctgaagaattagcaatattgggtctacttacttcaagcatagctgactccgaaatgaagatcaggcatttgatggggaaaatattggaacttgacctggcttgtgccagaggttcatacgctttatggataaatgctgtgaggccagcctttactgacagggatagtgatactcaactgaatccaaatagtgaatgctcagtttttatcgagggcattcagcatcctttacttcttgaacagtctcttagtatggtaaaagaatcaaccagagtagggaaaggacagctttctgatgaacatcttgtctctccaatgcctattcctctggacatgcaggtgagaaacgatactaggataattgtgatctctggacccaacactggaggcaaaactgccaccatgaagacgttggggttggcctctctgatgtcaaaggctggaatgttcttcccagccaaaggaacccctaggcttccatggttcgatcaagttcttgcagatatcggagatcaccagtcgctggagcatagcctctctaccttcagtgggcacatatcacgtcttcgcaagattgtacaagttgtgtcaaaagattctctggttcttattgatgagatcggcagtggtacggatccgtcagacggtgtagccctttcaacaagcatcttgaagtatcttgctagtaggcttaatctggccattgtgacaactcattatgctgatctaagtcgtctgaaagctgttgacgatcgatttgagaatgctgcaatggaattttgtttggaaactctgcaaccaacatatcagatcttatggggcagtactggtaattcaaatgcattgagtattgccaagtccattggttttgatcagaaagtgcttgctcgtgcacaagaatgggttgagaaacttttgcctgacaaacagaaggaacgccaaggtttactctatggttctttgctagatgaaagaaaactactggagtctcaggcaaatgaagcagcatctgttctttcagacgttgagagactgtacaatgagattcgctctgaagctgatgacctggatagtcgagtagcagctttaagggcaacagagtctgaaaaggtgcaacaagagttaaagtttgtgaagtctcagatggaccaaataatcaagaactttgaatctcaactcaagaattcagaacttgaacagtacaattcactaatgagaaaagcagaagctgccactgcttcattggctgctactcaccagccaactgattttaccttcggtgatgaagaaaatgagagctcatatgttcctgaaatcggagataaagtgtacgttgaggggctgggaggaggaagtatggctagtgttgtcgagacacttggggaggatggtagctgtatggttcagtatggaaaaataaaggtccgtgtcaaaggaaacaagataaagctggtccaaagaggcacgaaggacacgtcagcctcctctcctgtaaaaggaaagggacgaacaccgaagagatcagcagcagaagccaaccaagatggcaatgtctcctttggcccggttgtgcaaacatccaagaacacagtggatcttcggggaatgagagtcgctgaggcatctcatgagcttcagatggcaattgacgggtgcagaagttaccaggtcctgtttgttgtccatggcatgggcactggagctgtcaaggagtgtgcccttggtatactccgaaaccatcctcgagtagccaagttcgaagacgagagccctctcaactacggctgcaccgtcgcctacatcgaataataa

SEQ ID NO: 355 - DNA, 1544 bp, Solanum lycopersicum
gctttcaaagttgaagcaagagagagaggcctatggattactatacacttgtgtttgtgtcaattttagtgttggctaatatcatagcaaaaatatgtagcaaaggaagcaaaaaacttccaccaggtccatcaccatggccaattattggaaaccttcagttgttaggtgcaaaacctcatatatcactagccaatcttgcaaaaaattatggtccaattatgagtttaaagttaggtcaaataacaacaatagtcatttcctcatcaaccattgcaaaacaagtccttaaaactcaagatcaagccttttcatctagatttgctcctaatgctcttcaagcgcacaaccattacaaattttctgtggcatggcttcctgtttgtcctcaatggcgaacgcttcgaagaatattgaacactaacctcttatcttccaataagcttgatgcaaatcaacatctaaggtctcaaaaggtgaaacaattgattgattattgtgacaaatgtagtcaacaaggtgaagctttggatataggtcaagttgttttcaagactagtcttaatttgttgtcaaacacacttttctccaaggatttggctgatcctttttcagattcaaaggtagagttgaaggaagttatatggggtatcatggctgaggtagggaagcctaatttagtagattttttccccatacttgaaaaaattgatcttcaaggaataagacgtcgcgctatcattcattttggtaagttgtttaaactttttgatgatttgatcaacgaacgattggaggaaaagaaaagaccaggattcatggaaaagagcgatgttcttgaaatatttctcaatattactgaaaaaaatcctcaagagattgatcataatcacatcaagtccatgttcatggacctatttggtgcgggtactgatacaaccacaagcacattggaatgggcaatggcagaattgcttaaacaacctgagataataaaaaaagctcaagttgaacttgctgaaatcattgggaaaggaaaattaatagaagaagctgatgtttttcgactcccttacttgcaatgcattatcaaagaaacattaagattgcatccaccggttccgctcttagttccgcgcaaagtagaccaagatgttgaattgtgtgactacatcatcccaaagggctcacaggtactagttaatgtgtgggcgattggtcgagattttactttttggaaggatcctttagagtttaaacctgagagatttttgaatttggatctggacatgcgaggacaagattttgagttgattccatttggtgctggacgaagaatatgccctgggttgccactagcactgagaatgattccattaatgttgggctcactcttgaattcattcaattggaaacttgatgcaggtattgagccacaagaattagacatggaggagaagtttggtattaccttagccaaagctcatcctttgcgagctatcccctctcctctttgatcgatgttgcattgcctagtcgattag

SEQ ID NO: 356 - DNA, 1318 bp, Hordeum vulgare
gagatcgcgaaccatcctcttccgatgtcagacgtcaccgccgagtccacgccgcgccttcgcctgcctacgccgtcgccatcactatcccagcagcagtctcgcggtcgtcagccgccacctcctggctccgaccccctcgctctcggcgtcgtcatcttcatcgccgtctgcttcctcctggtttcaatctcagctccatcaagcattttacatcaagttcccgaaggacatgttggggtatactggagaggaggtgctcttttgaaaaccattactactccaggttatcacctgaagctgcctttcatcacccagtttgagccaatacaggttacactccaaacagaccaggtcaaaggtattccttgtggaacgaaaggtggtgtcatgatcagctttgacaagatagaggttgtcaatcgtcttaataaagactttgtttatgacaccctactcaattatggtgtgcattatgataagacatggatatatgacaaaattcatcatgagataaaccagttctgcagtgctcatagtttgcagcaagtttacattgacatgttcgatcagattgatgagaccatgaaagaagctatccaaagggactgcacgcgctatgctcctggaattgagattatcagtgttcgtgttacaaagccaaacatacctgttagtattaggagaaattttgaacttatggaggaggagcgtacaaaggcgctaattgccatcgaaaggcaaaaggtggcagaaaaggaggcagaaactcagaagaagatcgccctatctgaagcagaaaagaatgcactagtgagcaagatcctcatgcaacagatgctaacggagaaggacagttccaaaaggcagcagcagattgataatgaaatgtttcttgcccgagagagagccctcgcggatgcaaactattacaggattacgaaggaagcagaggctaacaaactaaaacttactcccgagtatcttgagctgaggttcattgaatcaattgccaataacacaaagattttctttggagaaaagattccaaccatgattatggatcaaagattgattcggaatcaccttgattctgctctgagcaaggaccggttagaaatatagtagcatctcttgaaaatttgaaggaacgttggttgttttgtaatcctgtctggaggtttggatttcgttgaagcccttcggagcatgtgaataaaaaaggatgagatactaggactctttaagatttgaagtagctagcctttggaattgccttaatggctttcaagcaaggaccgtttagccttgtggaata

SEQ ID NO: 357 - DNA, 1709 bp, Oryza sativa
acgatctcccgtaccttctctctgcgagatggggaggataaagagtagtagtgggcgatgcagcacggcgaggctggaggcggtcgccgtcctcgtcgtcgtcttcggcgtcgcgtcgtcgtcgctgcgaggatgcattgcgcagcagagcggaggagggctaaccaggggcagcttccccgaggggttcgtcttcggcaccgcctccgccgcgtaccagtacgagggagctgtgaaggaggacgggagagggcagaccatctgggacacgttcgcgcacacctttggaaagatcaccgacttcagcaatgctgatgttgcagttgatcagtaccaccgtttcgaggaggatatacagctcatggcagacatggggatggatgcgtatcggttctcgatagcatggtcaagaatctacccaaatggtgttggtcaagtcaatcaagctggtatcgaccactacaacaagctgatcgatgcacttctagcaaaaggaattcagccatatgtgacactctaccactgggacctcccccaggcccttgaagacaagtacaagggctggcttgacaggcagatagtggacgatttcgcggcgtacgcggagacgtgcttcagggagttcggggacagggtgaagcactggatcacgctcaacgagccgcacacggtggccatccagggctacgacgcagggctccaggcccccggccgctgctccgtgctgctccacctctactgcaaggccggcaactccggcaccgagccctacgtcgtcgcccaccacttcatcctcgcccacgccgccgccgccagcatctacaggacaaaatacaaggcgacgcagaacgggcagcttgggatagcgttcgacgtgatgtggttcgagccgatgtccaacaccacgatcgacatcgaggcggccaagagagcgcaggagtttcagctaggatggtttgctgatccgttcttcttcggcgactacccggcgacgatgagggcgagggtgggggagaggctgccgaggttcacggcggatgaggccgccgtcgtcaagggggcgctggatttcgtcggcataaaccactacaccacctactacacgaggcacaacaacaccaacatcatcgggacattgctcaacaacaccttggcagacaccggcaccgtcagcctcccattcaagaatgggaagccaattggagatagggcaaattcgatatggctgtacattgtgccccgagggatgaggagcctgatgaactatgtcaaggaaaggtacaacagcccaccagtgtacatcactgaaaacgggatggatgacagcaacaacccgttcatttccatcaaggacgccctcaaggacagcaagaggatcaaataccacaatgactacctcaccaatctggctgcttccatcaaggaggacgggtgcgacgtacgtgggtacttcgcgtggtctctgctggacaactgggagtgggcggccggatactcctcgagattcgggctctacttcgtggactacaaggataacctcaagagataccccaagaactcggtgcagtggttcaaggccctcctgaagacctgaactccagctgagaagtagtgctacaatagtttgggcgccatttccatacatccgatagatttattggtctgcacatatacgaatatacgataccctgcatatctcggaaatgttt

SEQ ID NO: 358 - DNA, 898 bp, Sorghum bicolor
tgacctgaggaagaggataaagaacaccccgaaatgccactcctgctgctcccaccagcggcgtgcaccacggcagcgaccgcgccggcgtctctcgcgttctcgcggcctcggtcgtcacgggcgcgttggtccagcctctctttcgcgttcccccgcctgaggaaatacgggcgccgccaacgcgagcccgtggccgcccccagcctcgatgacgacgaggacgaggaggagacaggggcaggggagtgggagtccgacgagggtgaggaagagatggaggtagacgaggaggagtttctggcgacgcggcccaagccggcgggatttggtgaggggaaaacgtattccactgacattgaggagcagcttctccgggagatgggcttcggcggtggcagcgagcggcgtcgaggagaggcggccccggccagtcgccgcgccggggatagttccaccaaagtaatggccgcagatgccagtgacgatggtgttcaagttcgtgtctggaaccttccaaaaaagaaaaacatacacaaggatctgaagcaagcttttaaagggttccgtggccttttatctatagaaccagcagtttccgcaaataagaaaactcgtgatcctatctgtaagggtttcgcatatctcaaactagagtctgcggaagctgcaacaaggttcgttgagatatactctcatcaaactgtgtcatttgggaaggttcagaagccaatcagttgctgtatcgtcgataaaggcagctctgttaagccttcaaaagcatccagtagtcaggcaacccctcaaccaatgttgaagcaccaaaaattggtagcggcgagttaagtaacacatgtatctgtcatctagcacaagtggtcacgcacacttctagagg

SEQ ID NO: 359 - DNA, 824 bp, Sorghum bicolor
aaaggatcccacacatcactcattcagttgccagtcagtttgccaaggccagttgcgcgcgcagagggaggagaggaccggaggagctgcgctgcgctgcgccgcgcagatgtgggcgccggggtcgccggggaggctgccggcgctggaggagtgcgtcgagggcgaggacggggaggcgtaccacggggccatggcctcctgctggggccgcttcggcgccgccgcgctgtggcgcaggctccggcagcgtctcagccttgtgcggcgcatgcggcggcgcggccgctcctccctcctcggcgccggcgggctcaactacgacccgctcagctacgcgcagaacttcgacgacggatgcctggagctggaggagcacgagccggacttcagcgccaggttcgcgcccgcgcgccacgccgccggcttcccgcggcccacggccgcggcgcgcgacgtcgtcgcgaccgcttgacggcgtaccacacgtcctccggcttttacctcccgtaacgctcggtgctcgccgctcgcccgcgcgcctatggaagggctagcggcaaattcctggtaatattgctccacacgtcttttagttgataaatgtacatacatggcacacgccgtcgatcgactcatatgcatcatggatggatgtaattaagtaggttcgttattatagcgtaatcgagctcgctcagacgaaaataaaatttttcttgccgatttgctgtgcattcagccagcggcagcgttcttgaattttttatgtgttcatgtacgcttgtgattcgggcttcggcacagtaattgctggtaccttt

SEQ ID NO: 360 - DNA, 442 bp, Sorghum bicolor
gtccacaagccacaccaacccgcctcaccccattcatcgacgggacgacctcgccggcgagagagagagagagagtgacagatggaggcggcggcagcggcggccggcgtggagctcggctcctcgaagccccagatcgcgacgcaggcggagatggcggaggcccgggtgcccctcgcctaccgcgaccagtgcgcgcacctcctcatcccgctcaacaagtgccgcgtcgccgagttctacctcccctggaagtgcgaacccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctctcctgatccggccccggcccgatccgcttgatttaggtct

SEQ ID NO: 361 - DNA, 1349 bp, Sorghum bicolor
aaaggatcctatcataagcacaatcgcaagctgcatccaggtcgcagctggccaccagcacgtacccacaactcccaagctagcagcggtggttggcacgtcgcagttgatacggaggcgtagccgcgtagctgtactggttctcccgcgtcggcgtcgacggccgtctccctcccgggaagatggtcatggggcgcgcgtccgccgccacggtgctcgtcgcgctcgccgtcctcgctctggcggtgatggcgcaggcgacctgcgacgacgagctgccggctcagcttgccggcaacttctcggggctcgcctgcgcccccgtctggaacaacttcgtgctccggtacgcgcagggcaaggacaacgtgctgcgggtggtgctgtcgaccatgtacagcacaggttgggtggggatggggttctccaagaacggcctcatggtgggctcgagcgccatggtggggtggatgggcaagacaggcgtcccgcacatcaagcccttctcgctggagggcaagaccccctccaaggtggtggcggaccagggcttcctcgcctccagcgaccaccacaagcccaccgtgctcgtgcagcaggccaagatctacctcgccttccagctcagcttcaccgagccgctcaagagccagaacgtgctcttcgccattggctccgccatccccgtcaacgaccacctctccgagcaccaggacaagaccgccatcgtgtttgatttcaccacaggcagcgcttcaagctcatcatccttcccggacggtctgaaaaggacccatggggcgctcaacttgttcgcgtggggtgtgctcctgccaattggtgccattgttgcaaggtactgcaggagatgggaccccctctggttctacctccatgccggtatccagttcgtgggattcatcctgggtctggccggcgttgtggctggagtatcattgtacaacaagatccaagccgacgtcccggcccataggggccttggcatatttgtgcttgtgctaggcattttgcagatcctggcaattttcctgaggcccaataaggactccaagtaccgcaagttctggaactggtaccaccactgggtcggcaggctcgccctcttctttgcagccatcaacattgtgctcgggatcaaggtcggcggcgcaggcaactcttggaagatcggctacggtttcaacctggccatccttctgatcaccatcatcacgctggaagtcctgctctggacaaggtggaaaaacaacagcggttccacgggggcatattagcagcgacttaccgatttatttaggtgttcgtgatggtcactgaaggaattcttt

SEQ ID NO: 362 - DNA, 963 bp, Triticum aestivum
atctcgcggtatcagatctcccagagaaggtgcagaatcatgactcttctcgccacggttggtcagcctcatcctccgtcgaaggtgatctcccgccgcgagcactccaaccgggggcacaagctgacccgggagccgacgggccaggccaagttcaagtgcaacggctgcctcgaggagatcacggggtgcgacagggacacgtgcaagccttgtgacttcgacctccaccaggcctgcaactacaaagaagggaccacgctggagcaccagctgctgcccaagagcaagttcgtgctccgcctcgaggcccccccttccaagcagcgatgcagcgcctgcggcacccgcacgcagggcacccactaccactgcgcacggacgggccattacctccacccgtgctgcgcgatgctgcctatggagatcaagctgagtgatgagctcagcttcgagctccgcgagaaggggtctcgccgctgcgccaagtgcagggaaggaggcggcgtcagggactactggttctactgctccaactccaactccaagaaagtgcacctgcatgtcgcctgcgcgagagaggattttcttctgccgagctcaagcagtaccgagtctcactctgacgtcggcggtaatggcagggcgagcaaggagactgcgttgcggaagtacgggtcggggaagtccgggatgaacctgggcaccataggcgacatcgttaaggccctggcgggcatcgtcctcgcggtgctcactggaaacccgctgccgttgatttctgcaggggtcgatctgctctccagcgtcgccaagttgaaaaagtagctagcagctccatccttgctcatcctacgcacgtacgtacaacttgttggtgacgggctgcatggtgatatatgtgacatcctactatttgtacgatatagtccccgcctgcattgtgtatttgtgatcgcttag

SEQ ID NO: 363 - DNA, 895 bp, Sorghum bicolor
actgccactgccagcccccctccccttcgctcgccatggccatggcgacctccaccttctccccgcgccccgccaccctcaacaagcccctgcgaccgggcgccaagcccgccagcctcctacccttcccgtgccgccgtgccggcagactcgtctgcgccacagcagccggggaggcgccgtccgtcgaggtcgaacaacgggacgaggcggagccggccccagccgcggcctccaacgggtccgccatcaaggccgaggcgcccgccccaaaggccgtgcaggctgaggccccgcccgcggcggtcccgccggccttccgggacgccaggtgggtcaacggcacctgggacctcacccagttcgacaagggcggcgtcgtcgactgggacgccgtcatcgacgccgaggccaggaggaggaaatggcttgaagattatccagaggcgactaacacagacgaggctgtcgtcttcgacacttcaattattccatggtgggcatggatgaagcgattccaccttcctgaagccgagaagctaaatggtcgcgctgccatggttggcttcttcatggcatactttgtggatagcttgacaggcgtgggccttgttgaccaaatgggcaacttcttctgtaaaacgctgctgtttgttgctgtcgctggcgtactgctaatcaggaaaaatgaggacattgaatcactgaagaagcttatcgacgagtctacgttctatgacaagcaatggctggcaacctggcaagatgattccactgggggaccaaagaattagttcagcattgggatacagatgcagaatcgttcttgtgatgtactttacctctttcttcggcctttttgtttcgccgtctcgtgaggcttggaggaacattt

SEQ ID NO: 364 - DNA, 1068 bp, Triticum aestivum
accattgttgtttcttcctccttccgccaatcgatcgtccctctatatcatataatcgtccaagtcaggtctccgcgccgccgcgctgggtggggacgtatcgaaacgatggaggacttcgtgctgagctacgtggtgaccgggctggccttctggtcgacggcgttcctggtgatgcgggcgctgatgccgaagcgctcctacgagttctgcaaccgcgccgtctccaccatgcacgccgtcgccgccgtctgcatggcctgcctctccgtccaggagtggtcgtgccccgtctgccccctcaacgccccctcctcgccgcgccagatgaagtccctggcggtgacgctgtcgtacatgatctacgacgcggcgtgctgccacctcaacggcgacgtgcggctcgacaacaccgtgcaccacctggtgagcatcgtcggcatcggcgccggcctggcctaccagaggtgcggcacggagatgatggcctgcatgttcatcacggagatctccagcccgctgctgcacctcagggagatgctcaaggagctcggcgtcaaggacacggacctcaacctcctcgtcgatattctgtttgcggcgaccttttcggtgggacggatggttggtggaccgtacctcacctacgtgaccttgacaacagactaccccatccttatcaaggcgatggctgcgggtttgcaactggtgagcgcctactggttcttgaggatactcaggatggtcaggtacaagctcgggaagaagaggccggcggcggcggcggccaaggtcaatgccaagtgatacatccatgtacatacacatcttgcttgcaaccttgagcaaattacttgctttctggcgggatgagatccatcgatcgtttgtatgtacaaaacccgccgtgtttgcccgattctggctaagaaaaaaggattgttcatgtagcatatcaattgttccacaggcaagcatcttccgaacaaaggatgcatatatacacactgtagcaattcaactcttgtgcagaaatactttccgagcactaccgcttgcctcctaact

SEQ ID NO: 365 - DNA, 1241 bp, Sorghum bicolor
aaatcctgcgaagcgagcgcgacgacatcataatggggcagagccagggcagaggaagaaccaaaccagagacgcggcacgcgacgcgggagggcgaggaggaagaggagcagcatcagcagcgcggcgacatcgcgaggccagacgcaacagccgaagagaaggggcagagtcgaccgccgggagtcccggccaccaccatggacaccttcttcctatcgcacggctcgcccacgctctccatcgacgacaagatcccggcgcggcacttcttcaagtcgtgggtgccggcgaaggtcgcgggcgaccaggcaccgcgcgccatcctcgtcgtgtcggggcactgggagacggccacgccggcggtcaacgtcatccgaggcagcaacgacaccatctacgacttctatggctttcccaagcccatgtaccagctcaagtacccggctcctggcgccccggacttggccctgcggaccaaggagctcctggagcaagccgggttcggccccgtgaaggaggaccacagccgcgggctggaccacggcgcgtgggtgccgctgatgctcatgtacccggacgccaacatccccgtgtgccagctatcggtacagagcgaccgcgacggcacgtaccactacaacctcggcaaggcgctggcgccgctgcgggaggaaggcatcctcatcgtcggctccggcagcgccacccacaacctgcgcaagatgggcccgttcgacgcgcccgtgccgcggtgggtcgccgagttcgacacctggctcaaggactcgctcctgggcggacggtacgaggacgtgaaccggtacgaggagaaggcgccgcacgggagggcggcgcacccgtggccggaccacttctacccgctgcacgtcgcgctcggcgccgccggggacgccgccaaggcggagcagatccaccactgctggaccaacgccacgctctcctacgcgtcctacaggttcaccaccaacagctgacgcgctcctgctctgctgtcggtggaactagatgaacgccggccaccgccccgccacctgctgaatttcgtgggaagcatccgtcgtcggcgtgcgtggcagcatatagcccatatacaagcacgcttgtacttgtaaaaactgtatccctaataaagccccgtgtgccgttccgttcgcagtagatatgtgtttgtcgatgctttgcattgttcagcgcagcagcttattccatcgtcattt

SEQ ID NO: 366 - DNA, 620 bp, Solanum lycopersicum
ccttcttcactctaaattatcacaacctaaatatagtaagttatttataccaagtaagggggaaaatggggttaaaggcttttataattctaagccttgttttggctatttttgcaattgtaacctcacatgttgcagctagggaattggctgagagcttcactactactatggaaaatacaaaggaaaatgaggtaaatgatgctaaatatcctggaggaggttatggagggtaccctggtggtggtcgtggaggttatggagggtatcctggtggtgatcgtggacgtggaggttatggagggtaccctggtggtggtcgtggacgtggaggttatggagggtaccctggtggtggtcgtggacgtggacgtggaggttatggaggtggatattgctcctatggttgttgtgaaaggaattactatggtaatggttgcaataggtgttgttactcaaaaagtgaagctatgaataaagtcacccaagctaagcctcacaactaaaatttctaagttatagtaatattttatgtagtgtgtgttttagtagcaagtaaaatagtttttaatttgttgttgggagtttgaataaatgtagcttccattcacttcatgtgg

SEQ ID NO: 367 - DNA, 2204 bp, Hordeum vulgare
aaaggatccgagttgaaatctattggcttccagcaagtccgaacaatgcagcatcttacacttgcagcatctctgtctgctgctgttctctttgcatgcatcctgtatgctgaaagtgccgatctgaactctgacaagcaggctcttcttgcatttgctgcatccctgccccatggcaggaagctcaactggagctccacgacacctgtctgcacttcttgggtgggagtgacatgcacaccggacaatagccgtgtacacacactacgcctacctgcagtaggactctttggcccgataccctcggatacacttggcaagcttgatgccttggaggtgttgagcctacggtctaatcgccttactgttgacctccctcctgatgtaggatctattccatcccttcattccctctacctgcagcataataatctgtctggaatcataccaactacactttcatccagcttaacattcctagatctgtcctacaacacttttgatggggaaatcccattgagagtacaaaatctcactggacttactgcaatccttctccagaacaactctctttctggacccatccctgacctacgtctccccaaattgaggcatttgaatatgagcaacaacaacctcagtggtccaataccaccttccttgcagaaattcccagctagttcattcttagggaatgcttttctgtgtgggttaccattggaaccatgtcctggaactgcgccttctccttcaccgacaccatcagtgcccagcaaatccaagaggagcttctggaaaaggatcaggacaggtgttctaattgcaattgctgctgcaggaggggtattgttgcttctcttgattcttgtactcttgatatgtattttcaagagaaagaaacacacagaaccaaccacagcttcgtcatccaaaggaaaagctgttgcaggtggaaggactgacacccctaaggaagactacagcagtagtgttcaggaagcagagagaaacaaactggttttcttcgagggttcttcatataactttgacctggaggatttgctgagagcttcggctgaagtacttggaaaaggaagctttggaactacctacaaggctgttcttgaggacagcaccacagttgtggtaaagagattaaaggagatggtggtggggaagaaagacttcgaacagcagatggagatagttggcaggattggccagcatcagaatattgttccgttgcgtgcttattattactccaaagatgaaaagctactggtgtatgactatgtccctgctggtagccttgctgctgttttgcatgggaacaaagctactggaagagctgcactggactgggagacgagagtgaagatatccctcggcgtggcgcgagggctcgcccatcttcatgccgagggaagcgggaagttcatccacggcaacctgaagtcgtcgaacatccttctgtcgcagaacctcgacggatgcgtctccgagttcggcctggcgcagctcatgaccaccctgcccgcccccgcccggctcatcggataccgcgcgccggaggtcctggagaccaagaagccgacccagaagtcggacgtctacagctttggcgtcctgctcctggaaatgctgactggaaaggcacccctgaggtcccccgggcgtgaggattccatcgagcacctgccgcggtgggtgcagtccgttgtccgggaggagtggaccgcggaggtgttcgacgtggacctgctccggcaccccaacatcgaggacgagatggtgcagctgctccaggtggccatggcgtgcgtggccgtcgcgccggaccagcggccgaggatggacgaggtgatcaggcgaatcgccgagatccgaaactcggactccgggccagcgacgccgccggaggaggccgcagcccaggcgccgtgagggcgggtcgcggagatgaaggagtcccgttgtgtttagcagaggtagctagctagctaagctaggttgctgcatagttacttggttggttatatagatagctttgagcgaaagttgatagccgcttgcttggttgattagtggggtgaggtttctgttgatctctgatttattctttttgttttgagaaattctgctgtgccgttttcggagtagtgaggctactgatcctgaatgagtatctgatgggcggtaccttt

SEQ ID NO: 368 - DNA, 324 bp, Hordeum vulgare
cgctagggtttaagcagcagcctcgccgcctccagatccccaaccctcgaatccggagaggagctcgccggcggcggcagccaggatgtttctaggcgcggtgccgcggaagccgagcaaggaggcggcgtacaaggagctgcgctcgcacctctacatcatggccggttgcatcgccgccatccgcgccgccccctacatcctccacttcctcaaccgcgagcccggcatgacggagctcaagctcgagctctagctcagccccccgccgcccctgaggtatgactgggatggtgaagttactctcaggatcaggctttgaag

SEQ ID NO: 369 - DNA, 1525 bp, Hordeum vulgare
aaaggatcccacgctcaacattgcaactctgcaagcaaagagatactgatcactgatcagggatcgccatatcggccagtgatggtgaaggcgcctctccactcctcatcctcggccgcagccgccgcggccaccttctcgttggtcgccaagaaggcgcggctctcgccgttcatcctgctctcgctgctcttcatgctcctcttctccttcctctacggagaggagctcgcggcgctcatcggccagcgagctggtcgacgttcagcagacctcgacgttgacgtcaaccgtgagcatcagcaaccggccggggtggaggatgggtggaagaggaagaagaagaggtggcaggggaggttggcgttcgcggtgaacgacgaggacgaggacgaggagtgcgacgtgttctcggggagctgggtgcgggacgaggaggcgcacccgctgtaccgggaggaggagtgcccctacatccagccgcagctcacctgccaggcgcagggccgccccgacaggggctaccagtcctggcgatggcagccgcacgactgcaccctccccgcgttcaacccgacgcagatgctggagacgctgcggggcaagcggatgatgttcgtgggcgactcgctgaaccgcgggcagttcacgtccatggtgtgcctcctccagtcggccatcccgtccccggaggccaagtccttcgagatgtcccccgaccagcagcacaccgtgttcaccgccagggagtacaacgccacggtggagttctactgggcgcccttcctgctgcagtccaacgcggacgacgccgtggtgcacaagatctccgaccggatggtgcgcaacggctccatcgcccaccacggccgccactgggagggcgtcgacgtcctggtcttcaacacctacctctggtggtgcaccggcctgcgcttcagggtcatgaacgggccgatcggggacgccagggaggaggacgcggtgtgggtgtccacggaggaggcctacggcatggcgttccgggacatgctgcagtgggtcagggacaacatggacttcaacagcaccagggtcttcttcaccagcatgtcgcctacccacggcaagagccaggactggggggacgcgcaggggggcaactgctacaacgagacggcgatgatcgaggacgccgagtactggggcacggacgcgcggcggagcgtgatgcgagtgatcagggagatcctagacggcgatggcgccgacgtgccgctcacgttcctcaacgtcacgcagctgtccatgtaccgcaaggacgcgcacacctccatctacaagaagcagtggaacccgctgacgccggagcaggtggccgaccccaggacgtacgccgactgcgtccactggtgcctaccgggactccaggacacgtggaacgaactcctctactccaagctcttctacccttgatcacgcacgtttattttcacttactacaagtactcgtaggttgtagtgaggccacctaacgggtaccttt

SEQ ID NO: 370 - DNA, 948 bp, Triticum aestivum
cgagttcatcgcctcctcggcattccgtcgaacaccatgacgagcgttgcggcggcggtcgccctcctccgcctccctctcgcccacctctcctcccacctccggtcgctcccttcccgtcccgtcccgtccgctcgcctccgcctctccgccccccaccgccctctctgctccctcctcaccagcggccacggcctcgccgtagcggccgtgtccgaggcggtggtcgcggcggatgaagaggagttcgaagcgacggaggagcagcaggaggaggcgcccccttccttcgtgctcccgcggctgccgcggccgaagctcgacgtgaaggagcggaaggagctcgcctcgtacgcgcacggcctcggcaagaagctcaagtcgcagcaggtggggaagggcggcgtcacgcccaacctcgtcaccgccttcacggacaacctcgagtccaacgagctcctcaagctaaaaattcatggaaactgccctggagaactacctgatgtgatacgacaacttgaggagtcaactggatccattgctgttgaccaaatcggccgctcggttattctatataggcctagctccagcaagatgaaaaagagggaagaagtcgctagaaacagagaagagtatgcaagaaacaatccgaggtttggaaaatctgaaaatgcatttgaagaacgtcctaggaacaacagcgcaggcaggagattcgtaaaatctgggtcgacatttaggactcaacagaagagaagaccggtagcatccaaggggtcgtcatacagcagagggtagcagcatcaaaaataatagattgtttttcttattgtatggaggaatcatgtaaattgagacccactagttgtataatggacattagtgtttagtttgtgctagtaaccatggtttcaagtctcatcaaccacaaagacaggctaacaccac

SEQ ID NO: 371 - DNA, 798 bp, Solanum lycopersicum
gtttcacttcaaatgagaacaataatgtctaagaaccaacatgagtccttctcattttcaagaaggtacttcaatttcaagaaaaaagttgaagatgaagagtacgatgatgaagtttacttgaacactttccactcttcctcgcttagaggtagcgaggaagagtattttgggatgcattcgctgtcaggtacagcgacgaatgcatccacagtaagcaagaaactgtcgcgttcgacagtttctaagcttcgttcggctcttacttttggtaagagccgaacacaaatagggcttggtactaaagttattggtactttatttggttatagaagaggacatgttcattttgcatttcaagaagatccaaagttaggcccagcattctttgtagaaatggccactcctacaagtcatttagttagagaaatggcttcaggattggttagaattgcattagaatcagataagaggacaggtaaaaaaggggtgaaattgctagaagagccaaattggaggacatattgtaatggtagaaaatgtggctatgcaatgaaaagagaatgtgggcctgatgaatggaagattttgaactcaattgggcctgtttcaatgggtgctggagttttaccaagtgatggtgatggaattgggttagaaggtgaattgatgtatatgagggctaaatttgaaagagttgttggatcaaaagattctgaggctttctacatgatgaatcctgatggtcatggtggtcctgaacttagcctttacttgcttagggtttaaactgtgtaa

SEQ ID NO: 372 - DNA, 785 bp, Gossypium hirsutum
caagcaagaaactcctctttcgttctttgtgagtgttacagtgaaaaacaaagataatggcaggcgggtccaaatccaatccaccaaagcctaggaagagagtcgacgctgcttcagcccctgcccctgcccctgcccctgcctcctctcttgttcgcgctaaagatggcagtgcttttgccaaatgtgatgagtgtaacaaaaccgtacccatggctcttatcaatatgcatagctgtagccttgaagctaaaatcaaaatgaatttggagtctcaagttatagagaagcctgctgaagccaagaagaattctgcagaaaggaagaagcctcccgcaacaacagagtcaaatcctaaaaagccgaagaagttgaagaagggaaaagatcccaatgcccccaaacgccctcccaccgccttcttcttgttcatggacgactttaggaaatcttacaaggaagcgaacccagatgcaaagggtgttacaggggttgcaaaggaaggtggtgagaaatggaaatctatgtcagaagaagaaaagaagtgttacgtggataaagcagctgagctgaaagcagagtatgaaaaggcaatggaggaggctaagaatgctgaccatcaaaatgaggaagaggaaggaggttcagacaaggaaacccctgctgctgaaaaggcaacagaggaggaagtgttggatgattactagttgaaggcatagttcttttcgagttcccccaagaatttgttcttattttgcccgggggtttgggagggagtgtaaatt

SEQ ID NO: 373 - DNA, 804 bp, Solanum lycopersicum
cgctgcattgagcaaatgagtagtgtaatgttatcttcttcctcttcctccatggctctccatcgcctgctccgacccgctcccatcctttctttctccttccttaagcaatctctctctcttcttccccatcaaacgacgtcacttcatcccatcatcaacaattctctttcctccttcccctctcttcggacccatacatcaatcttccttcgttctagaactttctctaaccttccaattagctgtacctctcaatctctcttggaatcttctgaggatgtggaagatgaggaaattgtaaaacaaaatgaagaagtgactgcccccaggcctagtgagtctgagagaaaaatattaagggcgaaattgccgaacctgactgtgaaagagaagaaagaattggcatcctatgcacatagtttagggaagaagctaaagagccaacaggttggcaaatctggtgttactgatactgtggtcatggctttagaggagactcttgaagctaatgagcttctcaagctcaaaatacatggtacctgtcccggaggagagctggatgatgttgtaaagcatttggaagaagcaactggctccgtggttgttggtcaaattggtaggactgtgattctctaccgtccaagcctgacaaaaatgaaagctgaagagaagaagaaacaggctcaaattctttttttgaaaaaacaaaaacaatatgcagagagacgatcatttcaggataaaggaccggtacctagatcatatgctcgtaatcgccgaggaagtagcagggtttgatga

SEQ ID NO: 374 - DNA, 1236 bp, Triticum aestivum
gccccaacaacagagacggacccggccatggtctacggcggagaggaggcgctgaggcggcagtactccatcggcgacgagatcgggcacggccggttcgggaccgtccgccgctgccactccaacgccacgggggaggcgctggcgttgaagaccacgcccaaggcgccgctgcgtgaccctctcgacctggccctcgcggagcaggagcccaagctgcacctcctcgcctcctccccgccctgcagcccgcacctggtcgccctccacgccgccttcgacgacgccgacgccgtccacctcgtcgtcgacctctgcgccggcggggacctcctctccctcctctccgcccgcggcggccgcctccccgagcgcgaggcggcggggctcgccgcgcagatcgcctccgcgctcgccgcgtgccaccgccgcggggtcgcccaccgggacgtcaagcccgacaacctcctcttcgacgccgccaccggcgcgctcaagctcgccgacttcggctccgcggagtggttcggggacgggcgccgcatgtccgggatcgtcggcacgccctactacgtcgcccccgaggtggtcgccgggcgggagtacggcgagaaggtggacgtgtggagcgccggggtggtgctctacatgatgctgtcggggtccgtgcccttctacggcgccgccgccccggagatcttcgaggccgtgctccgcggcaacgtgcgcttcccgccgcgcgccttcgccggcgtctcccccgaggccaaggacctgatgcgccgcatgctctgcaaggacgtctcccgcaggttctccgccgaacaagtcctgaggcatccgtggatcgcgagctgcggaggggatgcggttgcgggctgaagaaatcgatggaccaacatgcggggcgcgctccatccatctgtagatagaagaccttctccacggaggacgacggctcggtttctgcggctcttctctgtttctccggcaaatcggcgatggacagaagcagcggtggtgccggagttgagttgagttcagtaagtagaactagtgctagttccttcgtgatcatttaggcctagaggtctctggtgaagctggaattgcagaagctttcacctgagttagcctgaatgtgtgtttgttcgtcgtgtttgttctctgaatctcggcagcagtccttgtacatacagtcttgatcagttctagctgaagaggaagagagggttt

SEQ ID NO: 375 - DNA, 1067 bp, Sorghum bicolor
cacctgtcgttcttccttcagggagaggttggagccgtaggggaagcagggctgacagggttgcggctgcggcgcaaggacgagacgccgagaggactagggtttagccatggcggccgaggagcagactccttgtaccaagccccgccccgacaaggccaagaagcggaagaagcccaagaaggacaagtggggccaacctatcgccaccgctgaggagccgtcggtggagccggagcaagagcacccggcgggggaagttgaggcggtggtacaggtggacaaggaggaggaggaggcgactgcggcggcggagggctatgagtttggcaaggtggtggccagcggcatgccctacacgaccaccgaggcggacatccggaagctgttcgagttctacgggcccctccagtcggtgcagctctctcgcttcccggactccggcaacttccgcggccttgccttcatctgcttcgagacgaacgaagatgcaataaagtctcttgagcttgatggattcaaaattggcagcagatacatgagggttgaaaggtgcagggtgacggccacctcaaataagaaaaggaaggcagagttccaaaccgaccccaagaagtccgaaggctgcctctcggcatatgttggcaatctctcatggaatgtcactgaaaaggacttgcgagatttcttcagatcatcaaagattgcatcagtaaggttcgccatcgacaaaagaactggaggttctcgtggcttctgtcatgttgattttcaagacgacgagtcgctcgagaaagccgtagcgatgaaccagtctgaactgcagggtaggcctgtcaaagtcgcgtattcagtcagtaacaggggctgaagagcaaagattactcgccaccggtggtttgtactagtgagcttgtagtgttatggttttgctccctcagttttggtaaggcttttgctgcttgaaagatgattttggaatcaaatccatggtgacaattcttgccccaaacatatggcaaatgtaacccttgtgtaacaagtacgagtttggtaaacctgcatct

SEQ ID NO: 376 - DNA, 1231 bp, Brassica juncea
gcaaatacataaattcgaacattgcagctatggctcccacattgcaaggcgagtggatcaaggtgcagcagaaaggaggagagggacctggagcaagaagctcacacggcatagccgtggtcggagacaagctctactctttcggtggcgagcgtactccaaacatttccatcgacaaacacctttacgtctttgacttcaacactcacacatggtcaatcgccccggccaacggacaagcccctaacgtccaggctctgggcacccgcatggtggccgtgggaactatgctctatctattcggaggccgtgatgagaagaaacagttcgacgacttttactcgtacgatacggtgaaacaggagtggaagttcatcaccaagctcgatgaagagggaggacccgaggctcgtacttaccactcgatggcttcggatgaaaaccacgtgtatgttttcggtggggtgagcaaaggcgggaccaacaagacccccttcaggttcaggaccatcgaggcgtataacattgctgatgggaagtgggctcagctacctgatcctggtgagcaattccctaggttcgagagaagaggaggagctggattcattgtggtggaaggaaagatttgggtggtttacgggtttgcaacttcgcctgatcctaatggaaaaaacgactatgagtctgatcttgtgcactactttgatcctgctactcaaaagtggaccgaagtggagactaaaggagagaaaccttctccgaggagcgtgtttgcgcatgcggcagtaggaaaatacataataatatttggaggtgaggtctggccggacccaaacggacatttgggtcccggaacattgaccaatgagggttacgcgttgaacaccgagactctggtgtgggagaagtttggaggaggagctgagccgggtgaactcggttggcctgcctacacgactgctaccgtctatggaaagcaaggcctcctcatgcatggagggaagcgtccaaccaacaaacgtaccgatgaaatgtacttctacgcagtccattccgcctaagcaatgctctctcactactctcaaaggttcgtttatgtggtgagtattattactatttgtgttgtgtctcataatatgtatgataaaataaaggtctgtgaagcctatgtaaatcagccaactgtatgtggcttattatcaagttaaactatgtgtgtttctcgtttgca

SEQ ID NO: 377 - DNA, 1390 bp, Solanum lycopersicum
tgtcctttgcctaactccaaaggatcatcacttcaacaatccctcctcctattggccttgccaacttccccatttcttcttcccaacaaaaccccttaatatataaacccttctccatctttcttccttcagagtttttctccctatacacaaattgatagaatcggtcatttgatcagatcatggctcattcagctatctctcaggtgtcagttgctgttcctctccaaacggattcctctttccgaagatctacctttaaggctacaagcttaacattcagtgataaatcatgcatttctatgccatctatcgatctaaaagcgactcgatccagaagccaatacattgtttgcatgtcagtgcaacatgctagcaaagccaaggtttcagtttcacctttatcacttgaagatgcaacagaaccacccttgaatatctacaagcccaaggagccatacacagcgacaattgtctctgtcgaaaggattgtaggcccaaaagctcctggggagacttgtcatattgtcattgatcatgatggcaaccttccttactgggaaggacaaagttatggtgtcgttcctcctggtgaaaacccgaagaaaccagggagtccccacaatgttcgtctatattcaattgcatcgaccagatatggggactcttttgatgggaaaacggctagcttgtgtgtcagacgagctgtctactatgatcctgagacaggaaaagaagacccatccaaaaatggtgtttgcagcaacttcctatgcaatgcgaagcctggtgacaaagtgaagatcacaggtccttctggtaagataatgcttctacctgaaaataatcctaatgccacacacatcatgattggaactggtactggtgtggctcccttcagaggctaccttcgtcgtatgttcatggagtcagttccaatgaagtttaatggccttgcttggcttttccttggggtggcaaacactgacagccttctgtacgacgatgagttcaccaagtatctcaatgactacccaggcaatttcagatatgaccgtgctcttagccgagaacaaaagaacaataaaggggggaagatgtatgttcaggataaaattgaggaatacagtgatgagatcttcaaacttctggatgaaggggcccacatctatttctgcgggttgaagggtatgatgcccggcatccaggataccctgaagagggttgctgaagagagaggtgagagttgggagcagaagctttcacaactcaaaaagaacaagcaatggcatgttgaagtctactaaataggaaatttttaattgttgcatttgtttgtgattgttgattgttgtcaactgaacttagcaagcagttagatgacacattg

SEQ ID NO: 378 - DNA, 581 bp, Sorghum bicolor
ctagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaattag

SEQ ID NO: 379 - DNA, 1659 bp, Sorghum bicolor
gagggtttagccggttggcgccgaagccgccgccgccgatcctctccggcagccgaactcgcagcttgcggcgcatcccttccccacttccggcggtatggacagcacaaaggggacggcggtggcgaggctctgcgacgacctgatggtggatatcctctctcgcttgcccgtcaaggacctccgccgttccacgtgcgtgtccaaaccctggcgcgacctcgtcaccgaccccctccaccgcaagaagctgccccagaccctggaaggtttcttccacggtggtgctggcgagcgtcacagctatgggcacttcaccagcctgtcggggaggggagaatctgctcctccagtcgacccttccttctccttcctcacggcgaagctgccttgggtcgagcgcatggacctcttggattcctgcaatgggctcctgctctttgggtgcaccacggagaacaagtttgggtacatcgtgtgcaaccctgcaaccgaggaattggtgaccatacccgccagctctggttcttgtccgcctccttcgcttactccattggaagacaaaactatcgctgtctgtgatggggatatatatgcacacacctatctgatgtttgacccgattgtctcctcgcgcttccacttggtccagttctggcaggataggtcgacgtgtgaggtgaaaaaggtgcactcttactcgtctgaaaccagggcatggagtgacacgtcaaacaagtgggagccaggtgaagagcgctgtggatggggggtactgcggggtcgtggtgaagccataatcgaattcacgcgtggcagggctttggttgatggtctgttgctttatattgaagctgttctccttttcatgcgcggcagggctttggtcaatggtctattgcattttgttgcctaccattttgaggaaggagagaatctgatagttgcggtggatggggaagggacaatttgtaggatcatttgcccacctgttaagcatgtagatgccaatgcttttattggtcaatcccaaggccatctgcactgcatcagtacgaatctgatatctcaatacttcaattaccatttcacgcaactgtcaatttgggttcttgaggactatgatacacaagaatggatcctgaagcacaatgtgagctttccgcagctctttggatcaccgagttgcccaatcgacaaccacgatattgtggtcattcatccggaccacaattcgataatccttgttcagcactggaaccagaaactggtgtcatatgacatggatagtaaggagcaccgtgttctctgcactctaggagagggatatcggtccattaccccgtatgttccctatttcatggagtcaccagttcttgccaccaaggactgaggttgttgcttgtgggatacttctctgaatgttcagaaagagcttgatcttccaagtatgggcaactagcagtgtgggtaaatctaaatattagctggtgcaaatttggattaatctattatcaataggtgatctattctgctggtgctttactgtaaccctttttgtaatgttgtgagagttgtttactagacagcatgcaatttagcattaaatatgctagttcttttgttaatgcacaatgccatgaactagccaacggtcta

SEQ ID NO: 380 - DNA, 797 bp, Sorghum bicolor
tgtcttccgctctcaccttatccccttgcggcaaaaacctccgcgcgctccccatggccgcctccctcccgaccaccgccgcggcggcgcgcctcgcggcgcaggccttcgcgttcccgtcgctcaagcctccctctgcctccgccttctccgccctcccgcgtgccgccgccttcccctcattcgccgtcgcggcggcggcgcccccgcgcccgcgccccgcgaggccgacggcggcccgggccgcgggcgacgagagggagacgatactgctccccgggtgcgactacaaccactggctgatcgtcatggagtttcccaaggaccccgcgcccacacgcgagcagatgatcgatacctacctcaacaccctcgccaccgtcctcggcagcatggaggaagccaagaagaacatgtatgccttcagcacaaccacctacactgggttccagtgcactgtcgacgaggagacatcagagaagttcaagggtttgcccggtgttctgtgggtgcttcctgattcctacattgatgtgaaaaacaaggactatgggggtgacaagtacatcaacggtgagataattccctgcacgtacccaacctaccaaccaaaggagcggagaacatccaagtatgagagtagacggtatgagaggcgaagagatggccccccagcagccagcaggaaaccaaggcaacaggctcctcagactgagtcagcatcttcataatgagttttgcaggcatttatccacatacttactaaaacaaaagagcacgcctaattctgtcacttt

SEQ ID NO: 381 - DNA, 1046 bp, Sorghum bicolor
atacgtggacatcgaggtggtcggccatggcggagctccagcagctgcagcaggtggcgagcgacgacgcggcggagtggaagcaggtggcggagctgagggccgtcacccaagcccaggatccttcctgcaaggaggaggacgactacacgctgcgtcggttcctccgcgcgcgggaccacaacatcggcaaggcgtcggcgatgcttctcaagtacctcaagtggaagccgacggcgaagccccacggcggcgagatcccggcgtcggaggtggcgcgggaggtggcgcaggcgaagctttgcctgcaggggtacgacagggaagggcggcccctgatctacggcttcggcgcgcggcaccacccggcgcggcgggacatggaggagttcaagcgctacgtcgtgcacgtcctggacgccaccgtcgcgcgcctgccgccgccggggcccgggcggcaggagaagttcgccgccgtcgccgacctcaagggctggggctacgccaactgcgacatccgggggtacctggcggcgctggacatcatgcagagctactacccggagcgcctcggccgcgtcttcctcatccacgtgccctacgtgttcatggccgcctggaagatcgtctaccccttcatcgacgacaacaccaagaagaagttcgtgtttgtggcggataaggaccttgataggacgctccgggaggccattgatgactcccagctcgccgagatctatggcggcaagctcaaactcgtcgcgccgccggcaaattaaacggcaacaactgaaaactgatccatcccatgaactctgcaatgcagctgagcagagcagagagaatgcagcagcagagtacagtacgcgagctagacggacggacgctcgaatacgtacgggtcagagaaatatatatatgtatgtaaatcgtagcagctaggagaattagcaattgcaagtgacgacatgtcatcttgtacaagacacgcggaatgaaagatgcatggtttctgtatgctgtcctctgtactgtaaccagccggt

SEQ ID NO: 382 - DNA, 999 bp, Arabidopsis thaliana
ctctcctttaatggcttctgagagatatttaagtttagcaaaaaaatcctaagcttctacaatggcgaatcttcccaccgttctcgtcaccggcgctagtggcagaacaggccagattgtgtataagaagctgaaggaggggtcagacaagtttgtagcaaagggtttagttagaagtgctcaaggaaaagagaaaattggaggagaagctgatgttttcattggggatataacagatgctgatagcattaaccctgcgtttcaaggaatcgatgcgcttgtgattctcactagtgctgtgcctaaaatgaaacctggttttgatcccactaaaggtggaagacctgagttcattttcgaagatggacagtatcctgaacaagttgattggattggacagaagaatcaaattgatgcagccaaggttgctggtgttaagcatattgtcgtggtcgggtcaatgggtggtaccaatccggatcatcctttgaacaaactgggaaatgggaatatactggtttggaagagaaaggctgaacagtaccttgctgattctggaactccttacacaattatcagagctggaggacttctagataaggaaggcggtgtacgagagctgctagttggtaaagacgatgagctacttcagacagacacgaaaaccgtccccagggctgatgttgcagaagtctgcattcaggcattgctgttcgaggaggccaagaacaaagctttcgatctcggctcaaagccagagggaaccagtaccccaaccaaagacttcaaggctctcttctctcaagtcacctctcgtttttaaatcattatctttgttgccaataagaacatttgggatcaaaccttctaaaataaattctgtagtgtctatttgaaaggatacgttctttcaattcaatgagaatattggggttgaatgttcaaaatttaaaattttgatcatacagtaacttctccagagctattcattgaggtgaa

SEQ ID NO: 383 - DNA, 1002 bp, Hordeum vulgare
accgtcctacaactagccactgtcctatatcttggcgtcgcggactagctactcggcggccatacctctagtttataccccggatccccttgctctgcgcacgctggtacgccgcctgcggccatctcccggcctcgtccgtcagaccagtcgtcgtcgccgcgaagccgccgccctatggaggactacggcggcgtggcgagcctggtggcgtccggggtggtgttctggtcgacggcgttcctgctgctgcgggcgctgctccccaagcgctcctacgacttctgcaaccgcgccgtctccaccatgcacgccgtcaccggcgtcgccctcggctgcctctccgtgcaggactgggcctcccccgtctcccccgtcgcctcaccatcctcgccgcgccagatgagggcgctggcggtgacgctgtcgtacatgatctacgacggagcgtgctgccacctgagcggcgacgcgcggctggacaacgccctgcaccacctcatcagcatcgttggcctcgccgccggtctcgcctaccagaggtgtgggacggagctggtggcgtgcctgctggtcacggagatctccagcccgctgctgcacctcagggagatgctcaaggaggtcggcgtcaaggacacggacctcaacctgctcgtcgacatcctgttcgcggtgaccttctccgtggcacggatggtttgcgggacgtacgtcacctaccgcaccgtgacggctgacaaccccatcctcatcaaggcgatggcgacgagcttgctgctggtgagcgcctactggttcttgaggatcctcaggatggtcaggcacaagattgggaagaagaggctagcatccaaagccgccggcaagtgatgctgcaacctgcagcgaccggtgtgatgcgacaagctgtgtttgcgcgattatgatcatgtacgcggtgtagcacattattaatttagctattgtctgatgggcaaagcatgtcccaaacaagagatg

SEQ ID NO: 384 - DNA, 998 bp, Oryza sativa
cggcgatgagccccaggagggagcaggcggaggagcagcagcagcaggggtggagggaggaggcggtgtcgggcgcatcgctgaggcaggtggacctggagaggggcgccaatgggtgggcctcgccgccgggggatttgttccacctgcgcgcgagggggtacttttccggcggcggcggcggcggcggtggcggtggtgggggtgggaggcgcgggaaggcgccctccgccgccgagtggctcctccgccccgccggcgtcgactggttaaggagccactcccgcctcgaccacgtcctcgcccgcgacgacatccccgtcgccgccgccttccgccgcgcccgcctccgcaaggacccctccgcccacttcctcctcgccgtcaatctccaggtgccggggcggccggacgcgtacagcgcggtgttctacttcgcggcggaggcggcgatcccggcggagtcgctgctggggcggttcgtccacggcgacgacgcgtaccggaacgcgcggttcaagatcgtgaaccggatcgtgaagggcccgtggctggtgcgcgccaccgtcggcaactacgccgcctgcctcctcggccgcgcgctcacctgccgctaccacggcggggacggctacctcgagatcgacgtcgacatcggcagctccgccatcgccagcgccatcctccacctcgcgctcggcgcggtcacctccgtcaccatcgacatggggttcctcgtcgagtcccagtccgaggaggagctccccgagaggctcttcggcgccgtgcgcatcgcgcagatggagatgggcgccgccaagtatgtcgagacggcgcccgacgatgtggtccccgacgccggcagggctggcgccggattcagggttcactcggcgaaggtggccaacgatagccgccaccaagaacgcgccgccggcaaggtcgggaggtcgatgagctgccaggaacgcgggagcggaggaggaggaaaatagtag

SEQ ID NO: 385 - DNA, 1037 bp, Oryza sativa
atagacggtcctgatcttctgccgtgctgttctgctggtgttgccgcataacccacggcggcggcgcgtaggcaaagccgggaggaaggattagggtttaggcggcggccatggcagctgaggagcagactccgcgaaccaaacccagcaccgggaacagcaagaagaggaagaagcccaggaaggacaagtggggccagcctatcatcgacgccggcgatcgcccggcggttgagccggagcctgagccagagccggagcctgtcccagcgcccgcagcggcggcggcggcggaggaggaggaggaggcggggatctatgaaaccggcaaggtggtggccagcggcctgccgtacaccaccaccgaggcggagatccgggagctcttcgagcggttcggtcccctccggtcgctccagctctctcgcttcccggactccggcaacttccgcggcctcgcgttcgtctccttcgagtcaaacgaggtggtaatgaagtctcttgagcttgacggattcaaaattggcaacaggtttatgagagttgaaagatgcaggttggctgctggctcgaagaggaaaaggactgtggagttccaaactgatcctaagaaggctgatgggtgtctgtcagcatatgttggcaatctcaaatgggatgttacagaaacagacttaagggacttcttcaagtcactgaagatttcatcgataaggtttgctatcaacaagagaacaggtgattctcgtggtttttgtcatgttgattttgaggacgacgagtcgcttgagaaggctgtaggaatgaatcaatctgaactgcgcggccgacctatcaagatatcatatgctgtcagtaacaggggctgaaggctactagatagtaaactttgagcatgagcgagcctcagtgttatgcttttgctccctcagttttgttacggttatatatccgtattaagtttctactgaaagtgttgtttcttgcatcaatctctatgtagaatgtaattcaccgtgtgacaaatacttggtgct

SEQ ID NO: 386 - DNA, 1050 bp, Solanum lycopersicum
agcaaacaactagctagccaccagacaatcaaatcaatatcataaatttcaacaaattcttctcctaacttcacacatcacacacttatctcttttcccttctttcatactattaatatcacacacctttttttttcctccttcattctctctttccttttcaaataatcacaaggaattcatttctagtttcaattcttagctatgggtggtgatcacaaagagaagaccactgtaatggtgctaaaggttgatcttcagtgtccctgctgctacaagaaggccaagaaaattctctgcaaaatgcctcaggttcgagatcaaatgtatgatgagaaggccaacactatcaccatccttgtagtttgttgcagtcctgaacggattcgcgacaaattgtgttgtaaaggaggaaaagcaatcaagagcattgagatcaaagagcccttaaagctcaaagctcctgaaaagcccaaggagcccgaaaagcccaaggaaaagcccgaaaagcccaaagaaccagagaagaaacccaaggttgtcacttttgaaacgcccaaggagcccgaaaagcccaaagaaaaagcaaaggagcccgaaaagctcaaggacaaagcgaaagagcccgaaaagcccaaagggcaagaaaaacccactgtaattgataagcccaaggacaaaacaaaagatccagaaaagcccaaggacggtccaacatctgcaatggtggcaaccccatggatatccgaaccaataatgatgatgcctccggtccacggatacccccaggtaatgccaagttgtggctgtgggcaatgccattataccggtggcccgtgttatcaatattatggaacacccgtacccccacaacccgccccatactacggtaactactcgtatggatatgggcccggcccgggcccatctagctatggaaagggttattacggaaacaatgattactataatgaagaagatggtcaaggatgcacaattatgtaattgtggccctacttagtacttcattattgggctttcaaaagatag

SEQ ID NO: 387 - DNA, 947 bp, Solanum lycopersicum
tcggaccctagtttcttcaccccacaatctccgtcgaactggcgatgatcgataacatcgatgatatcatcaactgggacgatgtagatcacatcttccacaacgttctagacaatcccgacgatgatcaattcactcttcatgattcctccccacagtcattccagcagatcgagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggagttgtgatgtgactcgttgtgatcaaatcttttcccataggtggatcatggttcctttag

SEQ ID NO: 388 - DNA, 1314 bp, Sorghum bicolor
ataatccacaaacacggacagggtttttcgcaaggatttcccagcctaagaaccagctcctggaacaagcttcctgactgtcaaaaatggaggctgcgcgtagctacttcttcgtcgccgcggttgccgtcgtccttattgcgcttctcccggccagcgccatagccgccggcctcaaggtcggcttctacaacaagtcatgcccgtcggcggaggccctggtgcagcaggcggtggctgccgccttcaagaacgacagcggcatcgccgccggcctcatccgcctgcacttccatgactgcttcgtcaggggctgcgacggctcggtgctgatcgactcgacggcgaacaacacggcggagaaggacgcgcccccgaacaacccgagccttcgtggcttcgaggtcatcgacgccgccaaggcggcgatcgaggcgcagtgccccaagacggtctcgtgcgccgacatcctggcgttcgcggcgcgggacagcgtcgcgctgtcgtcgtcgtcggcgtcggggagcggcaagaacctgacgtacaaggtccccgcggggcggcgcgacgggcgggtgtcgagggacacggacgccaacagcaacctcccctcgccgctctccaccgccgccgagctcgtcggcaacttcacgcgcaagaacctcaccgccgaggacatggtggtgctctccggcgcgcacaccgtcggccgctcccactgctcctccttcaccaaccgcctctacggcttcagcaacggcagcgacgtcgacccggccatcagctccgcctacgccttcctgctcaggagcatctgcccctccaacaccacccgcttcttcccccccaacaccaccacggacatggacctcatcacgcccgccgtgctcgacaacaagtactacgtggggctcaccaacaacctcgggctcttcacgtcggaccaggcgctgctcaccaacgccacgctcaagaagtccgtcgatgagttcgtcaagagcgacagcaagtggaagagcaagttcgccaagtccatggtcaagatgggcaacatcgaggtgctcacgggcacgcagggggagatcaggctcagctgcagggtcatcaacaacggcgccggcagcagcagcagcagcgctggattattcgagcttcaaatgacaaccgacaactctgctcaggaggaatcagcagcgaactagcaggtaggtagtaccagctatctgtagaggatctagtgatccactactactgctgctgctgtctgcatagccagtgacgatgttcttcagcactgcgatgatgagttctacc

SEQ ID NO: 389 - DNA, 1188 bp, Sorghum bicolor
tttctcgagctcagcctccagccatccatgccggccttcgccgggagcgcagcggagccgccgctggcagacagctactacgcgctgctccgacgccgcggcggcggcggcaataatgatgatgaagaagcatcaggtggcgcctactactacgacacgacgtcgtcgacagtgccatcgtcggacgacgacgtggcggagtgcgagctcccgatgatcgacgtcgggtgcctgacgaccctgacgaggagcgagcacggatcgtcgtcggaggcggagcgggcggcgtgcacggccgccatcgcgcgcgccgccgaggagtggggcttcttccaggtgcgcaaccacggcgtgtcgcaggagctcctggacgagatgcggcgggagcaggcgcgcctgttccgcctgccgttcgaggccaaggccacggccggcctgctcaaccactcctaccgctggggcaccccgaccgcgacgtccccgcagcagctgtcctggtccgaggccttccacgtcccgctcgccggcgtctccggatccgccgccgccggcacctgcgacttcggcgacctcaccaccctcagggatgtgactcgggaggtggcgggcgcgatgtcaaagctggccggcacgctggcgcgcgtcctggcggaggaggcccggccccggccctgcctgcccgcgggcggcggcggcggtggcggtggcgagcgcttcccggaggggtgcgacgagacgacgtgcttcctgcggctgaaccggtacccgccgtgccccatcgccgccgacgccttcggcctggtcccgcacacggacagcgacttcctcaccgtgctctgccaggaccagcaggtcggcggcctgcagctcatgaaggggggcaggtgggtggccgtcaagccaatccccggcgccctcatcgtcaacatcggggacctcttccaggcgtggagcaacaacagatacaagagcgtggagcacaaagtgatgacgaacgccaagacggagcggtactccgttgcctactttctttgcccgtcctacgactcgccgatcggcacgtgcgaggagccttctctttacaggacgttcacgttcggagagtacaggcgaaaggtgcaagaagatgtcaagagaaccgggaagaaggtcggcctccctaattttctcgtgtaataagaattcttt

SEQ ID NO: 390 - DNA, 3026 bp, Sorghum bicolor
gagggatgaagagtctgttcaagagtaagatcaggtggcagcaccggtctaccgaccccgcgtccccggcggggcagcaggcgtcgggcccgccgtcgccgtcgcccgcgagctccccgtcggggacggcgccggcgcccgcgctctccgtatccacggctgtctcctcctcgcctccctccgcggcggccacgcccacgggcgccgccgctgctgctgctgctgcggcgcccgcgcccgcgggggcgggggcgggagcgggaggggaggactacatatcgtccgaggaggagttccagatgcagctggccatggcgctgtccgcgtcttccaacggcgatttcgtgggggacctggacggggagcagatcagaaaggccaagctcatgagcctcgatcgcttcgccgcccaccgagacgaaggacacaccgcggagttgctctcccgccgatactgggactataactttcttgattatcatgagaaagttattgatggcttctatgacatctttggctcctctatggaatcctctaggcaggggaagatgccatcattagcagatctccaaacaggcataggggacctaggctttgaagtcattgtagtaaaccgagccattgatagtaccttgcaggagatggagcaagtggcacagtgcatcctattggacttccctgttgccaatattgcactcttagtgcaaagaatagctgagcttgttacagataatatgggtggacctgtcaaagatgctaacgacatgctcacaaggtggctggagaagagtactgagctgagaacctcgctacaaacaagtttgttgcctattggttgcatcaagatagggctatcacgtcaccgtgccctacttttcaagatccttgcagatagtgttgggattccatgcaaacttgtcaaagggagcaattatactggtggtgatgatgacgatgctataaacataattaagatggacaatgaaagggagtttttggttgatctgatggctgctcctggtgctcttattccagcagatatcttaagctggaaaggcaattcgttaaactctaatcgaaaacttgccctgaatcaaacagttggatcatcaagtactgttgattctaatatggatcctactgtattgccacttgaacctaaaggtggccaactgcctttgttcagcagtggtgattggatatcagacagtggttctggatatgaggcagcagaaactgcaggttctactcaaacctcttcgggtgccacatcatctgttcctgctggaaatgtttttgacagttcatggctgctggttaatcatgaccaatcagatggaccatcaacttctgctggtacatcatcccagcagaaagttgtacctcaaagtgaacatcagcagaatttaaatcgccttccagatttgcaggaaattccagagtcaaaaaacctttttgctgaccttaatccttttggggatatgaagtccaagaaaaagtcagtaccattcaaaggaccagatcataggaacaatgagttgcaaaagcgcagagagaacgtagttcctaatgctggaagaccacagcagcggttagttatgaagaattggtctccttacaatgatgtttccaacaacaaacagtacaattatgtcgaggattcgtttgctcgtagaaatgttggcaataatgctgcatcatcatcatcccagatgccacgaccagcctcaaggtctaatcttaattctggattgcgtaatgatgcatcatatcataattatgatagtattatggctggtacctctgccatgaagattacatctacagctgagactgggaaggttcctgaaagggttctgcgtggtgatttggacaaaggtcaaacaaattatagactggaggaccaacatgtcgtagttcaaccaccacaggaaagacttccatggggcaatcctgcagaaggaagatttccaatgaatagagttcagagtccagcaaaacaacacattgaaaacatggatgtaaagcaagaccataagaaaatgctccctgatccaaaaaaatctccccttgacagattcatggacacgtcattgccatcaagaaacatggacatgaggtcacagaggcttgactttgatgatgtgtctgagtgcgaaattccttgggaagatcttgtgattggtgaaaggattggcttaggttcatatggagaggtttatcgtgctgactggaatggaacagaagtagctgtaaaaaaattcttggatcaagatttctatggtgatgctctggatgagtttaggagtgaagtccggattatgcgtcggctgcgccatccaaatattgttctctttatgggtgccgttacacgccctccaaacttatctattgtatctgaatatcttccaaggggaagcttgtataagatccttcaccgccctaattgcctaattgatgaaaagcggaggatcaagatggcccttgatgtggccaaaggcatgaattgcctgcacactagtgtacctacaattgttcatcgagatctgaaatctccgaacttgctggttgacaataattggaacgtaaaggtttgcgactttggactttcacggttgaagcacagtacatttttgtcatccaaatctactgctggaacacctgaatggatggcacctgaggttctgcggaatgaacaatccaatgaaaagtgcgatgtttacagctttggtgtcatcttatgggaactggcaacacttagaatgccatggagtgggatgaatccaatgcaagttgtgggggcagttggtttccaggatagacggcttgatattcccaaggaagttgatcctctggtagcaaggatcatatttgaatgctggcagaaggatccaaatttgcgtccgtcatttgcacagttaacgagtgccctgaagactgttcaaagactagtgaccccttctcaccaggagacccagagcccccatgttcaccaagaaatctcagtgaacttgactccttagtaa

SEQ ID NO: 391 - DNA, 1146 bp, Hordeum vulgare
aaagtcgacgcctcctcgtcttctcacacaaaccctaatctccctcctcttctcccgagaaccgaggccgcgggcgcggggcagatggcgggcaaggaggacagccggatcttcgtgggcgggctctcgttccacaccgacgagcgcaagctcgaggacgccttccgccgcttcggcaaggtcgtcgaaacccagatcatgctggagaggcacacaaaccgccaccgtggctttggcttcgtgacgttttcagaccccagggcagttgagactgctatcaatgacatgcacaacaaagagttagatggtcgtaccatttcagtgaacagggctgagccaaagttgcaaacagatgacacgcggtacagcggtggtggcggcggcggtgaccgtggggattatcgtggtggcaagggtgatggtccaccccctggcaattgctttgagtgtggccgtgctggtcactgggctcgtgactgccctaaccctggtggcggccgttcggggcgattcccttccaagttcagtggcggcggtggcaggggagaccgcttttctggatcagacaggtttggtgaccgttatgtggatgatcgctatgatagtggccgttatggtgggtaccgtgagcctattgacagcagagacagatatgatgggggccgtgatcgttatgccagcgaccggtacccctctggtggtgaccgctatggtacagacaggtacggagcagccccagaccgttatgcaccaagtggcggtggaggcggctacggcagggagcgagaaagaagctatgagagagacacggtgcgtggtggcgcctatgacaggagcggcccaaggggcggcgcaagctacgacagggatggcccaaggggcggcatcggcggtggctatgacagggacggtccacgcggaggcggtgccgactacggcagcggagggcctacccgctacgagggaggaggttacagggagaggcctgcgccgtatgaccgccccagcaggggaggaggccgctttgacgaccgctactagcgacccgttgctgcagccagtcgagctatgtatttgcgtttgaacccttttcagtttggcatggccgaatgcttgatgagtactctgtcggcatagggatccttt

SEQ ID NO: 392 - DNA, 1443 bp, Hordeum vulgare
aagtcgacaacgtggaagctcaatataccaacactctaacagcaagcaaccatggcttcttatgaccaacaattcaaggttctcgaggtacctccgatcgtgcaagagctggtaggcgccggcgtgaaggagccaccgagccagtacgtgcttccggagcaagaccgtcccgctgcggcggctgtctccgagatgcccgagcccatccccatcatcgacctcagccggctgtctgccggcagccccgaagagttcgccaagttgcggtccgccttggagaactggaacctcttcctggctgttggacatggaatggagcctagctttcttgccgaggcgatgaaggccaccagagagttcttcaacctcccactagaagagaaacaaaagtactcaaacattgtcaacggcgagaagatgggcatggatggatatggtaatgacatggtcgtaaaagagaatcaggtccttgactggaacgaccggctcaatctcctagtggaacccgagtccctaagaacctacagactctggccaacacaacccccttctttcagagacatcctgtgtgagtacacggtcaggtgcaaggcggcggctaaccttgtctttcgaaacatggccaagatgctcaatttacaagaggaccacctggtaaacatgatcggcaacaactccatcacccaagctatattcaactactaccctcagtgtccaaggccggaccacgtcttgggacttaaggcccataccgatggctcgataatcacagtcaacttcgccgatgccgaggggctccagcttgagagaaacggcgtgtggtacaacgtgcccatcgttccaaatgcattggttatgaacataggagatataatggagattttgagcaatgggtttttcaaaagcttggtgcatagggttgtcaccaacgcggagaaagagcgcttgtcgttggtgctggtctatacgttggagctagagacacaacttgagccggtgtcagagctggtggatgacaagagacctgcccgatacatgaagatcaagctcaacgactacatggaaaaataccatgacacttatgccactgggacactagccatagacggcgtgaagatctgaatatgattccgatgtatgcaagctcgctgagtaagatctatggtgaagtatcttccgttgaccagtttgtaacgagtttatgtttttacctatttcccagatttttgtgtgtgtactcctcatgtaaaatgttgggcagcttgtgtggtcgcattaaaccctattataaaacttatccgctgtgggcaacatacggatgcaaaggatggaataaaacttatcgattgtgtgcaacatgcggatgcaaggatagtttttcctgttagtatgtatcattgataagtaccattgtgcctccgtttcaagaaattaggatccttt

SEQ ID NO: 393 - DNA, 1928 bp, Hordeum vulgare
ccgacatggcgatcaccggcggcccgcgcggccgcctcctcctcctcctcttcctcgccgccgcctgcctcgtctgcgcccccgcccgcgccttctacctccccggcgtcgccccacgcgacttccagaaggatgatgatctccaggtgaaggtcaacaagctgtcatctataaagacacaacttccatatgactattatttcctggactactgcaaacctgaggcgattaagaacagtgctgagaacttaggggaagtccttcgtggggaccgcattgaaaattctgtctataatttcaagatgaggagggacgagagctgcaaagttgtttgtcgaacaaaactttctgcagaagctgcaaagaatttcagagagaagatcgatgatgaatatcgagtcaacatgattttggataatctcccagttgtggtccctagacaggcacgggaaggaagcccaacaccgaactttgaccatggttaccgcgttggctataagctcaaggatgacaagtactatattaataatcacttgagctttaaagtcttgtaccatgaagacctgaactccccagaggctcgtattgttggcttccatgtgattcctagcagcattaagcatgaatatggtgcctgggatgacaagaatcctacagtacaaacttgcaatgctaacactaagataactcctggtagtcacacacctcaagaggtggcccctgatgcctatgttgtattctcttacgacgttacctttgaggctagtgagatcatatgggcatctcgctgggacgtctaccttctctctagcgacagccaaatccactggttttctatcattaactccttgatgattgtccttttcctttctggcatgatagccatgattatgatgaggaccctttacaaggacatagcaaactataatcagcttgacaatcaggaggaagcccaagaagaaactggatggaagttagtgcatggtgatgccttcaggcctcctgttcattcaggccttctttgcgtttatgttggaactggtgtgcagttctttggcatgacagtggtaaccatgatgtttgcgctacttggattcttatcccccgcgaaccgtggaggactcatgacggctatggtccttctgtgggttttcatgggtgtattggcgggttacacgtcgtctcgcctctacaagatgttcaagggcactgaatggaagaagattaccctcaaaactgccttcatgtttcctggtataatctttggggtctttttcgtcctgaatgcccttatctggggtgagaaatcatctggtgcagttccttttgggacaatgtttgctctggtccttctctggtttggcatctccgtgccactggtctttgttggaagtttcttgggattcaagcagccagccattgaggacccagtcaagacaaacaagattcccaggcaaattcccgagcaagcatggtacctgcagccagctttctcgatacttgcgggtggcatattgccatttggtgctgtctttattgagctcttcttcatcctcacatctatctggctgaaccagttctactacatcttcgggttcctcttcatagtcttcgtcattctgctggtaacctgtgctgagatcacaattgtgctctgctacttccagctgtgcagtgaggactaccactggtggtggagggcatacctgaccgcaggctcctcagctctatatctattcgcttatgctatcttctacttcttcaacaagctggagatcacaaagcttgtttcaggcattctctactttggttacatgctgatcatttcttatgccttcttcgtcctgactggcaccattggcttctatgcttgcttctggtttgtgaggaagatctatgcttctgtgaagatcgactgatatagctga

SEQ ID NO: 394 - DNA, 1084 bp, Sorghum bicolor
cacagagtgttctcctagcacgcagcagatcgggtgcgtggcgcagtcgcaatggcaatggcaatggccacggccaagctcgtcctcctgatggtcctcgtggccggcagctcctgcggcggcagcgcctggcgggggccactgagcctcctccggacgctgccgacgacgacggcggcgcagtccgtcgaggccgccgcggagcgcctgaaggaagacctgtcgtcggcggcgtcgtcggcgtcggcggcgtcgtcgctgatccacgcgctgcggcccctgatgggttccgcgggggacctgggcctgcgcgccggcgtgccgtgcgacagctggcgcctggccgtggaggcgtacaacaagcgcgactggacgacggtgccgggcagctgcgagggctacgtcggccactacatgctcggcgggcactaccgccgggactcccgcgtcgtcgtcgacgaggccatcgcgtacgccgaggggctcaagctcgccggcaacggcaaggaggtgtgggtgttcgatatcgacgagacgtccctctccaacctcccctactatgccacccatggcttcggcactaagccgtacaacgccacgagcttcaacgagtacgtgctggaggggagcgcgccggtgctgccggagtcgcagcggctcttcaagaagctcatctcgctcggcatcaagccggtgttcctgacggggcgcaccgaggaccagagggccatcaccgtcaccaacctccgccgccagggctactccggctggatggacctgctgctcaagcccgtcgggctcaaggccaccgccatcgcctacaagtccggcgagcggcagaagctgcaggacgccgggtacgtcatcgtcggcaacatcggcgaccagtggagcgacatcctgggcgcgccggagggtgctcgcaccttcaagctgcctgaccccctctactacattggctaattgagcgatgatgccacgttggcctccgtataattgttaatccatcgcagcggctctccatcagcccatcatcgatcgatccgtcgcccggttgcaatgcctgtgctgtttgtgatgaact

SEQ ID NO: 395 - DNA, 814 bp, Solanum lycopersicum
tcaaagaaattgctactctgtactgcaaaagtgaagaaagacatgggtgttgttcatactctgcattttgtttttgggatatttggaaatgccactgctctgtttctgttcttggcaccaataatcacattcaagagggttatacaaaatcgatctactgaacaattctctggcttgccttacgttatgactttactcaactgccttctttctgcatggtatggtttaccatttgtgtcaccaaataatctgttggtgtctacaatcaatgggactggagctgtaattgagaccatttatgtgctgatcttcattgcatttgcaccaactaaagagaagaagaaaatctcagcactttttctattagtccttactgtttttgctgctgtagcccttgtttccatgcttggtttacatggaagcaaaaggaagctcttttgtggtatcgctgccaccatcttctctatcattatgtatggatctcctctatccatcataagactggtgatcaagacgaagagcgtggagttcatgccatttttcttgtcgttgtttgtgttcttatgtggcgcttcctggtttgcatttggccttcttggcaaggacccttttgttgctattccaaatggttttggttttggtttaggaacagtgcaacttatcttatatgcaatctactgtgagaagaagggattcacaaggaaatcaaaccttgatgagtcaaatggcaagtctcaccaagaggagaagcaatctagcaagtcaaagcttgagcaagtttaggacatgattgcctctaattcttcttgaatga

SEQ ID NO: 396 - DNA, 1645 bp, Brachypodium distachyon
aaaggatcccgaggatttccggactagcgtaccatggcgccatttcccgtctctcctccttcctcgggcggcggtaaacaagctggtgcagtaataggcagtccaagatcatcgctgcagaggagcagcagcgagtgcaacgtggtggtgcagaggaacatcaagtcctcgctgctgctcctgctggcgatctccgccgtcttcgccttctccatcctctactcgtctcgtaacctgaccgtggcgaccatggccggcgaagcggtgacgcagggacccttgctcgcagcccttgacatgggccgtatggtgcatgacgacgaggccgttgatgggccagccggcccagacacggacgtgaatgaacagcgcggcggacccgcagatgacgtctccttgccggcggcgaacgacccatcggctgctgcagtagtagcccctgcaccgagcacagctgaccaaacagctggtctaagtatgcagcttgaggagaaatgcgacatttccatggggaaatgggtgaaggagccgaaaggtccggtgtacaccaatctgacgtgcccgatgctgccggactacaagaactgccagaagtacggcaaggacacgggccacctctactggcgttggcagcccgacgggtgcgacctgccgcggttctccccggcgcggttcctcgacgtcgtccgcgggaagcggctcgccttcatcggcgactctctggcccgcaaccagatggactccctgctctgcctcctgtcgcaggccgagacgccagcggaagtgtactcggacgcgctggacaagttcgggacgtggcatttcccggcgcacaacttcacgctgacggtgatgtggacggagttctacgcgcacgccgagccggtcctggactcgtccgggaagccgacggcctcgttccacatccacctggaccggctcggcgccgactggacgagccggctgcgggacctggactacgccgtcatctccggcggcaactggttcttccgcgtcaactacctctgggaaggggggcggctcgttggctgcctcaactgcggcggcaaggggaacctgacccaattcggcgtcgcggacgccgtccgccgcgtcgtgagagccgccatcgagggcatcgccaagtgcaaggactgcaagagcggcctcgtgacgatcctgcggacttactcgccggaccacttcgagcacggctcgtggttcagcggcgggtactgcaacaggacgcagcccctggaggagcgcgaggtgagctttgagagcgtcgggtgggagctgaggaaggtgcagagggaggaagtgaggcgggcgatgaggaaggagaacttggcgagcggggccgggaagaggtacttcggggtgatggacgtgaccaaggcgatgatgatgcgcgccgacgggcaccctgatagacactatgacaagcggtgggtgaggaacggcagcgactgcctgcactggtgcctgccggggccggtggacatgtggaacggcgtgctgctccagaggctcgccgagatcgatcccgcaccgctgccgatcgatcgtggtgaggtggtcaattagaggagcctcacatggtttcgcgtcgccgtgagcccgtgatcttgtttatggtaccttt

SEQ ID NO: 397 - DNA, 900 bp, Gossypium hirsutum
acaaccatccatctcagctttcttatccttcctcccaccactagtctcccccttacccgaatctaaaagactaaaacccaaccctcaccttcctctctttcttcatcatcagcaaagaaatataccagaaaatcaaaaagaagaagaaaagagatccccaagatgtctcttacaatcccaactaatctctcaaaatcaattttgaagccaaagctggagacccaagtgatccccaaggcttcatccagatcattgattgtatgctcctccagcaatccttcctccgacaaatcggcttcaccactccaggccttctcagcggctctggctctttcttccatccttctttcagctccactccctgctgttgccgacattgcggggctcactccttgcaaagagtccaagcaattcgccaagcgcgagaagcagcagatcaagaagctggaatcctcgttgaagctttacggccccgatagcgcaccggctctcgccatcaaagccaccatcgagaaaaccaagagacggttcgacaactacggcaagtacggcttgctctgcggctccgatgggttgcctcatttgatagtgagcggcgatcagaggcactggggtgagttcatcacgcccggcctgttgttcttgtacatcgctggatggatcgggtgggtcggaaggagctacctcattgctataagcgatgacaagaagccagccatgaaggagatcatcatcgatgtgcctttggctaccggtctcatcttcagaggctttatttggcctgtcgctgcctacagagagcttatcaatggtgaccttgttgtcaaggacgtttaatcttatcttcctcagagattgaatggaacaacaactaggatgcgaagactgactttgttctag

SEQ ID NO: 398 - DNA, 1237 bp, Glycine max
tcacaattaacaaatcctcgaaacaaaacaaaaactggggcgggcacgaagagcagagggaggaagaaagggtcgaagagaatgtgggaatcaattgttttgacggtggttgccaccgccggcaacaacatcggcaaaatccttcagaagaagggcaccgtcattcttccccctctctctttcaagctcaaggtcataagggcatatgctttgaacaaaacctgggtgataggttttctaatggatatatttggggcactgttgatgttaagggcattagctcttgcgcctgtctctgtcatccaaccagtttctggctgtggactggcaattctctcagtcttttctcatttttatctcaaagaagtcatgaatgttgttgattgggtgggcattaccttggcaggttttggcacaataggagttggtgctggaggtgaggagcaagaggctgctgctctatctattttccacataccatggctggcatttgttgttttcatcttgtttataatgcttaatggatggcttcgtatattcaaacgtaatcgaagagaacaagagatgatggaatatgatgttgttgaggaaattatttacggcttggaatctggaattttgtttgggatggcatctgtaatatcaaagatggggtttctgttcttggagcaaggcttccccaagctgttggttcctatttgcatcatcataagtgtctgttcaagtggtacaggcttttactaccagacacgtggtctaaaacatgggagggctattgtagtttctacatgtgccgcagtggcatctattttgactggtgtacttgctgggatgcttgctttgggtgagcgactcccttcggccccaaaagctcgctttttacttcttcttggatggctacttattattgttggcgtgattttacttgttggttcaacaaagctagtgagattctttcgattttcttcacaccactttaaaagaagcagcgttgataagaattatggccctagaagatctggaacttcccgtgttagggaacctagcccaactgctgtcattcaagcggctaccttaaatcatttactctcatcatcttccaaagaaaaagcttgatttgacttgagctggaaaatgatccttcatccattctcaggattcaccctcaccccttaaagaagaagaccccttttgtaaggctagattgtttgtgtacagtggttgctttatcagaggg

SEQ ID NO: 399 - DNA, 481 bp, Hordeum vulgare
accacgatcgagagcagagcaccccatgggggcgaggcagcgcggtgagagaggcggtatgccgacgacgaccacgaggtcgaggctggcggacgcgtcgtcgtggtgcctcgcgctgtcggcgctggcggcgctgctgctggtgtgctcgctgggggagacgacggaggccgtcaccgtgcggggcgcgtcgctgtcggcgcggtggcggccgtgcgaggagatctacgtggtggcggagggcgagacgctgcacggcatcagtgaccggtgcggcgacccctacatcctggagcgcaacccgcacgtccacgaccccgacgacgtcttccctggcctcgtcctcaggatcacgccctccagccccaggccgtccgtccccgctagccccccgtaggtaggccacaagaaagaagagactggttgttctggagaatcgttccagttcgctacgatgaactctgaatctctgatttgcgag

SEQ ID NO: 400 - DNA, 1144 bp, Hordeum vulgare
gttctgaaaccacgacccacccagcagccagagggaaagggggagaaggagacaccgcggcgggcggagaggcaatggcgacgacgacgtgcctgctggcggcctgggcgctggtcgccgccggactgttcggcacgggcctcgcccgggcgtccttcgccccggccgccgtcgggaaggagcagcgcgagttcgactacttcgcgctggcgctgcagtggccgggcaccatctgctcctccacccgccactgctgcgccgtcaacggctgctgccggaaggagccgctccacacgttcacgatccacgggctgtggccggactacgatgacgggacctggccgtcgtgctgccgccgcaccagtttcgacatggacaagataacgcctctgaagcccacgctggacaagtactggccgtccctctactgttcgtcctcttccacttgtttcagtggtaggggccccttctgggctcatgagtgggagaagcatggaacatgctcggcccctgctgttcgggaagaattacagtacttcagcactgcccttgatctctacttcaaatataacgtgacagaaatgttggcgactggagatatcctggtctccaacggtaaagaatatgcactgagtgatgtcattgacaccatcaagcatgcttttgggggctcaccgcagatcatctgcaagaagggctcagttcaagaactaaggttatgcttcaccaaagatttgaagcctcgtgattgccttactacttcggcaatgtacaagaacctatcgaaatcaaagcattgccctcgaaaaatctccctgccaacatatgatcccatcgtactcgccaattcaacactggagattgtcccagaagccagcgacaatgggctgtacttctttacatcctaagatactgagcattgctgggttacgaggaaacagatgccttcacggccccgactgcttgcaagatctgtagccagagatgctgggcactaagatcccagtaaaatgggtctctggtttgtccatgctatttgtaaaggagaacattccacattagaacaacttagttcaattatgttctgaatatttgtaaaactgctggaaatcaaatactcagctcagatgcctcgttgtatgaa

SEQ ID NO: 401 - DNA, 1066 bp, Gossypium hirsutum
gtcaaacaaacagccagaagcagccagccagccctcgtttccctcattttcctcttcattttctcgggaaaaaagaagcatgggaaaaggtcctggtctctactccgatatcggcaaaaaggctagagatcttctttacaaggattaccaggttgaccacaagttcactgtcactacttacacttccaatggagtcgcaatcacatcaaccgggactaagaaaggtgaattgcttttggctgatgtaaatactcagctcaagaacaagaacatcacaactgatgtgaaattcgactccagatcgaatcttttcaccactgtcactattgatgaacctgcaccaggattgaagaccatctttagtttcgttgttcctgatcaaaagtctggcaaggtggaactgcaataccggcatgaatatgctggcataagcactggcattggattgactgcaaagcctcttgttagcttttctggtgttattggaaacgattctgtctctgttgggactgatctctcatttgacactgccagtggaaactttatcaaactgaatgctgggttaaatatcacccattctgacctcattgcttccatgacattgaatgataaaggtgatactcttactgcttcctactaccacattgttagtccattgactaacacagcagttggtgcagagctgacccatagtttctcgagtaacgagaacactctcactattggtacgcagcatgctcttgacccattgaccacagtgaaggctcgtatgaacaactatggcagagcaagcgcactgatccagcatgagtggcgcccaaaatccctcttcactatatcaggagaggtggacaccagagcaattgaaaagagtgctaaggttgggttggccttggcactcaagccataggtaaatttattatcattgttgtgcagttgaagggaaggccataaatttgattggtggagacttggagagaaataatgtactttttacggatttgacattgatggtcatggccctcatggattgtaaaaataattgtgagtggcaaactttagcgat

SEQ ID NO: 402 - DNA, 1399 bp, Gossypium hirsutum
cgtgtttccgatttacattcaatactataaagctttgagcttttattttttcttctcatcacttgtttatttttcagtcttctcttctccctctcatggctttagaaacccctaaccacactcagacggtagcaggatgggcggcttatgattcctccggtaaaatcgccccttacatcttcaaacgaagggaaaatggcgtcaacgatgtgaccattcaagtgatgtattgtgggatctgccacactgacctccaccatgttaaggacgactggggtatcaccatgtatcctgttgttcctgggcatgaaataacgggtgtgataaccaaggttggaagcaacgtgaagaatttcaaactaggggacagggtgggggttggttgcttggcagcatcctgtttagagtgtgaattctgtaaaaactcgcaggagaactactgcgatcagatccagttcacctacaatggtattttctgggatggtaccattacttatggtggatattccgatatgctagttgcagatcacaggtacgtggtccacgtgccggataacctgccaatggatgcagcagccccactattgtgtgctgggataacagtttttagccccatgaaagattgccaactgctggagtcacctgggaaaaaagtgggaatagttggcctggggggtctgggtcacgttgctgttaaaatggcaaaggcatttggtcatcaagtaaccgtcatcagcacttctccgtcaaaagaaaatgaggctaaacagcgtttgggcgctgattatttcctagttagcacagatgctaagcaaatgcagagaggtaagaggtcgctagatgttattttggacactgtctcagctaaacactcactcggaccaatcttggaactgctcaaagtaaatgggactttggtagttgtgggggcacccgacaggccaattgagcttccttcttttccattaatatttggaaagagagcagtaaagggaagcatgacagggggtatgaaagagacgcaagaaatgatggatgtgtgtgggaagcacaacatcacgtgcgatgtagagcttatcaagccagataaaatcaacgaagctttggaccgccttgccagaaacgatgtcagataccgttttgttatcgacattgccggaacctctaagctttgaagatggaatcagtgatcccttgcatgttccttggcaatcgattcatctatatctatttgttttactctttactacaaccagttgttttattggtcgtcatcttcaatcttcattaagtggtggtgttgtaacattacataaatcgagtttttcatcactttttttggttatttcgtgtattaaattagaagaatcatgctatcttctccttgaaacgactttgc

SEQ ID NO: 403 - DNA, 1252 bp, Solanum lycopersicum
gttcccacactcactcatctttgtagatctttaattaagaaagaagaatggctcaaacaacacctaatcacacacaaactgtttctggttgggcagctcatgattcttctggcaaaatcacaccttttattttcaagagaagagaaaatggtgagaatgatgttaccattgagatcttgtattgtggaatgtgtcatacggatattcatcatgttaaggatgactggggcattactaagtaccctgttgtgcctgggcatgaaattactgggattataacaaaggtgggaaggaatgtgagtaaattcaagataggagacagagtaggggtaggttgcttggcagcaacatgtttgaagtgtgagtattgcaaggggtctcaagagaactactgtgaccaagtggaattcacttataatggcatcttttgggatggtagcatcacttacggtggctactcaaaaatgcttgttgctgatcataggtacgtggtatgtataccagataacatggcaatggacagagcagccccattattatgtgcaggaataacagtttttactccttttaaagacaataatttggtggatacaaaaggtaaaaaaataggaataataggtcttggtggacttggacatgtagctgtcaaatttggaaaagcatttggacatcatgtcactgtcattagcacctctccatccaaagaacaagaagccaaacacaacttaggtgctgatgattttataataagcactaatcccaaacaaatgatggaaaagaaaagaactcttgactttattttggatacagtatcagccaaacactcacttgggagttacttggagcttttaaaagtgaatggaactttggtgattgttggagcaccagataagccaattgatttgcctgcttttcctatgatttttggaaaaagaacagtgaaaggaagcatgataggaagtatagaagagacacaagaaatgatggacttatgtggaaaacataacatattaagtgatatagagattatcactactgatcaaattaatgaaggacttgaaaggcttgctaacaatgatgttaagtaccgttttgtcattgacattgctggtccatcttctcatctttaatttgaaatttatatatttatttttgtgtgtgtaatttacatttcatttaattccgattccctgaatttgtatttcttaatattatgatgttgttcatttacactttgtttggtggttcatga

SEQ ID NO: 404 - DNA, 2789 bp, Sorghum bicolor
gggcaatgggcgccgctcagttggtgattctgttcttggcgcttggcgccgcgatgcgggcggcgtcggcggcgggggcgcggccgagcgaggtgaccgttggcgctctcttcacgtacgactccacaattggtcgcgcggcgcagcttgccatcgagctcgccgtcgatgacgtcaacgcggacggcaaggtcctcccggggacccagctcaatttggtgccccaggacaccaactgcagcggctttattgggaccatcgaagcgttgcggctaatggaaaaaagcgtagttgcggtgattggcccgcaatcctctgggataggccatgtcatctcccatgttgttaatgagctacatgtacctcttctatcatttgcggctacagatccaactctctctgcatcagagtatccgtacttcatcaggacaaccataagtgactacttccaaatgaatgccgttgctagcattgttgattactatcaatggaaaagggtgactgctatattcgttgatgatgattatgggcgaggtggcatggaagccctcggtgatgcgcttgcattaaagagggcaaagatttcatataaagcagctattcctccaaattcaaatacggatgtgatcaatgatgtactatttagagcaaatatgatggaatcaagggtcatggttgtgcatgtcaatcctgacacggggatgagaatattttctgtagctaagaacctccaaatgatggccagtggctatgtatggatagtaactgattggctagctgctgtccttgattcctcagcatatagagatcttaaagatatgggtcatattcagggactaattgttctgcgtcagcacattcctgaatctgaagccaaggataagttcatatctaaatggaatgatgtggctcgtaacagaagtattacttctggcttgaactcatatggtttttatgcttatgactcggtttgggctgttgctcgtgctgtcgataaatttctcagtagtgggcaacagatcaacttctcaacagatcccagattacaaaatttaaatgacagcacgttgcatctatcaactctgaagatatttgatggtggtgagcagatgctgcagcaacttctactctccaaatttacaggtgttacaggtccagtccagtttgattcagaccacaatttggtacgcccagcgtatgatatccttaatattgctggctctggctcccgcttgattggctattggtctaactattctgggctttcggtggctgctcctgaaattttgtatcagatgccacgaaatacatctacaagtgcccagcagctgcatgatgtggtatggcctggtgattccactactaagcctcagggatggatattcccaaacactggccaacctctgagagttggggttccaattaaagcaagctttaaggaattagtgtcaggcagaggagataacatgagtggttattgcgtcgagatattcaacgcagcaattaaactgcttccttacccagttccttaccaatttataactattggggatggcacaaaaaaccctagctatattgacatcattagaatggttgctgccaattcacttgatgcagctgtaggcgactttgctatagtgagaaatggaacgcagcttgcagaatacacacagccttatattgagtcagggcttgtgatagtagcgcctgtgaaacacgtaacttcaagtgcctgggctttccttgaacctttcacattggagatgtggtgtgtcacagttgctctttttattttggtgggtgtagtagtttggcttcttgaacatcgtactaatgaggaatttcgaggatctccaaggcgacaagtcataacaatgttatggtttagcttctcaacaatgttcttcgcacacagagagaacactgtaagcacacttgggcggttcgtgttgataatatggttgttcgttgtgctgatcatcacttcaagttacactgctagcttgacgtcaatcctcactgtccaacagctctcaactggaattacagggattgatagtttggtttcaagttctttacctattggataccagaatggaaaatttaccaaaaggtacctgagtgaaaacttcaatgttcctctctctcgactggtgccactgaatacgatccaggaatatgctgatgcccttaaccgtggaccaaaatacggtggtgttgctgcaattgttgatgagaagccatatatagatatcttcctgtcaaactactgcaaattcagaatagtgggagaggaattcacaaaggaaggatggggctttgcattccagagagactcccccctcgctgcagatttatcaaccgccatccttcaactttcagagagtggccaacttcagagaatccacgacgagtggttctcacggtctagttgctcctcagatgacagcgaagtgggagcaaccaggcttggcctcggaagcttttggggcctcttccttgtgtgtgccctgatatgcctcttcgctctgctggtattcttcatacgggtctgctggcagtacaaccagtactccagttctgaatcttctggcgagcccagcgcagccacccctggtcctgtcataagacagcggcgactatcacgccttggcagcttcaaagagctgatccagtttgtcgacaagaaggaggaggagattaagaaaacgatgaaacgaagatcaagcgataaagatagccaagctgcaggattctcatacgctcagtcagtggcttcagcttagtag

SEQ ID NO: 405 - DNA, 1953 bp, Solanum lycopersicum
aaagtcgaccattaagataagacgacgacaatcgaaagatggccggtggtggtggtggtggaagatcgttggagcaaacgccaacttgggcggttgccgttgtttgttttgtgttagttgcaatatctattgtcattgaacatattatccaccttattggaaagtggttgaagtctaaaaataaaagtgccttgtatgaagcacttgaaaagatcaaagcagagcttatgctgctgggattcatatcattgttgttaacagtaggacaaagtccaatttcgaacatatgtgtatcagaaaaattaggaaattcatggcatccatgtagtaaaaaagaagaagatagtagtataatttcagaagattcgttgtcggagcaacaccgccggagacttcttatggatgctgccggcggtggcgtacgacgaatattggctggtggtggtggagatgacaaatgtgcagcaaagggaaaagtaccatttgtgtctgctgatggaattcatcaattacacattttcatctttgtgctggctgtatttcatgtcctctattgtgttacaactttggctttggggagagctaagatgagaagttggaagtcatgggaaaatgaaactaaaacagctgaatacgaattctctcacgatcctgaaagatttcgatttacaagagaaacatcatttggaagaagacacttgagcttttggaccaaaaatcctgtcctactttggatcgtttgtttctttaggcaatttgtaagatctgtcccaaaagttgattacttaacacttaggcatggatttattacggcacatttagcaccacagagccaccaaaaatttgatttccgaaagtacattaaacgatcacttgaagaagattttaaagtggttgtaggaatcagtcccccaatatggttcctcgccgtgctcttcttactctttaatactcatggctggtattcctatctttggctaccattcatccccttgattgtgatattattagtagggacaaagctacaagtgataataacaaaaatggggctaaggattcatgaaagaggagaagtagtaaaaggggtacctgtggttcagccaggggatcaccttttttggttcaaccgtcctcgtctcattctttatcttattaactttgttctctttcagaatgcttttcagttggccttctttgcttggacttggtatgaatttgggttgaaatcttgttaccatgaccatactgaggatattgtcatcagaattactatgggggtcctcattcagattctgtgcagttatgtcactcttcctctttatgcccttgtgacacagatgggttcaaacatgaaatcaactatcttcaatgaaagagtagcaacagcattgaagaattggcaccacacagcaaagaaacatgtaaaggatcaaagcaagcattctaatccagtgacaccaatgtcaagtagaccagggacaccttctcatcatggcatgtcacccgtgcatttattgcgcggacattataggagtgatatgggcagtctacaaaactcacctcgtagatcaaactacgattttgatcattgggacaacgagggctcaccttcaccctcccggttttaccaggaggctgttgatggctcattgcaccatattcaacttggtcaattggaccatgaactgcaacaagttattgagcctaattcgtcacaagtggttcctctatcacaagagggtcgcgaccaacatgagattactattgctggatcaagagatttttcgtttgagaaaagaacaaccagtatatagatattattatttaattaacaaggagcacattaatactatattctatattatttttattaatttatatacttgatttcggagaaataacgattgtaaagttgcagcaatggatgcacggtgtaaatttgtaggatccttt

SEQ ID NO: 406 - DNA, 711 bp, Solanum lycopersicum
ttcccaatcaagttcaagatggtaaagaatgaagtgatggtggatgaaattccttttccttcacaattcatggtgaataataagcctttacctttgatgggccatggaataacagatatagagatacattttctccaaattaaattcacagcaattggagtttacttggatccagaaattgtgactcatttgcaacaatggaagggcaaaacaggggcagaactaactgaaaatgatgaattctttgaggctattgtgaatgctccagttgacaagtttttgagagtagtagtgattaaagagatcaaaggttcacagtatggtgtgcagctagagagtgctatacgcgatcggttagcagaagtcgataagtatgaagaagaagaggaagaagcactcgaaaaaatcgttgaatttttccagtctaagtatttcaagaaagattcagtaataacatattattttccaggtgcttctgggagtgcaaagatatcgttcgcgatagaaggtaaggaagacttggaaattgaagtggaaaatgcaaatgttgtagagatgatgaagaaatggtacttaggtggaacaaggggagtgtcacctacaactatttcttctttggctaacaacatttgtgttgaattgtctaaataaaagacattatgtgttgtgtttgttgttttggtcatgttggcttattgtatttggccttag

SEQ ID NO: 407 - DNA, 854 bp, Hordeum vulgare
ttctcttgagtcttgacctctgcaagaaaacaatgggatcggagcaggagaagaagccggccgccacagtggaagtggagggcattccgttcccgcgggaaatcgccggcgccaagacgctctcgctcgtcggccatggcgtcacggacattgagatccatttccttcagatcaagttcaacgccgtcggggtctacctcgacgtcgacggcgccatggagcacctgcaaggctggaaggggaagagccagctgatggaggacgaggctttcttcgacgcacttgtctcggctccggtggagaaggtgctgagggtggtggtgatcaaggagatcaaggggtcgcagtacggcgtgcagctcgagagctccgtcagggaccgccttgtggcggcggacaaatacgacgacgaggaggaggaggcgctcgagaaggtctccgacttcttccagtccaagtacttcaggcccggctccatcgtcaccttccacttcccggccacggccgccgccgcgccagagatatcgttcgtcacagaaggcaaggaggaggccaaggtggcggtggagaacgcggccgtggcggagatgatccagaggtggtacctcggcggcgaggcggcggtgtcgcagaccaccgtcaggagcatcgctgatggtttcgcggcaatgctctcctcagcatgattctttttacaagtgatgcgtgcttgcttttgcaataaatccataagtcacgatgaaatatttcaaaaagacacttgctcaaatcatttttaaatgtccaaacgggatgattcgtacttctttacactttttttgccgtataatgtggcacatcaaatgtctgcggac

SEQ ID NO: 408 - DNA, 443 bp, Gossypium hirsutum
gaaaggaaatggaaaacgtgattcctcagcaatgggcttctccttgtggaaatcaatgcactcacaaatacgctgctctcatgcaaattccttggagagtgttctgcaaaaaagggtgtaatgcggatggagacacttgggaagagtgtttagcagagtgtgatgagatatgctataaggatcctgtattaaaggatcagcaatggagtgcttacatcgatcgctcccctggagctgtcaattactctcaggactgcttcaatgcttgtgtaactggctgtggttataagtttgaaatttgtaaagagaaagttgatcaagtcagaccaagaccattaccatccgagcctcttccagaggtgaaaccaccaacctcgcctgcagccactaaacctgatgaacccgctgaagatgtaccaagtacttcagcgtagcaagagtag

SEQ ID NO: 409 - DNA, 763 bp, Zea mays
caaccagcactcactcactagctacgtccaactcgtacacaacccctctttctctctatcttctctccatccatccatcctctcgctcgcccttcgacagctagctaagcagtacgacgtagtatactagcatttagcagttcatcaacgcgctcaacctagcacgacgtacggcgatgaggcgccgcggcagcaactcctcgccgcttgcggctgctgccctgcccctcctactcctcctcgtcgccggctgcttccactgcatggcagcggcggctcgccacctgccttctcctggcgccccagtccaagcgctggatcaccaagccgagaacggtgtcaaggctgcatcagctggtgcagacggcgccggcggccttgtgctccaggaaggtggcacgggcaacaacggcgacgacctctcctccaaaaccctcctcgagacgacgacgacgacgatgggagcggaggcgtgcgaggaggggaacgacaaggacgagtgcgtgcagaggcggctgctcgtcgacgcgcacctcgactacatctacacgcagcacaagggcaagccgtgaccgtcagcgacgaggacggtgcatgccgcggctgcagaaaatgaggagcggaagaggagtgaaaaaatgatggaccatcctcaaaccaaatatcctataaattcacgcacaaggggaaggggatagtaatctcatctgctgctgctagctactagtacacgcatcgatcgaccttctgcgtgtgctgtata

SEQ ID NO: 410 - DNA, 1806 bp, Zea mays
ccacctcctctgcgctccccgttccccaggtcgcgcgcacccgctcccgcaccggagaacccacccgcacgccggcctcgtcccgagatggcggcggcgctgcgcttcccgggggtcgcgagggagtctctgtctctggacgcgcccgtcgccgcctccaagctcgggagggagcggcgcccggcccccgcgagcgcgaacccggggccgcaatgctggaggcggaggaggggcctggcggtgcgctgccagacggggtccaccgcaccgcccgtccttaggacggaggaggcccccgcggctgcggcgggggcaaggaatgcccaggcggggttcaccgtcgtcatgaagttcggcggctcgtcgctcgcgtcagccgagcggatgcgggaggtggccggcctcatccttagcttccccgacgagacgcccgtcgtcgtcctctccgccatggggaagaccaccaataacctcctcctggccggagagaaggcggtgagctgcggcgcccccaaggcgtccgaaatccctgagctcgctgtcatcaaggacctgcatcttaggacggttgatgagctcggtttagataggtcgattgtttcaggtttattggatgaattggagcaacttcttaaaggagttgctatgatgaaagagctgacccttaggacaagagattaccttgtttcctttggtgaatgtatgtcgacaagaatatttgctgcatatttgaacaaacttgggaaaaaagcacgccagtatgatgcatttgatattggctttataaccaccgatgatttcacaaatgcggatattcttgaagccacttaccctgctgttgcgaagaggctacatgaagactggatggatgaccctgctattcctatagtcactggttttcttgggaagggatgtaaatcatgtgctgtcaccactttaggcaggggtggtagtgacttgacagctacaaccattggcaaagccttgggattaagagaaatccaggtttggaaggatgtagatggtgtgttgacatgtgatcctaatatatatgcaaatgctatacccgtgccctacttgacttttgatgaggctgctgagcttgcctactttggtgcacaggttttgcatccccagtcaatgcgaccggctagggatggtgatattccagtgagagtaaagaactcatacaatcgtcatgcacctggtactgtcatcactaaatccagagatatgagcaagagcatattgactagcattgtgttgaaatctaatgttaccatgctggatatagtgagcacaaggatgcttggccaatacgggtttttagcaaaggtattctcaatatttgaagatttgggcatctccgttgactgtgtggctactagtgaagtcagcatctcgttgactctagatccatcaaaactatggagtcgtgaattgatccagcaggaacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaaggtgaacatttccttggtagtcaatgacagtgaggcaaaacagtgcgtacaagccctccattcagcgttctttgagaatggcttcttgtcggaggtagagggagctgacgttccccagaacggagcctctctgaactcaaatggccctgtctatggaaactagtcgactctgtag

SEQ ID NO: 411 - DNA, 1982 bp, Solanum lycopersicum
tcaggattgcttgattattggagtatattttcagcagggggagctaattagctaagttaattggctctctctgctttttgcaaaacccgagtcacttcattcgtcgaaagaactttattgtcatttatatccttttttggagttcccttagctgatttattatggcaacattgtcacatttttgtggggttaaaactccctgcccttctatattcaaaagaagcgtgcatttcccacaacttgattttgtggctactgtcccctttgtttctgctccaagtaaatctgtgaaggtttcttgttgtgaaagagtgcagagactggtatgtaaagcacaagcagctgatgttaatcctaaagagaccaagaatgaatcttttggtgaggctcctgatgaattgacatgtgttatgaagtttggtggttcatcagtagcctcagccgatagaatgagagaagtagctgatcttattcttagctttccagaagagagacctgttattgttctctcagcaatgggaaagacaacaaacaaccttttgctggctggtgaaaaggctcagagttgtggtgtttccaatgtttctgatctgcaagagttggcttttataaaggagctccatcttaggacaatagacgaacttggagtagagagttctaccatttcaaagcatctactcgaactggaacaacttttgaatggaattgctttgatgaaagagttgactccacgagcaaaggactacttggtgtcctttggagagtgtatgtccacgagaatattttccgcatatctgaataaacttggtgtcaaagcccgccaatatgatgcatttgagatgggtattataactactgatgattttactaatgcggatatattggaagcaacttatcctgctgttgcaaagagattaactggtgattggatgagtaatcctgcaatccctattgtcactgggtttcttgggaagggttggagaacctgtgctgtgactacactaggtaggggtggtagtgacttgactgctacaacaatcggtaaagcattgggattacgtgaaattcaggtctggaaggatgttgacggtgttttgacatgtgatcccaacatatatccacgtgctgagactgtgccatatctaacttttgatgaggcagctgaacttgcatactttggtgcacaggtccttcatccacagtccatgaggcctgctagagagggtgatattcctgttagggttaaaaactcgtataatcctaaagctcctggtactctcatcgttaaaacaagagatatgagtaaggcggtacttacaagtattgttcttaaacgaaatgtaaccatgttggatattgcgagtacccgtatgcttggtcaattcggcttccttgcaaaggttttctccatctttgaagacttagggatttctgttgatgtcgttgcgacaagtgaagttagtatttccttaacattggacccatcaaaactttggagcagagaactaattcaacaggcaagcgagcttgataacgttgtagaagaacttgagaaaattgcagttgtgaagctacttcaaaacagatcaatcatctctcttattggcaacgtccagaggtcctcgttgattttggaaaaggctttccatgttatgcgtaccaatggtgtcaacgttcagatgatctctcaaggtgcatccaaggttaatatctcgttgatagtaaatgatagtgaagcggaacaatgtgttagggctctccaccattccttcttcgagagtgatctttctgaactagtctgggaaagtcaatctggaaatggctatgctactactacttctactcccttgcccacgttgtccaattaattttccttcgatttctccttcgtatgattgttctttccaataatattttctaggaaatgaatgaaattttgctagtactttttggagtgtgggtgcagtttcgtcgttgtaaca

SEQ ID NO: 412 - DNA, 1136 bp, Solanum lycopersicum
tctgcaagtagcttaaatttgcttctaacagatccatggctgaaaatcaaaaaacagttttcaagtcagtacaagaactagcaaatgaaaatcaagttccagaaaagtatattcatacacaagggtcaatcaatagctcttgtcccatgctgaatgtgccagtagttgaccttagacttctcacatccactgccagaaaacaagagctcaacaaacttcaatcaggcctcaagttttgtggctgcatccaggtcataaatcacggactagcagattcatttcttgacaaagtgcatgaaattagcaaacagttctttgctcttccagctgaagagaagcttaaatatgccagaacagttgatgacatttatggatacggaaatgattcagttctttcagataagcaaaagcttgattggactgacagattgtatctaaatgtgtttcctgaagctataagaaacctcaaattgtggccccaaaaacctgaatgtttcagggaagtttttgaagaatatatcaataatatgaagttgttgagtgagtccctccttaaggccatggcagtgtcgttgaacttggaggagaactgctttctggatcagtgtggagaaggcagagagatgattgcaagattcaacttctatcctccgtgtccaacacctgaggttgtacttggaatcaaaccacatgctgatgcatcggccattaccatccttttgcaagacaaagaagttgaggggcttcaggttctcaaagatgatcaatggtttagagtacctattgtaccatatggtctcctcgttaatgttggagatcaagtagagataatgagcaatggtatctttaagagccccgtgcacagggtggtaacgaatgcagaccaagaaagaaacacccttgctgttttcattatgccagatgtaactgatggaattggaccagtggagaagcttatcaatgaggaaatgccaagagcatacaaagacgttaagaattatgttgaactcttcttccaaagctatcagcatgggaaaagaccaattgaaacagcaatgatatgccaagaacaagattagttgtcaacaaaaagctccctttcttgttattccatcaaacccgctacagtatgctag

SEQ ID NO: 413 - DNA, 1243 bp, Vitis vinifera
cgaagaacagatgaagaagaacgcataatgatggagtgggaagcccaagaactccagcagcagccgcagcatcacaatcagaatcagaatggggttgttgttggaggagggagtggagggttgtacgtgaaggtgatgactgatgagcaaatggagctgctgaggcgccagatctcagtctacgccaccatttgtgagcagcttgttgagatgcacaaggccattactacacaacaggacctcgctgggatgaggctggggaatatatactgtgatccattgatggcatccgctggtcacaagatcagtagcaggcagcggtggactcctacgcctgtgcagcttcaaattcttgagcgaatctttgatcaaggcaatgggactccaagcaagcagaagattaaagagataaccactgaactgacacaacatggccaaatttctgaaaccaacgtctacaattggttccagaacaggagggctcggtcaaagagaaagcaatcagttccattaccgaataatgctgattcagaagtagagacagatgtcgagtctccaaaagagaagaagacaaaacctgataatatccagtcccatgagaactcagctctggggactgaaaatatatacttccagagtccggaaatgggaagtgaaatgcattgcttggatacacagcctaacaaaggggagcccatgtttccatctgatcacagtttaagatcttctggcagcttggggcattcatctttgtacgaagccggggttccaaatccaagaatggaccagttgatcggtaaagtggaagttcctggtagctttagtccttatcggcagggaggggaagggtttgacatggttggatgatctgcccacccttgatgtttgttcttgtgctcacgtacaagcttatcaaacataaggtaatgggttatatttacagttaaagaagacgtttagttaacgatatatttatatatatggaccaacgacatagcagcatttacaagtatacgacaagaagttagaatttggcagatttcttagggttaagaatcaggtactggtagcatatatactatataatccttacatttctgattccgatgaactggtttctttgaaattgatgaggttttgaaggtgagtgaaatatagaatccatttgatatggtagtaaagcttgcttgtggcttttttttttcggtggggaaatatgttgctggtgttgagtttcaggttt

SEQ ID NO: 414 - DNA, 1058 bp, Vitis vinifera
gagcgatgtgggaatcgatctgcctaacgttagctgccaccgctggcaacaatatcggcaaagtccttcagaaaaagggcaccgtgattcttccaccgctctccttcaagctcaaggtgattagagcttatgctttcaataaaacttggattgtaggttttttgatggatataattggagctctattgatgttaaaagctttgtctcaagcccctgtatctgtaatccaacctgtttctggctctggtcttgctattctttctatcttttcccatttttatctaaaggagatcatgaatcctattgactggatggggattgctatggcagggattggcaccataggagttggaactggaggggaggagcaaaaggcttattcgatatcaattttccacttgccttggctagcattcagtgttgccatcttgtttgtacttcttaatggatggcttcgtatctacaggcgtcaacgaaaagtacaggagatgatgcaatctgaagttgttgaggaaatcatatacggcttggaatctggcattttgtttgggatggcttccgtcatatcaaagatgggatttgtattcttggagcaaggcttttccaagattctggttcccatatgcatttcgatcagcatatgctgtagtgccacaggatttatttaccagacgagaggcttgaaggatgggagggcaattgtagtgtccacatgtgctgctgtggcatcaatcttgactggtgtacttgctgggatgcttgctctgggcgaacaacttccttcagctccagatgctcgtctttcgcttttatttggatggctacttatcattataggagtgatcctactagtaagttcgacatggctagtaagacaccttccacgaccattacgacattatgttcaaagtggtgttgagaggaattttggcgtcaagcattctggattgcgttctggaacacgtgttagggattcaagtccaagtgcagttatccaggcaagcacattgcatcatttgataacgtctcctgctaaagcgaaggcttgatgaggtacc

SEQ ID NO: 415 - DNA, 854 bp, Sorghum bicolor
aaaggatccaccctgcaagcgtcatgggcagcgagtgcaaggaccaccttcagcttcacgccgccggctacggcgtcggcgtcgccagcccgcagcagcagcaggaggaggagcaggcgggcgccatcgcaccgttcgtggcgaagacgttccacatggtgagcgacccggccacggacgccgtcgtgcgctggggcggcgccagcaacaccttcctcgtcctcgacccggccaccttctccgactacctgctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggctggcggctgccgggagcagctgtgcgaggagggggaggaggtgcgcgggaccatccgggccgtgcagcgcctgcgggatcagcagcgcgggatggaggaggagctgcaggccatggaccgccgcctgcgcgccgccgagagccgcccgggccagatgatggcgttcctcgccaagctcgcggacgaaccgggcgtcgtgctgcgcgctatgctcgccaagaaggaggagctggccctggccggtaaggggtcgacgacgccggcgcccggcaaaaggcggcggatcggggccgaggccggcgtgggcgacgtcgcggacatggcgcagagcaggggcgccgtgccgttcccgttctctgttctcggccaagtgttctactagggtagatagggacaggtccgtgtagtggtgtatatatgaggtaccaaa

SEQ ID NO: 416 - DNA, 1388 bp, Hordeum vulgare
tgtctatggaaaggacgcagggcttcttcgcggcgctcaaacaggaggtggcgcgcgggctgtcgccggcgagggcgcgccggaggtccgcagaggcggccgacctcgacgccgcgctcaggttctccggcccgggggccggcggcgagatgctagcgccgctcatggaggggcccgatccggagtccggcgacggcgacgcccgcggcgccggcggcgccaggagggagggctggggccgctgggtgcgcggccagctcgcgcggacgccgtcctcggtcgccgccgccgcggccggcgccggcgccgcccgcaacgacctccgcctgctcctcggcgtcatgggcgcgccgctcgcgcccgtgcatgtctgcgccgccgagccgctcccccacctcagcattaaggacacccccatcgagacctcgtcggcgcagtacattctgcagcagtacctggcggcctctggtgggcacaagctcctcgcctccgtgcgaaactcctacgccatgggcaaggtgcgcatggtggccactgagtttgagaacgcgggccgcctggtcaagaatcgtaatgcggctcgctgcgccgagccaggccgcttcgtgctctggcagatggctcctgagaagtggtacatcgagttggctgtcggtgggagcaaggtgcatgctggctgcaatggcaagcttgtgtggcgccataccccgtggctcggctcccatgccgccaaaggccctgttcgcccccttcgccgtgcccttcagggcttggatccactgactgcagcaagcatgtttgccggtgcacggtgcattggggagaggaaggtgaacggggaggattgcttcatcctgaagctgtgcactgaccctgagaccctcaaggcacggacagagggcctcgccgagatcatcaggcatgtcatgttcgggtacttcagccagaggaccggccttcttgtccacatcgaggactcgcatctcacgcggattcagtcaacaaccggtggggatgcggtctactgggagaccaccatcaactcattcatcgaggactaccggccggtggatggcatcatgattgcgcactctgggcgctcggcggtgaccctgttccgtttcggcgaggtggccatgagccacaccaagactcggatggaggaggcatggagcatcgaggaggtggcgttcaatgtccctggtctgtccatggattgtttcatcccacccaccgacatcaagtctggatctgttagtgaaaccgtggagctccctcatggcgagaagaacaagtttggtcctccccatggccatcgcgccaaagttgccgcgctggagaagacggatggcgacgagctagcatggaggggaactcgtacctgatga

SEQ ID NO: 417 - DNA, 2170 bp, Hordeum vulgare
cgaatcgacctccgtctccgtcctcctccgccgcgccccacttatccgcccgccatccccgacggccggagcacgcaggctgcgccgcttccctgcttctcccaccatcgctccttgtcccagggcagaagctcaaagatgggaaggggcgacggggagaaggaagcgaagcgccgacgacgcggccgcagcagcaagagatcgcgccacgccacgccctcctcggactccgattcttccccttcctcggcctcctcctctccgagccgcagccctgggccccggagtcgcagcggcagcaagcccgagaagtcgtcctcgtctcgtcgccgccgccatcaccgcaagagcagcggccgctcacgcagttcccgtgacgacgataggcgtcgtcaccggcggaggcgccgggatgagcgtgcccgtcacggcagcgatgccagcgacctgtcagggtcaggctcagatgattcaggttggatggaggaggcgcaggaaatcgtccgtggcattctcagtgagttccctgccatcaccagcgagcttcgtcagcttctccaaatgatagatagtggtgaaggcattgatatttctggtatttctgacaagccattggtaaagcggttgaagaaacttttcagatccctgaaattgaaagaaagtgcaaatggagcttacttgctggcaccaaaaggtgttcctacccttgatgttgttgggccagtattagaaggaagcgccaaacttggaaatgatccaaatgaaactgtggcatcacgaaatagacaacaagtaccgtcgcctaactttgacgtacaaaataaggatgacattcctcctgaagatggaggaaaagttgatcgggaagaggacacccctataaagagggtaattggtcctgcaatgccatcacgtgaattactagctgcagcagctgaaatgacagaggctcttaggtgccgggatgctgaattggaagctgatgatggttttcttataggtcctccaccaccagccatggtcgctgaagctgcatctgcaaatgaagctgagcgatttgaagaggttactcgaatattgggtgctgatgcagatgcactctatgatgttctgggcataaattggaagatgtcgcctgataacatcaagaaaaggtattggaagctatctcttttagtgcatccggacaagtgccctcatccttcagcacaggaggcttttgtgaaattgaacaatgcttttaaagacttacaagaccctcaaaagagaggcgcaatagatgagaagatacaaaagaaagaagagatggaacaattcgaggttgagcttaaagcaatgcgtgaggctgcagaatggagacgattacaaggtatatctcttgagggcgatgaagaacttttggcagttccgaaacagccagaggcaccacctacacgcgatgaatggatgactacattgccacctgaaagaaaagcaggagtaccaatgcattcaactacggcctttagcatgaatggcaaagaaggacgtggtgacacaagtgcatggacagatagtcctcttgatagagcccagaaagcacaacaaaactacttagaagcctacaacaaagcaaaggcaattgcagatggacatgaagagaagggcaaaagctcagatgcttctcttgtggataaatacaactcctccaagcggtcagtatctctcgtgcagaagcatcgagaaagcaaaaaggagaaaaagaagcagaagcaacagcgagggaaggaagaatgggaggagaaccacccatggaagccgtgggatcgtgagaaagatttaactgccgggcggcaaaatgtcgctttggatccagagaacacggcacaagggttgtcgtcccgtttctcatccggagctgtgcagaggaacttcctgtgaggaatttgagtctgactgcttgaggcatgccaagggagagcatggcctaattggcggccagtaccgccggatgtcgaaattgctaggggcacagaaatcatagagaatgtgaggtttgtgacattgctagtttgcatgttgttttctggagagagctgaagttatctgagacatgtaaaaaaagggtttttcttgtgagttgtttcatactgtgtaacacagctccaggtaggtcttcgtacctggctca

SEQ ID NO: 418 - DNA, 869 bp, Solanum lycopersicum
tctctgcttccatggctttaacgtttcatattttcccctaatttctcttcggatctcaaaaaaaaaaaaaaaaaattaaaaaaaaaatcaaacaaaaaaactttttttaaaaaatcttcggtcatgcggagaagcagagcagccgctgcggcgagacaagttccggcgacggaacttccggtaccggcaccggtggccggagaacacaacggatctggaggatctaaggagataaggttccgtggagttcgaaagagaccatggggaagatttgcagcagagattagagatccatggaagaaaactagggtttggttgggtacttttgattctgctgaagatgctgcgcgtgcttatgatgcagcagctcgtactcttcgtggacctaaagctaaaactaatttccctttaccttcttctcatcatctacctccatatcctcaccatcatcagttcaaccaaagcatcaaccctaacgatccctttgtcgattcccggttatactctcaggaccacccattagtttcacagagacctacttcaagcagcatgagtagtacggtggagtccttcagtggaccacggcagccgccgcggcagcagacggcagcttccgtgccttccagaaagtatccccggtcaccgcctgttgtcccggacgattgccatagcgactgtgactcatcgtcttctgtcgttgaagacggtgaatgtgataacgacaacatcgcttcttcctctttcagaaagccgttgcctttcgatctaaacttaccggcaccgatggatgacttcagcgccgacgcatatgccgatgatcttcactgcacagcactatgtctttgacgaaatgatggtttgtgacccac

SEQ ID NO: 419 - DNA, 2248 bp, Zea mays
actggatgtctggatggcatagcgctaaatttgagaccggcaaaatagcaatttttccccctgtgagcccgcgacgcagcgcgaggtgcggccccgtcccctcgccaccggaggagcaggacgacgaggtggcgccggcgcgaggtagtcgcgcgcctggaagagcggcggcatcagagtcgcaggcggaggcgaggaagtgaggggagagccctatagccaccgccgcggggcgtcctgctcgctgcacgcactcccaccattttgtcccaactcgaagctcagactcgtgctgtcgtgcacttcccctcccctagcatcccaagctcctcactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgaggaccgccggcggcggagaagacggggccaggagagaaagcggcacggtggggatggtggcaggtcctccgactcccaatcgtcggaggaggatagggcggaggaggcgcgggagatcgtccgagatatactcatcgaattgccggccatagccgaagagcttcgccagcttctccaaattatagacagtggtgaaagcattgatatttctggaatttctgacaaactattggtgaagcgcttgaagaaacttttccgatctctgagattgaaagaaagtgcaagtggggcttacttgttgccttcaaaaaatgttcctacgcttgatattgttggatcattactattagcaagttccaaacttgcagacaacaaaagtggaaagccagtgtcaccaaatagagaagcactacaacaggctaactttgatgtgcaaaataaagataaagattatattgtttccgaagagccaaaaattgttgatgtggaagaggaacctcctaaaagaaggataattggtcctgcaatgccatctcgtgaattattggctgcagcagctgaaatgacagaggctcttaggtgccgggatgctgaactggaagccaatgatgatttgctcataggccctccaccgcctgccgtagttgctgaagctgcatctgcaaatgaagctgagcgatttgaagaggttactagaatattggcagctgacacaaattcaccttatgaggttttgggggtaaattggaagatgtcaactgataacatgaagaaaaggtattggaagttgtctcttttagtgcacccggacaaatgtccacatccttccgcacaagaggcattcgtgaaattaaataatgccttcaaagacttacaagaccctgataagagaggtgcaatagacgagaagataaaaaagaaagaggagatggaacaatttgaggttgagcttaaagcaatgcgtgaggctgcggaatggagacgaatacaaggtgtatcactcgcaggtgatgatgaacttttagcaggtccaaaagagtcacagagacctacgagagatgaatggatgaccacattgccacctgagagaaaagcaggagtgccaatgcattcaactacatcatttagtatgaatggtaaagaaggacgtggagacacaagtgtctggactgatacccctcttgatagagcacaaaaagcacaacaaagctatctagaagcctacaataagacaaaggcaattgcagaaggcgacgacgtgaagagcaagaacccggatgcttcaatcgtagataaatacaacacctccaaacgatcagtgtcccttgtgcagaagcaccgagagagtaaaaaggagaaaaagaagcaaaagcagcaggagaaagaggaatgggagggaagccacccatggaagccatgggaccgggagaaggatctgtctgctgggcgccagaatgtggccttagacgcagagaacatgtcgcaaggattatcttcccgtttcgcatctggtgctgttcagcggaacttcctgtgagctgtgtggaaagatactcctggagcttggtctaatcgatgattaatgtccagttattacatcctggtcggcagatggcaaagataatgctgacatataaaaacgagttatgttaccaaggaccatcgtcctgtaatatcgatcgtgcttg

SEQ ID NO: 420 - DNA, 1242 bp, Hordeum vulgare
aaaggatccttgtctcgtacctgccagcgatcgaatcgaaccaagccgacgcgcgcgcgagggcttgtgcatgataaggaggaggatgggggcactgcacgtcggcgagccgcgggtcagcttccagcagcaggtcggcaagaacggcggcgggcacggcgccgtcgtcgaggagatacacgggctcatccgcgtgtacaaggacgggcacgtggagcgcctcccggccatccccgacgtgccctgcacgtggggctcgacggccgccgcgagcggcgtcctcgcgcgcgacgtggcggtcgaccgcgccacgggggtgtgggcgcgcctgtacgcgccggccgccgcggcggggaaggtccccgtggtggtgtacttgcatggcggcgggttcagcgtcggctcggccgcgtggagctgctaccacgagttcctcgcccagctgcccgcgcgggcgggctgcgccgtcatgtccgtcgactaccgcctcgcgccggagaaccgcctgcccgccgcgttcgacgacgggctcacggctctgcgctggctgcggcagcaggcgagcagaggcgccgccgcctccgacgaggtctcgtggtggcgcagccggtgcaggttcgaccgcgtgttcctcatgggcgacagcgcgggcgccgccatcgccttccacgtggccgcgcgggcccccgccccgctcgccgtgaagggggccgtgctgatccagcccttcttcggcggggaggcccgcacggcgtcggagaagagcatgccgcagccgccggggtcggcgctgagcctgtcgacgtcggacagctactggcgcatggcgctcccggccggcgccggccgcgaccacccctggtgcaacccgctggcccgcggcgcgccccggctggagagcctggcgctgccgcccatgctggtgtgcatctcggaggcggacatcctgcgcgaccggaacctggagctgtgcagagcgctgcgcaaggccggcaagagcgtggagcaggcgacgtacggcggcgtggggcacgccttccaggtgctccacaactgccacctgtcccggccgcggacgcaggagatgctcgcgcacatccgggccttcgtcagcgccaggtccagctgacagacactcgcccgccgacgtgtcatgtcagtgtcagccgtcagttaattacttcaaatccagtctaatccactaccagttccagagtagatgccgtgtaagcaggtaccttt

SEQ ID NO: 421 - DNA, 992 bp, Zea mays
aaagaattctcccataaaggtttcagtttcgcaagccaagccactcccacacccccacgctcgagcgaagggaaccagcaatggcgcgtcgcgggccgtgagagacgggaacaagaatggctgccatggtgcgcgggcccgcgatggcctctgcggctgggccgggtgcgacgtcgtcggctgctgcggccgcggccgcggcggcggaggagatgcggtggcggcagctagacagcggcgtgagcgcggtgtcgttcgggttcgtggccaccgccatactcgtgtccatgttcctcgccatggccatcctcgagcacttcctccgccccccgacgacggcccacgcgccgccccggggccggggtgtcctccgccgcctccgcctcttcctcctcggccgcagtggcggcgcccccggcgggacggatctcgaggcggcgaggaagctccacggtcacgcgcccctcgagatgcctgtttaccccagaggcgtgtcagttctgatgccagggcaagacgtgccaacgttcatcgcgcatcctgcccctgcaccgtgccccccagagaggatccggtggccgtcacaccagccgcctcctttcactggctcctcgccaaaccctagctagtgctgatgtagcacacacccagcacactgagaacgctggctgttgtcagccagtcaaccatcaatgtcttgtctgtagaggaggcgaggagcagccgtgcgctttgcgggcgtgttggtgttgccgatgaatcgatgatccactccgtctccggggcatgacagccaggacaggcgggctctctctcctctttgtgactctgtatctgtacaggtttaggtcttgttctgaagcattgcaaccttgtactgctgccccctgctgcgttgtggctggcgagcggcggctggtggatccgtcgtggagttgttgctgctgatccctgttgatgtgtgtcagtagatgcctgatggaaggcctttt

SEQ ID NO: 422 - DNA, 516 bp, Hordeum vulgare
gtcgacacagggtaaggcgatgttctccggcgactggacgccgccgtgcggcagctgctgcaccaagaagtacgcgaccctcgtccaaatcccatggagggtgttctgcaagaaggggtgcaacgcggacggcgacacctgggaggagtgcataggtaaatgcactgaaatatgctacaaggatccggtgttggaagatcgccagtggagtgcttatatcgatcggtcgccaggagaggacagttactccttggagtgcttcaacgcgtgcatctctgggtgtggatacaggtttgacataccggcggagaaagtagggctcatcaagccgaacaggccatccaagccgccgccaccgctaccccccgtggtcgaacgggccaaacctagctccgggcctcccgccgcggccggcgaagatgtgcccggcacatcggcatagcccatgatgatgccaaattttcgtgtaaactgttagtaactgtcgtcctcgaattacccaccgttgttgaattc

SEQ ID NO: 423 - DNA, 1853 bp, Sorghum bicolor
ccgccatgccgccaccgccgccgcagggtccagctccctcccacgctggccgcgccaacctcttctccgccccgccgcctgccctctccaaccgccgctaccccagtcagcggtccctgcccctcccgcccgtcccccctcgccgccgcgaccccaagaaccaccgcccgcagccttcccaagaggaagaacgaccgacagacagcggtccaaggagaacggctgccaccaacccggccttccgcgcgtcccacctccgtaccgcgtaccgcaagcccgtgcccccagccgcagccgccggcgaaggcgaggccctcctcgccgccgacccaaccgacgccgcctcggggcgcgccgtcgtcgtgggtccctcgggcctctccttccgcctccccggcgcgccgttcgacttccagttcagctactccgaggggccccgagccccgccgctcgccatccgggagccggccttcgtgcccttcgcgccgccgaccatgccgcggccctggacgggcaaggcgccgctgctgactaaggaggagaaggcgcgccgccggggcgtgcggctgcacacgccgctcgggcaggagccgccgcaaacggtgagcgcgcacgggatcatgatggaggtcagggacaggaggcaaatggacctggccagggtcagccccggtgatggcagaagcagggaggaggtgctcggtgagccgctcaccccatctgaggtgcgcgcgctcgtcaagccgcacatttcacacaaccggcagctcaacattggaagagatggcttgactcacaacatgttggaaatgatacattgtcattggaggcgccaggaaatctgcaaagttagatgccgaggcgttccaactgttgatatgaagaatctctgttatcatcttgaggaaaagtcaggtggaaaagtcattcaccgagtaggtggcgttgtttttgtgtatagaggaagacattatgatccgaagacccgtcctcactatccactaatgctctggaaacctgcgactcctgtgtatccaaaactcatcaaagaagttccagaagggcttacaaaagaagaagcagatgaaatgagaaggaaagggcgtgatcttctgccaatctgtaaattagccaaaaatggaatatacatcactcttgtcaaggatgtgcgagatgcttttgaaggaaatgaccttgtgaagattgactgtgagggtttgaatccaagtgactacaaaaagattggagcgaaactaagggatcttgttccctgtgttcttttatcatttgatgatgaacagatattaatgtacagaggcaaagaatggaaatccagatactcgaagcctcttactctcattccgaaagttccaaagaataatctggcaatgtcatctgacatgaatagttcagatgaagttagtgatgccaacactcaagttgcgataagagaagtattgagacccaaaatgtttaaattatggaagagtgcagtggactcatctctagcattgctgctggatgacgctgaagcaaatgatctcacacccgattcactgctgactttggttgaggagttcagcgtgacatctcaggcagtcgagcactcattccctgctctgcttgtgaccaatggtgaggtgaacaccgaatctctaagtgcagaatacataaatgatgatgagtctgaaacaagcattgctggaaacgaagagggccagctcgagcagtcacctgatctctctggcgatgaacattttgagcttgacatgcttgagcgtctggagtcatctgtgccattgggatcgctgccgattgacggcatgatagagcagctgaacagtgagtgatga

SEQ ID NO: 424 - DNA, 1141 bp, Glycine max
ttacccacaccctctctctctctctctctgtcacgcacagagaaaaactcagacacccacgttcacacttcgcacacaccatctctcactgttctttcttcttcctctttttcttcttttttttcttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcatcctcgatcccctcgacttctcccactccctcctccctactttcttcaagcacaacaacttctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttcatgaaatgaacaagaggttagagacaacagaaaaacgaccacaacaaatgatggcttttctgtgtaaggttgtcgaggacccgcagattctttctcggattctccgagaaagagaaaagaaacacctgggagagaaaaagcgacgcctcattccgcctccgccgccgacggcagcgacgtcgtcgtcgtcgtcctccggcatcaagacagagttcgaagaagacgaaggtaattataatatcaagtcttcgtcgccggagacagggttggaaatcgacaacaatagtaacaatatttgttcgccgccgccgctggggtgttggggtgaacagggttgttatgggtacaattgcgcctccgtgccggcacctttgacggtggtagcgccggcgtttccgacgatgggaggagggtatttgaggcgtggggggttttggggggaaatggcggcggaggggaatgcggtgccgccttatccgttttcgttgttggaagggggcttttagatttagttttaggttatgaaatgaatgaattattactgcca

SEQ ID NO: 425 - DNA, 1267 bp, Zea mays
cacactcgagagccatctcccagcacacgagcgcgatggcttccaccaccaccaccttcctcgccatcttgctggtcgtggcagcgtccgcggcgccggcacggtcctgctcaccgcgcgacatccacgcgctgctgagcgtgaagcaggcgctgggcaacccggcgtcgctgtcgacgtggacgccggcgtcgcccaactgctgcgcgtgggaccacctccgatgcaacgacgccgggcgcgtgaacaacgtcttcatcgacggcgcggacgacgtgcgcggccagatcccgtcggcggtgggcgggctgacggagctcatgtcgctgacgctgttccggctgccggggctgacgggcgccatcccggcctgcctcacggcgctgtcgaacctccagttcctcaccgtctcccacaccaacgtgtccggcgccatcccggagtcgctggcgcggctgcgcggcctcgactccgtcgacctctccagcaaccggctgacgggcggcatcccggcggcgttcgccgacctgcccagcctccggtcgctggacctccggcacaaccagctgacggggcccatcccggcggggctggtgcaggggcagttccggtcgctggtcctgtcctacaaccagctcacgggccccatcccgcgcgacgacgcgcgcgacgagatcaacaccgtcgacctctcccacaacaggctcaccggcgacccctcccacctgttcgccgccggccggcccatcggcaaggtggacctgtcgtggaactacctcgacttcgacctcagcaggctggtgttcccgccggagctcacgtacctggacctgtcccacaacctcatccgcggcaccgtgccgctgtcgctggagcgcctgtccacgctgcagaagctggacctcagctacaaccgcctgtgcggcccgctccccaagggccacggcgtcatcaagcacgggtgcaagccgtacgcgcacaaccagtgcagcaaagggaccccgctcgcgggatgccaggacctggagtgagtgagccggtggccatggttttctatactctgctctgctctccctcgccggcgttcttttcgtgtcccaatcttgaaggacgacggtacggtgcctggtttagctatagacaaaaaaaggtacggccgcgtggtggcggtgctaatatgcttagccacgcccacgcgcggttgatctttgagcagttaagcgtgtacgaaatgacagctgtgtacgtgtactgtctggtggagtgt

SEQ ID NO: 426 - DNA, 1719 bp, Sorghum bicolor
ggtgctctctttcttcccattctccagccgccgcggcgacgcgcagacctagcactaccagagaaacacccgagatggcgatggctctgcgccgcctcgcgggcgtgtccggctcgccgtcggcctccgctgccgcggccgcgctgctactccggccggcgctgacccgcccgatctccaccggcttccgcgaggagcgcgacaccttcggtcccatccaagtccccaacgacaagctgtggggcgcgcagacgcagaggtcgctgcagaacttcgacattggcggggagcgcgagaggatgcccgtgcccatcatccgcgcttttggcgtgctaaaaaaatgcgccgctaaggtgaatatggagtatggtctggatccaacaatagggaaggccataatgcaggcagctgaggaggtcgcagagggaaagttggatgatcacttcccacttgttatctggcaaactggcagtggcacgcaaagcaacatgaatgccaatgaggtaattgcaaatagggcagccgagatccttggacacaagcgcggtgagaagtttgtgcacccaaatgatcatgtgaataggtcacaatcttcaaatgatacatttcccactgtaatgcatatagcagcggccgttgagataaattcgaggtttatcccaagtttgcaacagttgcatgattcacttcattcaaaaactgttgagtttaaagacataattaaaattggacgtacacatacccaagatgccaccccgttgactcttggccaagaattcagtggttacactacacaggtcaaatatggaattgaccgtattaattgtacattacctcggatgtaccagcttgctcaaggtggaactgcagttggaactggcttgaacactaagaaaggatttgatgtcaaaatagctgctgcagtggctgaggaaacaaacctaccctttgtgacagcagagaacaagtttgaagctttggcagcgcatgacgcttttgtcgagagcagtggcgcggtaaatacaatttctgcatctcttatgaagatagcaaatgacatacgcttgctaggaagtggtcctcgatgtggtcttggtgaactaatcctaccagaaaatgagcctgggagcagcattatgcctggaaaagttaatccaacccagtgcgaagctctgacaatggtttgtgctcaggttatgggtaatcatgttggtgttacagttggtggtgcaaatgggcattttgaactgaatgtttttaagccaatgatagcagccggattgcttcgatcattgaggttgttaggggatgcatctgtgtccttcgagaaaaattgtgtcaggggaattcaagcaaaccataagagaatttcacaacttttgcatgagtctctgatgttggtgacatctttgaaccctaaaattggctatgacaatgctgcagctgttgctaagaaagcccacaaagaaggaaccacgttgaagaaagctgcattagaccttggagtattaacggagcaagaattccatgaacttgttgtcccagagaaaatgatcggtccttctgattgataaccccatgttcattatgtttctttaaagcattcaggttgccacatccggagttctggtggtttcctgtgatgccaacttaatgattctagtgcacccgtaaataaaccaaataatttttcatatggtcattaggtcctctccacac

SEQ ID NO: 427 - DNA, 1406 bp, Sorghum bicolor
ccgccatggccacctccccagccgcctcgtcctcttccgctccgaccgcctccgccgccgctgcggccacgatggctgccgaggccaccgacgggccggtgctcagcgtagtatcgaagcgtctccgcgcgctgcggaagaagtacaaccgcatcacgcagatggaggagtcgctcgccgccggcaagacgctcaaccgagagcaggaggaggttctccgctccaagcccgtcgtcgccgccctgatcgacgagcttgagcgcctccgccccccgctcgcatccgccgtcgcggaggagctctcctcccgccccgcccccgcccctgcccctgcccccgccgccgccgcttcctcctccgactcagattcgtcagtccaggacctcctcgcgctcatctacttcggctccctcttcgacgtcaagcagcaaagcgacttcgtctctttggtttacgcgagcgagctcgagcggagcagctgcatcacttatgactacgtcggggatgatccggaggacagtctcgcggagaccgatctgaacgcggtttctgcccttgcctccctcgccgcgtcgcgccctccagctgcagccggagtctcgcaccgtgacgcccttcaggcttgtgcccatcacgcccgcctctggctccgccgtgcggatgaacccatccaccctgactccaccgtcacatatgctggggtgagggcaaagctggataggatcatggcatcgggctactacacagctcagctagaaatgaggccaccattggatctggctgctgcagtggcaagctttggagctggaggtgctcagatgcaggagagtatggttgtgtcgcctcaggcaccggaagcagttgaggagaacccagctgttgaaggacacaaggatgagaaggatgattcgcaggctactgaaatctacagtgaccatcaggctcctgttgttgatgctgaacatgtggaggatgaaggcctggtgaatccaactgatgaggttccttcagctgaggcagagcaggagacatttgatgctgatgtggaggatcaggaacaaaaagaccaacaattcacccagcggcggtcttaccagaaccagcgtgggggtggtggtcgtggtggcggcaggaggggctatcctaatggtcgtggagggcgtggtggccgaggcggtgggtaccagaacggccgtggcggtggtggataccagaacggccgtggcggaggcggtgggtactactatgaatctggatactaccagccgaggaactacaacaacaacagaggccggggtggtcgctctggcggtggcaactcttactacaacaaccatggtggaggtgcacagggaggcggccatggcaatcctgggagggttgagcttggtgcaaacgcctagtag

SEQ ID NO: 428 - DNA, 1995 bp, Sorghum bicolor
aaaggatccaaccaaaccctccagagtccccccgcagcaggagcgagcagccatggcgccggtcgatccccactcctacaccgacggcgcgcacccggtggtgtcgcgcgccgcgctcgccttctacctcgacttcgccgcctccaccatacacgcctccgcgctgctcaccctctccgcgccgcactctggggatctcctcctcgacacccgtgccctcaccgtccactccgcctccaccgatgccgacacgccggagcccatccccttctccctcgccgcggcgcccgacccggtcctcggcacggcgctcaccctcaccctgccccccgacaccacctccttccggctcaccttctccacctcccccgccgcctccgcgctgcagtggctggccccgccgcagaccgcctccgggcagcccttcgtcttctcgcagtgccagtccatccacgcccgctccatcttcccctgccacgacacccccgccgcgcgcatcaccttctcgctcctcctcaacgtgcccgagcagctctccgccgtcgcctccgcgcgccacgtcgcgcgacgggacccgctgccctccgaccaccgcggggcctgcgacgacgagctgtggtgcgcgcccggccgcatcgtcgaggagttccagatggagcagtccgtgccgccctacctcttcgcgttcgccgccggcgggattgggtccagggacctcggcccgaggacgcgggtgtacgcggagggaggggacaaggtgctggacgaggcggctagggagttcgcgggggtggaggagatggtcaaggttggggagggcctctttgggccgtatgaatgggagaggttcgatctgctcgtgctgccaccgagcttcccctatggaggcatggagaaccccaggatggtgttcctcacccccacggtcatcaaaggggatgctgcaggggctcaggtcgtggcgcatgagctcgcacatagctggactggcaatctgattactaacaagaccaatgaagatttctggctaaatgagggattcacaacatatgctgagaggaggattgttgaggttgtgcaaggggaggagcgggcagccttaaacatggggattggatggagggggttgaacaggatgatggagaggtttaaggataacatggagttcaccaagttgaagccgaatatggcagggattgaccctgatgatgtgtactctgaagtgccctatgagaaaggtttccagtttctttggagaatcgagcgtgagattggcaggcctgcttttgatgaattcttaaagaagtacattgcaaccttcaagttccaatcaatagatacagagacatttcttgaattcctcaaaaccaatgtacctgggatagaaaaccaaattgaccttaacctgtgggttgaggggaccggtatccctcctgatgccatggaaccagattcagctacttacaaaaagatctgctccttagctgcagaattcaaatctggaaaacttccaagtgaagatgaggtggcaaactggagtgggcaagaatgggaactttacttagaaaatctaccaacagatgttgaagcctcacaggtcactgctcttgacgagcggtacaagctatctgaaagccgtgactacgaggtcaaagtcgcattcctccagctggcgatccccaccgggtgcaagtgctacttcaacgaggttgagaaatgcttgaagcaggtgggaaggatgaagtacctccgcccgctctacagctcactggccaagtgctccagcgaggagaagatgctggcccagaggatcttctccgaggctcaagagttctaccacccaatagctcgcagtgtcgcggagtccattttgtcgaagcatagctaagcaggccaagactcttgtttagcaaatccatcgtccacggcctcacccgactcacggttgggagcaactgagatctggtgattgctcagttgcttcttggtaccttt

SEQ ID NO: 429 - DNA, 778 bp, Sorghum bicolor
aaagaattctgccaagagtacagtttgatgcgagcagctagctagttgttcctttcaattcgtgtgcttttgctagtagcttgagatcaagccagccggcgaacgaggatcggaacatcatccatcgcaccatggccgccgagcagcagcagcagcctgccaaggccgccgcggccggcagcaggttcgcggtgacgtgcggcctgctgaggcagtacatgaaggagcagggcggcagcggcgccaccaggtgcctcgcgccggccgtcgccatgggcctcatgccggaagccgacgctgcggcggctgcgaccgaggagaggaccaccgtgctggagctcttcccgcagcaggctggcacgctcaaagacgagcagcaaaggaagaggaaggagcctgcggacgggagagcgccgctgaccatcttctacggcggaaagatggtggtgttcgacgacttccccgcggagaaggccgaggagctcatgcagctcgccggctccggcggcaacgccgcgcccgccgccgagaacgcgctgggacagcccagcctcacagacatgcccctcgcgaggaaggtgtcgctcaagaggttcctcgagaagaggaagaacaggctcaccgcggcggatccatacccggcggcggcaagtgagtcgtcgaccaagcagcctcctgctgttaaggaggagggcgcgccgtggctcggcgtgagctccgcgctcagcctcagctgaagaatctgatggaggacagcaagacacctactaggcctttt

SEQ ID NO: 430 - DNA, 1005 bp, Gossypium hirsutum
tgtatcttctgatcggttcaatttcatgtgtcactcactttcctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggagatcgagaaggttttgatggaggatgataattttgatcctagggttgagactcaacctgtctccgatgatgatttcttggccgatttactggttgattcacctcctagtagcggcggcgatgtgactggcgtcgacggtgctgatttgcacaaacagagccagacccacaccgacgtcgataaagacgatcccattgctaagaaacagagaaggcagttgagaaacagagatgcagctgtgagatcaagggagaggaagaagatgtatgtcaaggatcttgagatgaagagtaggtatttagaaggggaatgtagacgactgagccgtgtgcttcagtgcttcattgctgagaatcaagctcttcgtcttacgttgcataagggttgtgcatttgatgcatcctcggccaagcaggagtctgccgtgctcttgttggaatccctgctgttgggttccctgctttggttcctgggcatcatgtgcctcttcaccctgccaatactgcccaagtcagttctggaggcagttccaatggcaaacgaggaaacacaaggtcccgaaagagtggctccaagaggggcagggagtaaccgggtcggaccatcttttgtgaagagtaggagatgcaaggcgtctaggggaaagatgaaagaaatttcatgttttatgggaattttaattccattttaggtttaatgtgatgggggtgtggctgtcgtgttattta

SEQ ID NO: 431 - DNA, 998 bp, Oryza sativa
tttggatcccggagatggcggtggagtcgtcggacgaacggaaggccgacgaagacggagctcacgaggagctcgaggggcagttgctgtaccgcgttccggtctttgacccctccctcgccgagttctgctcgccgcccccgatcgatgacgcggcggccgcatcctcatcgtgcttcaaggaggacgccgccgacggcgccgtggaagacgcaaagtatccggcagctgcggcgtcgtcgcccgtgcagcagctcccggatagctttgtcaacttcgaaccgacggacgccgagctgagggagttcgccgccgacatggaagccctactcggacaaggcctggacgacagcaacgagctgcaggactcgttctacatggagaccctagggctaataacgccgccggtagaagaatccggccgggtgaagatggagctcgacggcggtgttgcctccaacagcagggtatctctcccatcatgccgcgctcatccgaagccggaggacgtcgaatccgccgacgtgctggacatcgatttcaactgcacctcgccggacgaacagaagtcgtcggcgagcaacggcgccgcagccgattcgcagttcttccacaggagcctggatctcaggctcaactacgaggcgatcatcgagagctggggcaactcgccgtggaccgacggccggccgccgcacggccagctcgacgacttctggcccaacgaccaccattactcggggttgtgggctgcgggagggggcgggcatggcgcggaggtggggatgatgacggtgaggccgcggatggacggcccggggcgggaggcgcgggtgacgaggtacagggagaagcggcgtacgcggctgttctccaagaagatacggtacgaggtgcggaagctgaacgccgagaaacggccgcggatgaagggccggttcgtcaagcgcccctccgccgccgccgccccgtgcgccgtcacctagtagggtaccaaa

SEQ ID NO: 432 - DNA, 2647 bp, Oryza sativa
aatagcaagcggaagctgggggaatctgcggtggctttttcgcctcgttgtgccgtgtcatctcctcctcctcctcctgccgatgatgatgctgctgctgccgagttcctcctcctcctgctgctgtcgctgccccggcgggcagttccacggagctccaccccgcgtgatggcgcctcgtcgtggggtcaccagagtatatattgagaagagattgggagtaggagggggaaatgcatcaagcctgcaagacatgcacaggaaggagctccaggcaaggacaagggaccagctccagacattggagttatctacgtctttgtacgacacggcgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggactagattttattggaaggaatttctccattgccatggatgagcagattgctgctcctgttggtttcaacatcacttttcctggtatgcttagccttgccatggggatggatttagaattccctgtcagacagacggatgttgatagacttcttcacctccgggagatagaactggaaagagaggctggagaccattcttatggaagaaaggcatatatggcttatgtcacagaaggattaggaaacctgttggagtgggatgagattatgatgttccagaggaagaatggatcatttttcaactgtccttccacaactgctgccacattagtcaaccactataacgataaagccctccagtacttaaattgtctggttagtaaatttggcagtgcagtaccaacagtgtatccactaaacatatattgtcagctttcatgggtggatgcacttgaaaagatgggaatttctcagtattttgtcagtgagataaagagcatcctagacacaacatacgtttcatggttagaaagagatgaggaaattatgctggacataacaacatgtgcaatggcttttcgcctgttaaggatgaatgggtatcatgtttcctcagtcgagttatctcctgttgctgaagcttccagtttccgtgaatcacttcaaggatatttaaatgataagaaatctctaatcgaattatacaaggcttcaaaagtcagtaaatcagaaaatgaatcaatcttagatagcataggctcttggtcaggtagcttattgaaggaaagtgtgtgctctaatggggtgaaaaaagctccaatctttgaagagatgaagtatgctcttaagtttcccttctacaccacactggaccgtctagatcacaagaggaacattgaacgttttgatgcaaaggattcccagatgttaaagacggaatacttgcttcctcatgccaatcaagatattctagctttggctgttgaagatttcagtagttctcaatctatataccaggatgaacttaattatcttgagtgttgggtgaaagatgaaaagctcgatcagctgccatttgcacgccagaagttgacatattgctacctttctgctgctgctaccatattcccccgtgaattgtctgaagcccgcattgcatgggctaaaaatggtgtactgacaactgttgttgatgacttctttgatcttgggggatcaaaagaagaactagaaaacctcattgctttagttgagaagtgggatggacatcaagaggagttctactcagaacaagtaagaatagttttttctgctatttatactacagtgaaccagcttggagcaaaggcttctgcattacaaggccgtgatgttacaaaacacctaacagaaatatggttatgtctgatgaggtctatgatgaccgaagctgaatggcagaggacaaaatatgtgccgacaatggaagaatatatggcaaatgctgttgtctcatttgcactgggacctattgtgctcccgactctgtatttcgtaggaccgaagctccaagaggatgtcgtcagggatcatgagtacaatgaattatttagactgatgagcacttgtgggcgtctcctgaatgacagccaaggctttgagagggagagcctggagggaaagctgaacagtgtctcactgcttgttcatcacagtggtggttctatctccatagacgaggctaaaatgaaagcccagaaatccatagacacttccaggaggaacttgttaagattggtccttggagaacagggtgctgttcctaggccatgcaagcagctgttctggaagatgtgcaagattgttcacatgttctactctcggactgatgggtttagctcgccgaaggaaatggttagtgcagtgaatgcagtcgtcaaggagccacttaaactcaaagtgagtgatccatatggctctattttgtcgggcaattgagtgcttctccgttctgttttatcagggatatcagcaacgagctttatacaggttgatatttcttttctttttctttacgataagggtttaaatcctagtacccacgattatagctgctgtgtgtag

SEQ ID NO: 433 - DNA, 2007 bp, Oryza sativa
cttagctcagctcaaccacatctcgaactaaccaactaagctaaagctaagctagcttcaccgtcatcctccactgacacatggggagcttggacgccaacccggccgccgcctacgccgcgttcgccgccgacgtcgagcccttccgcccgctcgacgccgacgacgtccgctcctacctccacaaggccgtcgacttcgtctacgactactacaagtcggtggagtcgctcccggtgctccctggcgtcgagccgggctacctcctgcggctgctgcagtcggcgccgccgtcgtcgtcggcgccgttcgatattgctatgaaggagctcagggaggcggttgtccccgggatgacccactgggcgagcccgaatttcttcgcgttctttccggcgacgaatagcgccgccgcgatcgccggtgagctcatcgcgtcggcgatgaacaccgtcggattcacgtggcaggcggcgccggcggcgaccgagctggaggtgctcgcgctggattggctcgcgcagctgctcgggttgccggcgagtttcatgaaccgcaccgtcgccggtgggcgcggcaccggcgggggcgtcattctggggaccaccagcgaggcgatgctcgtcacgctcgtcgccgcgcgcgacgccgcgctgcggcggagcgggtccaatggcgtggcgggcatcacgcggctgacggtgtacgccgccgaccagacgcactccacgttcttcaaggcgtgccgcctcgccgggttcgatccggcgaacatccggtcgatccccaccggggccgagaccgactacggcctcgacccggcgaggctgctggaggcgatgcaggccgacgccgacgccgggctggtgcccacctacgtgtgcgccacggtgggaaccacgtcgtccaacgccgtcgacccggtgggcgccgtggccgacgtcgcggcgaggttcgcggcgtgggtgcacgtcgacgcggcgtacgccggcagcgcgtgcatctgcccggagttccggcaccacctcgacggcgtggagcgtgtcgactccatcagcatgagcccccacaagtggctgatgacctgcctcgactgcacctgcctctacgtccgcgacacccaccgcctcaccggctccctcgagaccaacccggagtacctcaagaaccacgccagcgactccggcgaggtcaccgacctcaaggacatgcaggtcggcgtcggccgccgcttccgggggctcaagctctggatggtcatgcgcacctacggcgccggcaagctgcaggagcacatccggagcgacgtcgccatggccaagacgttcgaggacctcgtccgcggcgacgaccggttcgaggtcgtggtgccgaggaacttcgcgctcgtctgcttcaggatcaggccgaggaaatccggcgccgccatcgccgccggcgaggcggaggccgagaaggcgaaccgcgagctgatggagcggctgaacaagaccggaaaggcttacgtggcgcacacggtggtcggcggcaggttcgtgctgcgcttcgcggtggggtcgtcgctgcaggaggagcggcacgtgcgaagcgcgtgggagctcatcaagaagacgaccaccgagatcgtcgccgacgccggagaagacaagtagatcgagctcgacggcgacagtgtaaagccactgttatttgctgtgtcgtgtccgttcgatacatggattgattaattgtttactggtcgcagttggtagaagtaattaatggcgacaacgagaggtgcgtggaataataaatactctctccacgtaggcagtgtgtgtgtgtgattatattcatactgtgcattcaaaattactatggtccatcatataaatgttgggctttcatcttcttcttttttttgggtaaggttctttttcttttttgttacttgtataccagcaagaaacatgtcataagtcatgtgtagtacgggtaaaaaggaacaggtgatttgtttggccttaa

SEQ ID NO: 434 - DNA, 1690 bp, Solanum lycopersicum
ctccggttcttggtgtttattgcttaccagtttcggattcatatagccaacttcaacttgtttgggattgaggcgtagttgttgtacaccagggacaggaaattgtgttatgggttggttagaaaagatatttggaggttccacacacaggatctccggtggacaataccatagtgggtatgagggtgcgcaatatcatgggggctacgatggagggcaatatcattcggggcatgaaggagaacaatatcatggagggtatcaggacagtactacttgggacggaccaactacatcagtggatgaatcgtcagattttgataaagaagaaattgatcgtgccattgcactttctctagcagaagaggatcagaaggggaaaaaagtaattgagagtgaaccccatttggaggaagacgaggctctcgccaaggcccttcaggaaagtttgaatgtggagtcgtctccaccaccaccaccacctcgatatgattatggaagtccctttccctcactctcatactcgtttccgtatgggtatagggtctgtgccggttgcaatgctgaaattggacatggaagatatttaagttgcatgggagctgtttggcatccagaatgtttccgttgccatggttgcaatcaaccaatttccgactatgagttttcaatgtcagataaccgtccataccataaatcatgctacaaggaacagcatcacccaaaatgtgatgtatgcaagagctttattccaacaaatccggctggtctaattgaatatagggctcatcctttctggcttcagaagtattgcccatcacatgaaactgatgggacgcctcgttgttgcagttgtgagagaatggagcccgtagatgccagatatctgatacttgaagatggtaggaagctgtgtctagagtgcttggactcttcaataatggacactcatgaatgtcaacccctttatcttgagatacaagaattttatgaaggtttaaatatgaaagtagagcagcaaattcctttgcttctagttgaaagacaagcattaaatgaagcaatggaaggagaaaagaacggtcatcatcacatgcctgagactcgaggactctgcctgtccgaggaacagaccattagcagtatttcaaggagaccacggattggtggttatcggattttagatatgtttacagagccttacaggttaattcgacactgtgaagtgacagctattctaattttgtatggtcttcctaggttattgactggttcaattctggctcatgaaatgatgcatgcatggttgcggcttaaaggttatccgagtttaagtccagaagtggaagaaggtatctgccaagttttagctcacatgtggttggactcggaaattatagctggttctggcagtacttcaacttctgcatctacctctgcatcctcatcatcatcttcatcaccatctacttcatcaaagaaagggaagcgctccgactttgagaagaaactgggtgatttttttaagcaccaaattgaatcagatacatcagcagcttatggggatggattcagagaaggtaacaaggcagtgctcaagtatggccttaagacgacacttgatcacatccggcttacaggaacctacccgtgttaaaattttcagtcattccgagtgtttccactttag

SEQ ID NO: 435 - DNA, 3278 bp, Populus trichocarpa
agaaaatggtgaggctattaggattaactcgcggagaatcggatgattctccgcgagagattacctcgaggacgactcctttaactagtgagtcaggtgagagtgggtggttgattaggttctttgactcatctttcttttgtgagtggattgcagttagttatctatacaagcacgatcatgccggggttcgggattatctgtgtaatagaatgtatacattgcccttatcgggtattgagagttatttgtttcaaatttgttatatgatgatacataagccaagtccgtcacttgataggtttgttattgatatgtgttctaagtctttgttaatagctttgaaagtgcattggtttttgttggcggagcttgaggattcggatgataatgatgggattagtaggattcaggagaagtgtcagattgctgccactttgatgggagagtggccgccattgttgaggccacggaatgagtcttcgagtcctgggagtaagaatcaggttttgaatagaatcttgtcatcaaaacagaagttgttgtcattgacttcttctccacctctacagaagtctacgcaattatcggggaatagtttgcaggaggatgggactgggagtcagttgtcaccggatgagaataagatttttaagaagtttattcctggtccaaagtttagagatgctttgttgtttaggaagaaatcagttgataaagatgaggatgagggtggaaaggatggatttttcaagagacttttgagggatagtagtagacgcgaggatgaggagttgacaacaagttcagatggttttttcaagaggcttagagatagcattaaaagcgaggatgaggagttgacgtccagctcagatgggtttttcaagaggcttctcagggacaatagtagagtcgaggatgaggaagtaatgtcaagctccgatggctttttcaagaaactgtttcgtgatagtaagagtgatggtgatgaaaagctggtttctaaatctgctgaagacgatgaaaaagaggggttccttaagaggttttttaaggagaagtttgaagacaagaaagatggaaatgatcagaacgaggatgaagaaaggttgaagcttgaagagaaaggttcaaaatctgcagaggatgatgaaaaagaggggttcttctggaagttgttcaaggataagtttgaggacaagaaagatggggctgataaacctgatgaggggactgtcaatggtgaggaagaagaaccttctgacttttcgttgtttcgaagactgtttcgtgtgcatcctgaagaggtccaaagttctcctgtgaatgaaaataacagtagtggtagcttgcttgaaagcagcctgggtactgagaatttttttcgcaaattgtttagagatcgtgagcgctcatttgaagactctgagttatttagttttaagaagaacaatgagaagcatcctggatcacctaagcaacagaatgagaaatcaaacacaaagcccccactttcaaatactgcagcactgttccggaaaggggcttatcatgagtcattggactttgtgatgacattatgtgaaacttcgtatggtttggtggatgtatttcctgttgaagatcgtaaaagtgctctttgtgagtcacttgcagagatcaacatgcatttagctgaggctcaaaacagtggaggggtttgctttccaatgggaaaggggatgtatcgcattgttcatatacccgaagatgaagctgttctcttgaattcgagggaaaaggcaccttatctgatttgtgttgaagtattgaaaagtgaaatgccaagtaatagcaaggagacatctggtactcaaaagctttccagaggaggaattcctctagcaaatggcgatgcattcttgcagaagccacctccttgggcttatcctttgtggactgcccaggaagtttatcggaatagtagtgataggatgtctcgatcaaccgctgaggcgattgaccaggcaatgtcccattcatcagaaatgaaaatgaaatttgttagtgtgagtctttcagtggagaagcaattccctagccagtcaactatcattgaagcacctaaattgaattctggcatcaattgtatgcatcaaaatgcttcacattgtaatgatttggaatgggtaagggtagtgttgacagcagatcctggagttagaatggaagacacagggtatgcaggggcaccacgacgcaaggagcatcgtcgggttcctagtacaattgccatggaagaagtaaaggctgctgcagccaaaggggaagcacctcctggactccctctgaaaggggctggtcaagattcctcggatgcacacccaaaggttgatggcaatcccaaggccagtgatgccttatctggtgaactctgggaggtcaagaaagagagaatacgcaaagcttcattatatgggaaattacctggttgggacctgcgctctgttattgtgaagagtggtgatgattgtaggcaggagcatcttgctgtgcaactcatttctcacttttatgatatatttcaagaagctggtctccctctttggttgcgtccctatgaagttctatgtacttcatcttacacagctctcattgaaacaattccagatacggcatcaatccattctattaagagcagatatccaaatgtcacgagtttgcgtgacttttttgttgccaagtatggagagaactccccaagttttaagcttgcacagaggaactttgttgaaagcatggctggatattctcttgtgtgctaccttttacaggtgaaggacaggcacaatgggaacttgttaatggatgaagatggccacattatacacattgattttggcttcatgctctctaactctcctggtggtgtaaattttgaaagcgcacctttcaaactaacccgggaacttcttgaggtcatggattctgacgctgagggaattccaagcgagttctttgactattttaaggttttatgtattcaaggcttcttgacatgtcgtaagcatgcagagcgtattattctccttgttgagatgttgcaggattctggtttcccttgctttaaaggtggtccacggacaatacagaacctaagaaagcgataccatctaagtttgacagaagagcaatgcgtgtccttggtgctctctctgatcagcagcagcttagatgcatggcggacacggcagtacgattattatcaaagggttttaaatggaatattgtgatga

SEQ ID NO: 436 - DNA, 473 bp, Sorghum bicolor
agctcacattggtcctcttaccagtgacgatggccggcggacagcggcagcgtcggtggggggcgacggacgtggcgtcgtggtgcgccctgctggcgctcgtgatggtcgttggatcgctcgccgggtcgggggacgacgaggagcagtacgacagaggcgggcgccgcttggtggtgcgcggggcgcggctggcggcggcgcggccgtgcgacgagctgtacgtggtggcggagggggagacgctgcacagcatcagcgccaggtgcggcgacccctacatcctggagcacaacccgcacgtccacgaccccgacgacgtcttccccggccttgtcatcaagatcacgccgcgcgccgccgactccaactccaactccaactccggcgacggcggtggcgccaagaagtgaagtgaaacggcaccagaccacgcgcagacctgtatgtgtatatgtatcgccgggaactag

SEQ ID NO: 437 - DNA, 3100 bp, Oryza sativa
gttgctgattccctcactgctgctcgtttctcgccattgcggccgttcttggctactgacagaagaggaatgacgaatttgtccgggaagaaatctctgaatacagtgaccttggtcttcaaattaccctactacacacaatgggggcagagtcttctcatcgccggctcagagccagcacttggatcttggaatgttaagcaaggattgtctctcagtccagttcatcagggaaatgagctaatctggtccggcagagtttccgtcgctactggttttacctgccagtacaattactatgtagtggacgacaacaagaatgttttgagatcggagtccggggagaaaaggaaattagtacttccagagggtgttcaggatggagatgtagttgagatacgcgactggtggcaggatgcttctgaagctcttttccttcgaagtgcattcaagaatgtcattttcaatgggtctgaaaatgctaaaagagaattgaagactacatccctcaacaaaagtttggagcctgaagatattgttgttcagtttattgttagctgtccccgacttggagctggctctactgtcgtggtcacaggaagtaatcctcaattaggaaggtggcaaacacaagatggcctcaagcttaattatgtcggagattccatctggaaagcaaactgtctgttgcgaaagtctgagttcccaataaaatataaatactgtaaaattagtgaagcaggagtctcttcattggagttcggtccgaacagggaggctgatgtggatctatcatcacccaagccatccagatacgtcctcttgtctgatggtgcccttcgggaatcaccatggaggggtgcaggtgttgctgtacctatattctcgatcaggtcaaatgaggaccttggtgttggagaattccttgatcttaaacttcttgttgactgggcagtcaactcaggctttcatcttgttcagcttcttcctatcaatgatacttcagttcacgggatgtggtgggattcatacccatacagctcgctctctgtgtttgcattgcaccccttgtacctgagagtacaagcactttcagatgcaattccaggggatattaaggacgagatttcacaggcaaagaagcagttggacaaaaaggatgttgactatgaggcatcactggcctcaaaactctcgatagcaagaaaaatattcaaattagagaaagacaaagtactaaattccagttcgttcaagcagtttttatctgaaaacgaggagtggttgaaaccatatgctgcattttgttttctgcgggacttctttgagacatcagatcacagccaatggggccgtttttctcagttttccaaggagaagctagataagcttgtttctgaaggtaccttgcaccatgacgttatatgtttccattactacatccagtaccatctatatatgcaattatcagaggcagctgcctatgcaaggaagaaaaaggttattctgaaaggagatttacctattggtgttgataggaatagtgtggatacttgggtataccccactttatttcgcatgaatacagctactggtgcacctccagattatttcgacaaaaatggacaaaattggggttttcctacatataactgggaggaaatgtcaaaggataattatgggtggtggcgagctcgtctgacacagatggcaaaatacttcactgcatataggatagaccatatcttgggtttctttaggatatgggagcttccagatcatgcagccacaggtctagttgggaaatttaggccttcaattgctctcagtcaggaggagcttcttagtgaaggcctatgggatttcgatagaatgagccgcccttatattcttcaggaaacactggaggagaagtttgggtccttttggacagtaattgcagctaactttctaaatgagtacaagaaacaacattacgagttcaaagaggactgcaatacagagaaaaagataattgcaaagcttaagaacagttctgaaaaatcattatggctggagaaagaagacagcattcggcgtggtttgtttgatctactacagaatatagtccttattagagatccagaggacagcacaaaattttatccccgcttcaaccaggaggatacttcaagttttaacgatctagatgaacatagcaaaaatatcctcagaagattgtactatgactattattttgctcgccaagagaatctctggcgtcaaaatgcgctcaagactctgcctgtgcttttgaactcatcggatatgttggcatgtggggaagatcttggccttatccctgcctgtgttcaccctgttatgcaagaacttggattgattggattgcgtatccagagaatgcccagtgaaccaaacttggaatttggtattccatctcagtatagctacatgacggtttgtgctccgtcatgtcatgattgctccacattacgtgcttggtgggaagaagatggaggaagaagaagccgtttctaccagactgtaattggtagtgatgacgagccgccatctcgctgcaccccagaagtagcgaactttattgttaagcagcattttgatgctccatcaatgtgggcaatcttcccactacaggacctgcttgcacttaaagacaagtacaccacaagaccagcaaaagaggaaacaatcaatgacccaactaacccgaagcattattggagattccggctacatgtgacattggattcgctgttggacgataaggacatccaagcaaccatcaaggaacttgtcacaagtagtgggaggtcatttcctggtaaggtggatggcgccgaagaaagcggagagaagctagctaaagtccagttgaatggtaaaccatagaaaattatcccaagaacagccgaagggtatcacggtcaaaagtaaatagaataaggcagcgtactgccaattggcatgccagttcagctggtgttgtttcagctagaattttttttacgccaacttaattccatttaacactggaaataattagtatcattcatcaagtcggcatgtggaataatttatc

SEQ ID NO: 438 - DNA, 1512 bp, Oryza sativa
actggcagttggggaggtagccgaagcgccgagaaaaatggccacgcggccactcgctgcctccactcttcttcctcccctccgcttctgctcccctctcaaaaccccacctccctctcctcctcctcctcacctccgccgcctccaaaccctaacccgcgcgctcgcctcctcctcctcagccatggcgtcgccgcccgcgaagaaggtgctggtgccgatcgcgagcgggacggagccgatggaggccgtcatcaccgtcgacgtgctccgccgcgccggggccgacgtctccgtcgcctccgtcgaccccggctccgcgcaggtcggcggagcctggggcgtcaagctggccgcggacgcgctgctcgacgacctcgccgacgccgaattcgacctcatctcgctcccgggaggtatgccagggtcttccaatcttagagactgcaaacttctggagaacatggttaaaaagcacgcaggaaagggcaaactttatgctgcaatatgtgctgcaccagctgtcgctctaggatcatggggtttgctgaatggattgaaggcaacttgttatccttcattcatggataaacttccttcagaggtcaatgctgtagaatcgagggtgcagattgatgggaactgtgtgaccagtcgaggaccaggaacggccatggagtattctgttgttttggtcgaacaattatatggcaaagaaaaagctgatgaagttgctggtccaatggtcatgcgcccccagcatggtgtggagttctcattgaaagagttgaattcaactagttggaatgttggtgaaacacctcagattcttgtaccaattgctaatgggacagaggagatggaagcaactatgataatcgacatcctcagaagggcgaaagcaaatgttgtcgttgcgtccttggaggaaactttggagattgttgcatccaggaaagtgaagatggttgctgatgttctgttggatgatgctcttaagcagcaatatgatctcattttgttaccaggtggtcttggtggtgcccaagcatatgcaaagtcagataaactgattggtctgatcaagaagcaagctgaggcaaacaagctatatggagctatatgtgcctcgccagcaatcgcccttgaaccacatggcctgctgaagggaaagaaggctacatcctttcctggtatgtggaacaagctctcggaccaaagcgaatgcaagaacagggttgtcgttgatggcaacctaatcaccagccaaggtccaggcacatccatggagttctctctcgccatcgtggagaagctgtttggtcgggagagggccgtcgagctcgccaaaaccatggtcttcatgtgagttgtgttgttacatactacgtgtaagacaacaccatagtcagactctgaatatgaggcatccttttgctcgtagctggtgtggtggaaagcacttcgtaatccttttttttggctttctcttccacaataacacgacgtctt

SEQ ID NO: 439 - DNA, 929 bp, Zea mays
tcacgatgctgctcccacactcttcgtcagcctctgcaactgctaccactcgtgggctagcactagcagcagcagcaccgccgccgcgtccgaccgctcgcccccggcgcgcacgcctcctgcctccacgcgcgcgggccgagacgcatgcgacgggcgttggcgccgaccgcgcggccgaggcgcttctccagagcgggctgcgccgtgagtcgctgccgcggcacgtcgcggtggtgatggacgggaactcgcggtgggcgcgcgagcgggggctgacgcccgcggacggccacaaggccgggggccgcaacctggagcgggtcgttgcgctgtcgcgcgcctggggcatccgcgcgctcaccgccttcgtctgctcccgcgagaacttgagccgccccaaggccgaggtcgactacatgatgggcttgtccgagtggctgataggcgacaacatcgacaagctctcgaggcaggggatccgactgcaggtgatcggcgacgccgcgaagatgccagcctctctgcggagcgcagcggcgcaggccgacgaggccacgaggcaaaactcgcagctgcacgtgatgctggccatctgctacagcgggcgatgggacatggtccaggcgtgccgggagctggcccgggaggcgcaggcgaaccggctcagtccggacgacatcgacgagtcgatcatcgccggcaagctcgcgacgagcgccgccggcgagttctcctgtcccgacctggtcatcagaaccagcggcgagatgaggctcagcaacttcttgctatggcagtcggcgtactcggagttgttcttcaccgccaagatgtggcctgactttggggaggctgagtacctggaagcgttgcgctccttccagggcagagaccgccgcttcggccaatcaaaattactctaataa

SEQ ID NO: 440 - DNA, 1292 bp, Sorghum bicolor
gcatcgccatggctctcgccgtccgcacgccccgcttccagcctcgacggacctccatttctgcgcccgcaccacccgcctcgacatccctcgccgccgcgaacgcgaggccccgcgcctgcgccgccgccgccgtccgcgcctcgcccttcaccgaggccacctcctcctcgcgctaccgccgcgacgcctggtcctacgccgccgccgatggctcctccagctccgcatccccgtcctcttccgatgctgccgctgccgccgccgctgcggcggcggcggcgggccgccgggacgacgagatcgcgctgcagctgccggagctgcggaggctcctggacgcgctgagggcgtccagggggaagggcgccgagggggcagacggcggcggcgggcccgggagggtggcgctggtggggacagggcccggggaccccgagctgctcacgctcaaggcggtccgggccatcgaagcggcggacctggtgctctacgacaggctggtgtctaacgacgtgttggacttggtcggggagggcgccaggctgctctacgtcggcaagacggcgggataccacagccgcacccaggaggagattcacgagctgctgctgagctttgccgaggctggtgccaatgttgtccgcttgaaaggtggcgatcctctggtttttggaaggggcggagaagagatggatttcttacagcaacagggaatcaaagtcgaagttatcccaggaattacttctgcttcaggaattgcagcagaactaggcattccgctaacccatagaggtgttgctaccagtgtcagatttttaaccggccactccagaaatggtgggacagatccactacatgtagctggaagtgcagctgatccagacactactttggttgtgtacatgggtttgtcaacacttccatcacttgctccaaagttaatgaagcacggcctgccgccagatacccctgctgttgcagtagagcgcgggactacacctcaacaacgaacggtgttctccttgttaaaggatcttgtggatgaagtcaagtcagctgatctagtttctccaactctaataattatagggaaagtggtatccttgtcgcccttctgggtggagtcatctgaacatgatgcactgaaaattgagagctcttatacaaatgaaaccagatgatagcgcgttttcctgattttagtgattggacaatacttaagtaatgaaatatcccagatacgagcagttccaattgagatccatttaggaaatgcaagcacaggttcg

SEQ ID NO: 441 - DNA, 1445 bp, Triticum aestivum
ggtttgtattgtagctcgagaattgaaacaacttggtaatgagttgtttttctcgcattttcaagaggacgagcgggggtcagcaacaaactggtccactcaatgaggacctcccgggtgttgagaacataacaagatttagctataaggagttggatagggcaactgcaagatttgaccaatccaataagattggtgagggaggttatggaccagtttataagggaacactcagggatggaacagccgttgcagtaaaggtgctctctttgcagtctaggcaaggcgcgagggaatttcttagtgaacttattacgatctctgatatttcccatgagaatcttgtcaagctttatggctgttgtgtggaaggaagccacaagatccttgtctataattatcttgaaaataatagccttgcacaaacccttctaggttctcagcagcatagcagcatccagtttaactggagtactcgagtgaatatttgcattggtgttgcccagggactagcatacctccatgacggtgtccggcctcatgttgtccaccgggacatcaaagctagcaatatacttctggaccaggatcttaccccgaaaatttccgattttggcttagcgaagcttctaccttcggatgtatcacatattagcacaagagtcgcaggaacgctaggttacctagctcctgaatacgccatacgaggacaagtgacccggaaatcagatgtctacagcttcggcgttctgctgatagaaatagtcagtggaagatgcaacactgacacaaaactaccctacgaagatcagattcttcttgagaagacgtgggcatactacgaccaggggcagctggacgagatcatcgacagctccctgggcgacgacctggacgtggacgaggcgtgcaggttcctgaaggtggggctcctgtgcaccaagaacgtgacgaaacggcggcccgacatgtcgatggtgacccggatgctgaagggcgaggaggacgtggagtcgcatgagatcaccaagcccgacgtgatccgggacttcagggacctgaagctgaggagcaaggccacgtcgtcgtcgctgctgacctccatcgtggcgcgctcctcgccgtcgtcgtcgtcgtccaccggcaacaccacccgcacctccatcaccttcaccgccatatcggaccgcccctgaccgaagaggcgcgcgggaggaaaatagacacgaagagactgcagagaaaactgtagatagccgtagcgcagcccaggtttttcctcttttcttgtggtttgtatggtctgtgtggtatagtagccttcatactttcattcactttactctttttttttggcggggcacttcacttgattgtttctctgtataaaagggttatacccatttttttatcaatagaaaccaagctcatgtagttcacggcaa

SEQ ID NO: 442 - DNA, 1228 bp, Triticum aestivum
cgacttgatccgatctccagccgacgccggcgaccatggctcgccgtcaccacctcctcctcctcctccctctcctcgcgctcgccttctccttcgtcgccgccgcccctgagggacagggagatgccgccgccttcatcgacggcgcgtcgcaccgctacctgcgggatcagcagggcgaccaggccacgtcgatgtcacttgatgaagtttccgcagctgtttctgtcttgcttggttttgcaccacctgccatgcttcccgcgccttcttctgcaaagttaaacgagctgctactcccaaagccatttgacaggcctcgtgctgttttcttgatgcaaattgatgggtcccatgactctgtcgatagcttcgtatctgatgccggtagtatttacaaaaccaagattgatgttgcaaaaaatgctgctacagggcttacagatagggatgaattgattgtcattcgttcagatgaatcttctggatcagatgttcttgataatgaactcaccaacttggcaacctggttggagggatcctatcagaaggctgatagcaaattaatcatcccattgaagagtggaaacagtcttactttgctcctcaataaggaagtagacgttgaatttgcatccagcttgatctcccttctcaaaaccatcaaaaggggtattcaggttcacgaagatttctcaggaggcattgtgagccctgcagagttattagtatgccacttcacgggcattaaggctctggaagatgaatatggttccgcagaaattgtcaagcagggagtggaagtagttcaaacagctctcaccaaagcatttgatcaattgcagggagcatataatgggaaaattgttgggctggtaatatccaccaaggaggcttcaacatccttggcatccatcatcgatgcaccgtcttcattgcatatctcaagacggcttgcagaagcatctaaaactaatgctacagcttctatagctgctatatatcttgttagattgagtcttgcatggattacagggatcatctttcttgtgtcaactctcattgggatttgcctgctcatgaacatgccgcttaccagggacacgctcctctattcgaatgtcaagatggattagtttgtgctacatatgaattttcgcacgatgtcattgaagttgtcaacagtcatgcgtgtttttattctttggaccttgggtttacaataggg

SEQ ID NO: 443 - DNA, 525 bp, Sorghum bicolor
aatccgatcctgaaccattcatgcagcatggcagcctcagtcatggcctctttgtctctgaaaccatctccatttttggatcggtcgaggttcacaagtgtccagccatcagcaagatcttcaaccttcagagtaatggccaagaaaacaaagaagatcaaaacatcccaacctttcgggcctgcaggagggttgaacttgaaggatggtgttgatgcatctggaaggccagccaaggggaagggtgtctaccagtttgccaataaatacggagcaaatgttgatgggtacagtccaatatataacccagaagaatggtctccaagcggtgacgtttatgttggaggaaagacagggttgttgctctgggcagtcactcttgctggaatattgctgggtggtgctcttcttatttacaatactagtgccctggcttcttgaagcctggctgcagcaaataaaattatgtgccatgcagtgtcacgtagatatatctgtatccaggtgtccctagatccgtaggat

SEQ ID NO: 444 - DNA, 588 bp, Hordeum vulgare
ggaagagcgagagcttactgtcattcatggcaacctcgaccatggcttttatgcctctgaaaccatctccatcgacattttctgggcattcgcagctccagcgcatccagcctttcacacgatcatcatctttcagagtaatgtccaaaaaggcaaagaaagttcagacttctcagcctttcgggcctgggggaggattggaattgaaagatggcgttgatgcatctggaaggccagccaaggggaagggcgtctaccagtttgccagcaagtacggagcaaatgttgatgggtacagcccgatatataacccagaagaatggtctccaagtggtgattactatgcgggaggaaagacatggttgttgctctgggtggctactcttgctggaattctgctgggtggtgctcttcttgtttacaatactagtgctttggcttcttgaagcctggtatagcaagccaaactatgtactgtaccatgcaaggatttacatcatctagggtagatattcgggcacctatatccctaggcttaattaccaaaaataatggtcttatatgttgtgcaactgatgtaatcaaggc

SEQ ID NO: 445 - DNA, 1597 bp, Solanum lycopersicum
cctattaatctgtgcaaacccttgtaatttcatcaagtctaaaagccttttggtatctttactccaacaatggcggctacacaccttgtctcacactctccatcacttcacaagtccctcaaatacccatcaaatgcatcacaaaaactttcttttttcaaacccaattttccgttgaagcccatttcaagaaaccttagcataagggcatctgtatcaacttctgagcctcaaactcagaaatttcagcattgtttcaagaaatgtgaagatgggtttttgtattgtgagggtgttaaggttgaagatgttatggagactgtcgaaagacgacccttttatttatatagtaagccccaaattactaggaacgttgaggcttataaggccgctttagagggcttggattcaattattggttacgctattaaggccaacaataatctcaagattttggaacatttgaggagccttggttgtggagctgttttggttagtgggaatgaactcaaattggcacttggtgctggatttgatcctaccaagtgtatttttaatggaaatggaaagctgttagaggacctagtgctagctgcccaagcaggtgtgtttgtaaacatcgacagtgaatttgacttggataacattgtagcagctgcaagactggctgggaagaaagttaacgtgctactcaggattaatccagatgtagatccccaggttcatccttatgttgccactgggaataagagctccaaatttggcatcagaaatgagaagctgcaatggtttctagatgctgtcaaggcacatcctcaggaattgaaacttgttggagctcattgtcatcttgggtcaactatcaccaaggtagacatttttcgagatgcagctgccttgatggtgaactacattgacgaaatccgatctcaaggatttgaaattgattacctgaatattggaggtggtttagggattgattactatcatgctggagctatccttccttcacctagagatcttattaatacggtacgagaattagtcctttctcgaaacctcaatctcattattgaacctggaagatcactaattgcaaacacatgctgcttggttaacagagttactggagtgaaaaccaatgggaccaagaactttattgtgattgatggtagtatggctgagcttatacgtccaagtctttatgatgcttatcagcacatagagcttgtttcccctccacctccggaagctgcaattgctaagtttgatgttgttggtcctgtatgtgagtcggctgatttcctggggaaggaccgtgaacttcccgccccttctaggggcactggtttggtagttcacgatgcaggtgcttactgcatgagtatggcatcaacttacaatctcaaaatgcgcccaccagagtactgggtggaagaagatggatcactgtccaaaatccgtcatggggagacattcgaagaccatttaagattgtttgaaggtctgtaaacttatggtttcttttaagcacttaaacatgacaggatgtgagactcagaaattcctctggtagtttggttcctgtcagtgttga

SEQ ID NO: 446 - DNA, 1505 bp, Sorghum bicolor
ggtgatcttgggggttcccatgggcggatgcttctcgcaggaggagcaccggctccagagcaggccagctgaagctgctggaccagacggactgaggaagtctaaatccgattctaaagttatagcaagtgttcttgctcctccaaaagatgtggtggacctgcaagtagaaggatatggaaatgtgaatattttcacatatgatgaattgagagcagccacaaaaaactttcgaccagatcaaattcttggagagggtgggtttggagttgtttacaaaggtgtaattgatgaaaatgttagagcaggtttcccatccagacaggttgctgtgaaagaactaaacccagagggctttcaaggggacaaggagtggctggcagaagtcaattatcttgggcaacttagtcatccaaatcttgttgaactgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgcgaagctttcagactttggtctcgcaagaacaggtcctagtggagaccagacccatgtgtcgactcgggtcatgggaacttatggatatgcagctccagaatatgtcatgactggccatctgacggcacgaagtgatgtttatggctttggagttgtgcttctagagatgattattggaagaagggctgtagacaagagccgaccgagccgtgagcataacctagttgattgggcacggcccctcctcgtccataacaggaagctgttccgaataatcgatccaagaatggaagggcaatactccaccaaggctgccattgaggtggcaagccttgcataccgctgcctgagccagaatcccaaaggacgaccaaccatgagccaagttgttgagacctttgaggcggtgcagaacatgcctgaatgccaagacatactcctccagaacagtatcacaggtgccgtgacgctctatgaggtcccaaaggagcctgcagacagagttgaattggagaaggccaagcaggaaccggcagtaaagaccaccgcaatgccaccccccgtgaatggaaagccagtcccccagagcaggcgaacacggcctgggaatggccggagcaagagcgagccatcgttggagtgtaagatgtacatcccgtcaccagactctgacggacagcagctcggcctggaggcactcgcatccccaaatggaagcataaaggaccctcctgatgaggatttgtacaagatataacaccagagcagtttttttttcgacaacgtgagccctcgttgcttgccttttgtgccttcaccccctgttctcaaagatcagccag

SEQ ID NO: 447 - DNA, 750 bp, Hordeum vulgare
cgtcgctagccatcttccaagaatggcgccgcaccatcttgccctcctcctgctcgccgtactgctccgggcggcggccacggccgacccggacgcagtgcaggacttctgcgtgccggacgccggccccggccggccggtggagctcaacctgatccgctcctacccgtgcaggagcccgggcaacgtcaccgcgggcgacttcgccttctccggcgtgcgcgcggcgggcaacttctcggcggacacggggttcgcgggggtgtcggtcacgccggcgcagttcccggggctgcacaccctgggcatgtccttcgcccgcgccgacctctcggcggccggcggcgtcaacccgccgcactaccacccgcgcgccaccgagacggcgctcgtcctcgccggccgcgtctacgccgggttcgtcgacacggccggccgcctcttcgccaaggtgctcgtggagggggaggtcatggtgttcccccgcggcatggtgcacttccagctcaacgtcggcgaccagccggccaccgtctacggcaccttcaacagcgagaaccccggcatcgtgcgcatcccggccaccgtgttcgggtcagggatcaggggcgccgtccttgagagggccttcgggctcaccgcggaggagctccggcggatcgagaagaggttcggcgtgcccaagaaggccgacgagctggaggactagctagttaattcgtttattagtgatggctgatgagtacttgg

SEQ ID NO: 448 - DNA, 797 bp, Oryza sativa
ctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccgcattcctgttaggacttaggagaagtaatgtcaggagtattagcaaaattcgctattgcatctgcggtgatgtggacagctccagttgccatcgtgtatggattttactaccagatgattccaggtgtgagtcaactgtcatcctcgacgcaaactctagcaagtggattccttgctgttatatcgattaatctggtaatcggcttttatatatgcatggcgatgaaggagactccccaccaagagccacaacctgatccaaccttcttggcaaatgctaaagcaagcattgatcaaccaactccgtctcaagtgaatgatgattcccatggaaagggaaaggtggagtaggtcatatcacaacatgtgcatgtttcacatgttatccagaaacagttcttctcgataccctgccttctaattcaatattatcttctgtaaatcttgagaattatggaaccaatatgagttttaccttttgtactgttattatcgagatactgtgttagaattatttttgtttggctgcagagaactactttggctggctgt

SEQ ID NO: 449 - DNA, 3721 bp, Arabidopsis thaliana
tctcaacctttatctgatcgcaccaaaccagttttttcgcatcggcttcttccttttgctactagctctcctctcttctccgaaaatggcgttacaaaacaaagaagaagagaaaaagaaagtgaagaagttgcaaaagagttacttcgatgttctcggaatctgttgtacatcggaagttcctataatcgagaatattctcaagtcacttgacggcgttaaagaatattccgtcatcgttccctcgagaaccgtgattgttgttcacgacagtctcctcatctctcccttccaaattgctaaggcactaaacgaagctaggttagaagcaaacgtgagggtaaacggagaaactagcttcaagaacaaatggccgagccctttcgccgtagtttccggcttacttctcctcctatccttcctaaagtttgtctactcgcctttacgttggctcgccgtcgcagcagttgccgccggtatctatccgattcttgccaaagcctttgcttccattaaaaggcctaggatcgacatcaacatattggtcataataaccgtgattgcaacacttgcaatgcaagatttcatggaggcagcagcagttgtgttcctattcaccatatccgactggctcgaaacaagagctagctacaaggcgacctcggtaatgcagtctctgatgagcttagctccacaaaaggctataatagcagagactggtgaagaagttgaagtagatgaggttaaggttgatacagttgtagcagttaaagctggtgaaaccataccaattgatggaattgtggtggatggaaactgtgaggtagacgagaaaaccttaacgggcgaagcatttcctgtgcctaaacagagagattctacggtttgggctggcaccatcaatctaaatggttacatatgtgtgaaaacaacttctttagcgggtgattgcgtggttgcgaaaatggctaagctagtagaagaagctcagagcagtaaaaccaaatctcagagactaatagacaaatgttctcagtactatactccagcaatcatcttagtatcagcttgcgttgccattgtcccggttataatgaaggtccacaaccttaaacattggttccacctagcattagttgtgttagtcagtggttgtccctgtggtcttatcctctctacaccagttgctactttctgtgcacttactaaagcggcaacttcagggcttctgatcaaaagtgctgattatcttgacacactctcaaagatcaagattgttgctttcgataaaactgggactattacaagaggagagttcattgtcatagatttcaagtcactctctagagatataaacctacgcagcttgctttactgggtatcaagtgttgaaagcaaatcaagtcatccaatggcagcaacaatcgtggattatgcaaaatctgtttctgttgagcctaggcctgaagaggttgaggattaccagaactttccaggtgaaggaatctacgggaagattgatggtaacgatatcttcattgggaacaaaaagatagcttctcgagctggttgttcaacagttccagagattgaagttgataccaaaggcgggaagactgttggatacgtctatgtaggtgaaagactagctggatttttcaatctttctgatgcttgtagatctggtgtttctcaagcaatggcagaactgaaatctctaggaatcaaaaccgcaatgctaacgggagataatcaagccgcggcaatgcatgctcaagaacagctagggaatgttttagatgttgtacatggagatcttcttccagaagataagtccagaatcatacaagagtttaagaaagagggaccaaccgcaatggtaggggacggtgtgaatgatgcaccagctttagctacagctgatattggtatctccatgggaatttctggctctgctcttgcaacacaaactggtaatattattctgatgtctaatgatataagaaggataccacaagcggtgaagctagcgagaagagcacgacgcaaagttgttgaaaacgtgtgtctatcgatcattttaaaagcaggaatactcgctttggcatttgctggtcatcctttgatttgggctgcggttcttgttgatgtagggacttgtctgcttgtgattttcaatagtatgttgctgctgcgagagaagaaaaagattgggaacaaaaagtgttacagggcttctacatctaagttgaatggtaggaaacttgaaggcgatgatgattatgttgtggacttagaagcaggcttgttaacaaagagcgggaatggtcaatgcaaatcaagctgttgtggagataagaaaaatcaagagaatgttgtgatgatgaaaccaagtagtaaaaccagttctgatcattctcaccctggttgttgtggcgataagaaggaagaaaaagtgaagccgcttgtgaaagatggctgttgcagtgagaaaactaggaaatcagagggagatatggtttcattgagctcatgtaagaagtctagtcatgtcaaacatgacctgaaaatgaaaggtggttcaggttgttgtgctagcaaaaatgagaaagggaaggaagtagtggcaaagagctgttgtgagaaacccaaacagcaggtggagagtgttggagactgcaagtctggtcattgcgagaagaagaagcaagctgaagacattgttgtcccggtgcagattattggtcatgcattaacgcatgtggagatcgagttgcagacaaaggaaacctgcaaaacaagctgttgtgacagtaaagaaaaggttaaggagacaggtttgctgctttctagtgagaacacaccttacctggagaaaggagtgctgattaaagatgaaggaaactgcaagtctggcagcgagaacatggggacagtgaaacaaagctgccatgagaagggctgcagcgatgaaaaacaaaccggggaaataactcttgcttcggaggaagagacagatgatcaagattgctcttcgggatgttgtgtgaacgagggaacagtgaaacaaagcttccatgagaagaagcattctgtgttggtggagaaggaaggtttggacatggaaactggtttctgttgtgatgccaagcttgtttgttgtggaaacacagaaggtgaagtgaaggagcaatgtcgtctggagataaagaaagaagaacattgcaagtctggttgctgcggcgaggaaaaacaaaccggagaaatcactctggtttcagaggaagagacagagagcacgaattgttccacgggttgttgtgtggacaaagaagaagtgacacaaacctgtcatgagaagcctgctagcttggtggtatcaggcttggaagtgaagaaggatgagcattgtgagagctcacacagagccgtcaaggtagagacctgttgcaaagtgaagattccagaggcttgtgcatcaaaatgtagggacagagcgaagcgtcacagtggtaaaagctgttgcaggagttatgcaaaagagttatgcagccaccgccatcatcatcaccaccaccaccaccatcaccatgtgagtgcttgatggagattgattgaataacttaaactcttgatgcatccatctattcacattacgtttagtctcattccgtgaatgccgaaataaaaaacaaaatgttccagcaaaggcagtttatta

SEQ ID NO: 450 - DNA, 932 bp, Hordeum vulgare
gcagagcaccacagggtagctaccagtagcacatacactaacaatggcgatggcaagggtgcccatcctcgtcgccgtggccctcatggccgcgtcggcctcctgcagcgcatgggatcccaccatccggatggtcgacgacgcggtggcgccgctcatccacgcgctgcggccgctgctgggctccggcgggcagctggggagccgcggcggcgtgccgtgcgacagctggcggctgggcgtggaggcgtacaacgtgcgggactggaagacggtgccggccaactgcgagggctacgtggggcactacatgctcggcaaccacttccggcgcgacttcaaggtcgtcatcgatcaggccatcgcctacgtcgacggcctcaagctcgccggcaacggcaaggacgtgtgggtcttcgacatcgacgagaccaccctctccaacctcccttactacgccacgcacggctttggggctaggccatacaacgcgacgagcttcgacgcgtacgtgctggaggggagcgcgccggcgctgccggagacgaagcggctctactacaagctactcaaggtgggcatcaagccggtgttcatcacaggccggacggaggacaagagggccgtcaccgtcgggaacctccgcagccagggcttctccgggtggatgaacctgacgctcaagcagcacggattcaagggctccgccatatcctacaagtccgccgagaggaagaagctgcaggacgccgggtacgtcatcgtcggcaacatcggcgaccagtggagcgacatcctcggcgcgcccgagggcgctcgcaccttcaagctgcctgaccccatttactacatcgcctaggtcggctgcggccatttggttgccccatgctcgtgctccacgaataataatcaagctccatgctctcttgata

SEQ ID NO: 451 - DNA, 3554 bp, Oryza sativa
aaaggatccttacctgcgtcttgttcttcttgggagttgggtggatcgattgatcgaggttttggaggttggaagaagtgtgtgttgtggtggggggtttgtagagagagagagggcaaaggcacgcaaagagggagagagtgaggagagatggcggcggagggagggaggtgtcagaagagctacttcgacgtgctggggatttgctgcccgtcggaggttcccctcgtcgagaagcttctgcagccgctggagggcgtccagaaggtcaccgtgatcgttccctccaggacggtcatcgtcgtccacgacgtcgacgccatctcccaatcccaaatcgtcaaggcgctgaatcaggcaaggttggaggcgtcggttcgggcttatgggaacggcagtgagaagatcaccaacaaatggccgagcccgtatgttctcctctgcggacttcttctggtcgtgtcgctgttcgagcatttctggcacccgctcaagtggttcgcgctggtggctgcggccgccggcttgccgccgatcgtgctgaggagcattgcggccatccggagactcaccctggatgtcaacatactcatgctgattgctgttgctggagcaatagctctcaaggactattctgaggctgggttcatcgtcttcctcttcactacagctgaatggcttgagactagggccagccacaaggccaccgctgggatgtcagctctaatgagcatggcaccacaaaaggctattctggcagagaccggggaggtggttgcagcccgggatgtgaaggtcaatacagtaattgctgtcaaggcaggggaagtcattccaatcgacggtgttgttgttgatggacgtagtgaggtcgacgagagcaccctcacgggggagtccttcccagtgtccaagcagccagactcccaggtctgggctggcacactcaacattgacggttacattgctgtgaggacgactgctatggctgacaactccgcggtggccaaaatggcaaggttggttgaagaagcacaaaacagcagatccagtacacagaggctgatcgacacgtgtgctaagtattacacacctgcggtcgttgtcatggcaggatcagtagcagcaattcctgcaatagcgaaagcacataaccttaagcactggttccaattggctctagttcttctagtgagtgcttgtccatgtgcactggtactgtccacacccattgccaccttctgcgcgctactaagggccgcaaggacagggctgctcatcaaaggaggagatgtcctggaatccttggctagcatcaaagttgcagcttttgacaaaactggtacaattactagaggagagttcagtgttgaggagttccagccagttggtgaacgtgtttcattgcaacaacttctttactgggtctcgagcgttgagagcagatcaagtcaccccatggcatctgtcctggttgattatgctcaatcaaagtctgtggaaccaaaatcagagaatgttagtgaattccaaatatatcctggtgaggggatttatggtgaaatcgacggagcaggcatatatattgggaacaaaagaattttgtcaagagcttcatgcgaaacagttccggacatgaaagatatgaaaggagttaccattggatatgtggcatgtaacaatgaattgattggagtattcactctatcggatgcctgccgaactggatcagctgaggccatcaaggaactgagatcactgggcattaagtcagtgatgcttacaggtgatagtagcgctgctgccacatatgcacagaatcagctgggaaatatccttgctgaggttcatgctgaacttcttccagaggacaaagtgagaattgttggtgaactcaaggaaaaagatggccctacgctgatggttggtgatggcatgaatgatgccccggcattggctaaagctgatgttggagtctctatgggtgtatctggttcagctgttgcaatggagacaagccacgttgctctgatgtcaaatgacatccgcaggattccaaaggctgtccggctggcaaggaggacgcatcggacaatcatcgtgaacatcatattctcggtgattacgaagcttgcaatcgttgggcttgcatttgccggacatccacttatctgggcagccgtccttgcagatgttggcacatgcttgctggtgatcatgtacagcatgctgttgctgagagagaaggacagtcgaaaggcgaagaaatgtgctgcttctcatcacggatctccaaagaagtgctgttcttcttctcatcatggatctcatgcaaagaaaaatcatggcgtttcccaccattgttcggatggtccgtgcaaatcaatggtcagttgcaaagaatcatcagttgcaaagaatgcttgtcatgatcaccaccatgagcataaccatcacgaagagccagcccacaagcattcttcgaaccagcatggttgccatgatcacagccatggccatagcaactgcaaagagccaagcaaccagctgattacaaacaagcatgcttgccatgatggtcataaccactgcgcagatacgagcaatctgcacgacaccaagaagcatgactgccatggccatgagcatagcacctgcaaagaagaactcaacgctttgcctcccaccaatgaccatgcttgccatggccatgaacatagccactgtgaagaacccgttgctctgcactctaccggcgaacatgcttgccatgagcatgagcatgagcatatccactgtgacgagccaatcggctcgcattgcgctgataagcatgcttgccatgaccatgaacaggttcatgagcatcattgctgtgatgaacagcaaactccgcacaccgcagatttgcacccctgccatgaccatgaccatgacaacctggaggtcgaggaagtaaaggactgccatgctgaaccacctcaccaccacaaccattgctgccatgaacctcatgatcaggtcaagaatgatactcatccagtccaggagcactcgatctcgatcgaagaatcatcagaccaccatgagcatcaccacaacgaagaacacaaagccgaagattgcggacatcatccgaagccgaaagattgtgctccacctccaactgactgcatcagcagaaactgttgcagcaataccagcaaaggtaaagacatttgctcgagcttgcacagggatcatcataccagccaggccagccggtgctgcaggagctatgtgaaatgctccaggcccagcaggagttgctgcagccacagcatagtgaagctgcctgagatcgtagtggagtagtaggaaattcagcaatgtctgcacatatcatcagaaaatatagcaacctcgtcatcggcgaaatgtagaaaaagccgatgctgctatgcgtttgatctttttttttttagtcgtgctgcttttgcttcagctaaagaaaaaaatgttgtttgtagaggtgtctggttttgagacgaagcaggtgtttgaatggtaccttt

SEQ ID NO: 452 - DNA, 1924 bp, Oryza sativa
agtgaccaactgaccacttcccgccatgtcgccgccgccgccgcagcggccatccccctcccgcgcaggccgcgccaacctcttctcgtccccgccgcctcccctccccaactgctacgaccccaagcaccgccgccccgcgccgccgcctctcccctccgcccgtcgcctccccagcaaccgccgccgccgccacgaccagcctccgaatccgaccaccggcaatggcgggaaccccgccttccgcgcgccgcacctccgcaccgcctaccgcaagcccgtcccacccgtggcggcggcgggggagggcgaggcgctcctcgccgccgacgccagcgacgccgccgacgggcgggccgtggtggtggggccgtcggggctgtcgttccggctcccgggcgcgccgttcgacttccggttcagctactccgagtgcccccgcgccccgccggtggccatccgggagcccgcgttcctgccgttcgcgccgccgacgatgccccggccgtggacggggaaggcgccgctgctgaccaaggaggagaaggcgcggcggcggggcgtgcggctgcacaccccgctcggggaggaggcgcccaggacggtgagcgcgcacgggatcatgatggaggtgagggggaggaggaagctggacctggccagggtcagccccggcgacggcaggagcagggaggaggtgctcggcgagccgctcaccgccgccgaggtgcgcgacctcgtcaagccccacatctcgcacaaccgccagctcaacatcggaagggatggattgacccacaacatgttggaaatgatacattgtcattggaggcgccaggaaatttgcaaagtgagatgccgaggagttccaactgttgatatgaagaatctgtgctatcaccttgaggaaaaatcaggcggaaaggttattcaccgagtaggtggtgtagttttcttataccgtggaagaaactacaaccctcgaacccggcctcgttatccactaatgctttggaagccagctactcctgtctatccaaaacttatacaggaagccccagaaggtcttacaaaagaggaagcagatgaaatgagaagaagagggaaggatctgctgccaatttgcaaattagcaaaaaatggtatatacatctatcttgtcagggatgttcgagatgcttttgagggaagtgatctggtgaagattgactgcgaggggttgaatccaagtgactacaaaaagattggagcaaaactaagggatcttgttccttgtgttcttttgtcgtttgacaatgagcagatattaatgttcagaggcaaggaatggaagtccagatatccaaagcctctgactcttattccaaaaattcgaaagaataatgttccaatgtcatctgatgagagtagttcagatgaagccactgatgatgatgaccgtttggcagtaagagaagtactgagacctaaaatgtttgaactatggacaaatgcgattgagtcatctgtggcactgatgttggatgatgctgaagtggatgctcttacacctgattcccttcttacaagggtagaggacttcagtgttacatctcaggttgtcgaacattcatttccagctgtgcttgtggccaatgatgaatcaaacccagatgtcctaaatgctgaatacaccgaagatgagcctgagacaggtacacttgaaccccaacaacatgagtttacagaatcttctgatgtcgcagaggatgatcatttcgaagatgacatgcttaagcgtttggagtcatcagtcccattgggagcattaccgatcgacgcagtggtaaaacagttgaatgatgagtgaattatattaccaaacaatcatgaattcagtgttcagtccaatggggcaatgacctgcaatcacaaatacagctag

SEQ ID NO: 453 - DNA, 1554 bp, Oryza sativa
agctgacaagaggaggtacgtgtcgccggcgatcgatcgtttgaccgacatggcggcgaaggggagcccggaggaggaggccctcctcgccggcgtcggaggtgatcatcagctggtggagtcggatgagttggcgccagctgcagcggtggtgcgggaggaggtgaagaagcagctgtggctggccgtcccgctcgtcgccggcgcgctgctgcagaacgtcatccagatgatctccgtgatgttcgtcggccacctcggcgagctccccctcgccggcgcctccatggccagctccttcgcctccgtcaccggcctcagcctcctgctaggaatggcaagcgcactggacaccctgtgcggccaggcgttcggctcccggcagtatcatctcctgggcgtctacaagcagcgcgccatgctgctgctcaccgccgtcagcgtcccgctcgtcgtcgtctggttctacaccggcgacatcctcgtcgcgttcgggcaggacgccgacatcgccgcggaggccggcgcgtacgcccggtggatgatcccggcgctgttcgcctacggcccgctgcagtgccacgtccggttcctgcagacgcagaacgtggtgctcccggtgatggcgagcgccggcgcggcggcgctgtgccacctggtcgtgtgctgggcgctcgtctacgccgccgggatgggcagcaagggcgcggcgctgagcaacgccgtgtcgtactggatcaatgtcgccatcctggcggtgtacgtgagggtgtcgagctcttgcaagaagacatggacggggttctccatggaagccttccatgacccgctcagcttcttcaggctcgccatcccttccgctctcatggtctgcttggagatgtggtcgtttgagctcattgtgcttctttcaggtattcttcccaacccgaagctagagacgtccgtgctatcaatcagcctcaacactgctgctttcgtttggatgatcccctttggcctcggttctgccataagcacccgtgtctccaacgagctcggagcgggccggccccgcgcggcccgcctcgccgtccgggtcgtcgtgttcatggccgtctcggagggattggtgatagggttggtgctggttggcgtgcgctacatctggggccatgcttacagcgacgaggaggaggttgtcacatacgtggccaagatgatgctggtcatcgcagtctccaacttcttcgacgggatacagtgtgtcctttcaggtgtggctagagggtgtggatggcaaaaaattggagcttgtgtaaaccttggcgcctactatatcgttggcatcccttcagcttacctcatagcttttgtcttacatgtcggcggaatgggtctatggctaggcatcatctgcggcctcttggtgcaagtcctgctactaatggcaataacactatgcacaaattgggataaagaggcggctaatgcgaaggacagggtcttcagttcttctcttccttcagatctcgcaacatgaagttagaggtgatagttgtgaaagcgtgcttg

SEQ ID NO: 454 - DNA, 1447 bp, Oryza sativa
gaatccccaaaaccctagcccaccccctgccgccatggccgcctcccccaccggctcctcctcctcggcccccgccgccgcggcggcggcggcggccgaggccaccgacgggccgaccctcagcgtcgtctcgaagcggctccgcgcgctgcggaagaagcacaaccggatcctccagatggaggagtcgctcgccggcgggaggaagctcaacaaggagcaggagggggtgctccgatccaagcccgccgtcgtcgcgctcatcgacgagctcgagcggatgcgcgcccctctcgccgccgccctcgccgaggagctctcctcccgccccgccccctcctcctccgccgcgccgccgccccccgcatcctcctccgccgcaggcgccgcggattcgtccgtcgtcgaggatctcctcgcgctcatctacttcggcaccctcttcgacctcaagccgcagaccgagttcgtcgccaccatggtcgcgcgcgcgcaggagcgggactgctgcatcacctacgactacgtcacggaggacgccgccgacctgctgcaccagtccgatctcgacaaggtgtctgctctggccgccctcgccgcctcgcgccctgccgcggcggtgggcgtctcgcaccgcgacgcgctccagtcctgcgcgcagcacgcccgcctctggcttcgccgtgccgatgagccaatccaccccgaatccagcatcacttatgcagcggttagggcgaagttggacaagatcatggcttcagactactacacagcgcaaccggagatgccggagatgggggctgcggtcgatttgtcggctgctgtgcaggagagcatggttgtgtcaccagaggcgccggctgtggaagagagccaggctgagggacacaaggatgagaaggaggcttcggaggctacagaaatctacaacgataatcagcctaatgtagctgatgctcagaatgtggaggatgaagccccggtgaatccttctgaagagttctcagcagcagaggtggagcaggagaagtttgaagcagatgtggaggaacaagagaggaatgcagatcaacagttcacttctcgacggccttaccagaaccagcgcggtggtggtggtcgtggtggtggcaggaggggttaccagaatggaggtcgtggtggacgtggggggcgaggaatgggcggtggcgggtaccagaatggtcgtggtggtggcggcggcggtggctaccagaatggccgtggtgggggtgagggtggtgggtactactataatgagcctggttactaccagcagagggggtacagcaacagaggcaggggtggtcgctctggtggtggcaactcttattacaacaatcaaggtggaggttcgcagggaggtggccacgcccatcctgggagggttgagctgggcgcaaacgcttagcttcctaactag

SEQ ID NO: 455 - DNA, 1251 bp, Arabidopsis thaliana
tggaaaggaaaagagacacacacaaataaagaaaacgaaaaaacttttatacttatattgaagctatggctccgactttgcaaggccagtggatcaaggtggggcagaaaggaggaacgggaccaggacctagaagttcacacggcatagccgcggtcggagacaagctctacagtttcggcggcgagttaacaccaaacaaacacatcgacaaagacctctacgtctttgacttcaacactcaaacttggtcaatagctcaacccaaaggagacgccccaactgtatcctgcttaggcgtgcgcatggtggccgtgggaactaagatctatatctttggaggccgcgatgagaaccgcaacttcgaaaactttcgctcctacgatacggtgacatccgagtggacgttcctgacgaagcttgatgaggtgggaggacccgaggctcgtactttccattcgatggcttcggatgaaaaccatgtgtatgtattcggtggggtgagcaaaggcggtactatgaatactcccacgcggttcaggacaatcgaggcgtataacattgctgatgggaaatgggctcagctaccggatccaggagataacttcgagaaaagaggaggagcgggattcgctgtggtacaagggaagatttgggtggtttatgggtttgcgacctcgattgtgcccggaggcaaagatgactatgagtctaatgctgtgcaattctatgatccggcttccaaaaagtggaccgaagtagagactacaggagcgaaaccttccgcaaggagcgtgtttgcccatgcggtagtgggaaagtatataataatatttgcaggtgaggtatggcctgatctcaatgggcattatggtcccgggacgctgtccaatgagggatatgcgttggacaccgagacactggtgtgggaaaagttgggagaagaaggtgcaccagccataccacgaggttggactgcctatactgctgccactgtcgatggaaagaatggcctcctcatgcatggcggaaagcttccgaccaacgagcgaactgatgatctctacttctatgcggtcaattcagcttaatgcgtgtcaagatttgtgttgtgtgtgtggctcgttaatatttattactatccaataaggagccctaatggtttgctgtattattacaaattatctgtgtgtgggactcgtcgagcttttttactctagtgaggccttctcatggttgtgtgagtggttc

SEQ ID NO: 456 - DNA, 1145 bp, Glycine max
tcttcaattacaaaattgtcttgatccttttaattttcatgtcggtttatttttgaaccccaaagatagaaacttttttcttttttataatgagaagcatagcatcttgttacaacgaacatgcaattagagtgtccgattcatattgttcaagaccttcgaaccaggcgtatctctgtccagaactcaacccttccaccagagattccgttacctgcatgtacaaactctccctcatcaaaacgcaaaaacaactcttcatcacaataacttgggccaagaaactcttgggccaaggcttcaccataaccatctccaattctgaacattctctttctccctctaataataaatccaacgcaaggcaattgagaaagaacaaaggcaacgaaacattccaatcccaaaattttcaagtccaagtcttgtgggatctctccgatgcaaagtacgaggaaggaccagaaccggttggtggcttttacgtcgacgttttggtggactccgaactgggcctacgcctcggcgacaaaaattcctcaatggaagaattgttaccaaactttgacgcaaaggaagcgactttctcgatggtttcacggagcgagacgttttccggcacaacggtttacgcgacgaaggcgaaattctcgcagacgggaagttctcacgatatattgattaggtgcggcgcggaggcggagcgaggagagccgaagggtcacgtgttgtccgtgtgcgtggacaagaagacaatgttccaggttaagaggctgaggtggaactttcgtgggaaccaaacaatttttgtcgatggtttggtcgttgatatgatgtgggacgtgcacgattggctttttaattcgaattctgcttcatctgcagtgttcatgttcaggacaaggagtggcctcgatagtaggctatggttggagaagagtttgcacgcgcacaaggaacaggacaaaattgggttctctttgttgatttgtgcctgtaagaacaatgactgattcaatcttatatagatttttttttcgttttaattcatctggattttataagattgaaaacactgacacctatttagatgatttttttcttcttcttaatcttaatctctgtcgatgatatttggtcagtgg

SEQ ID NO: 457 - DNA, 2086 bp, Oryza sativa
aaagtcgacagggagtttggcagttgctcgctcgccaaactgccagatccggatcccgcaccagatgcgcccgacggcgatgctccgatggcccgccgccgcggcggcgctcgcgctcgtcttcctcctcctcatcgccgccgcgccccccgccgcggccttctacctccccggcgtcgcgcccaacgacttccagaagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtgtttgagatgagagagcccaagatgtgtcagatcgtctgcaaagcaaccattagcgataaacaagcaaaggagctaaaggaaaagatagaggatgagtaccgggtgaacatgattcttgacaacctcccgctagttgtgcctattacaaggccagatagggatgatgttgtttttcagggtggatatcatgttggtgttaagggccaatatgctggtagcaaggatgagaagtactttatccataaccacctgatatttttagtgaagtatcacaaggatgaaaattcagatctctctagaattgttgggttcgaggtcaaaccatttagtgtaaaacaccaattcgaagagaaatggaatgatgcaaatactcgtttgagcacatgtcatccccatgccaacaaaataataataaactcagatactcctcaagaggttgaagctggaaaggatatcatattcacatatgatgttggctttgaggaaagtgatatcaagtgggcttctcgctgggacacctatctgcttatgacagatgatcaaattcactggttctctattgtgaactctctcatgatcgtgcttttcttatctggaatggtggccatgatcatgctccgcactctatatagagatatctccaggtacaatcaacttgagactgaagaagaagcccaggaggaaactggttggaagcttgttcatggagatgtgttccgcccaccaactaactctgacttactctgtgtctatgttggcactggtgtccagttctttggtatgctgctggttaccatgatgtttgctgtcttgggtttcctttctccatcaaaccgtggaggattgatgactgcgatgctgctcatttgggtcttgatggggctgtttgctggatatgcttcttcccgactctataagatgtttaaaggatcagaatggaagagcatcaccttgaagactgctttcctgtttccgggaattgcttttggtattttcttcgtcttgaatgctcttatatggggggagaaatcatcaggtgctgtccctttctccacaatgtttgccttggtgcttctttggttcggtatctcggttccacttgtctttgttgggagctatcttggtttcaagaaacctgccattgaggctccagtgaagaccaacaaaatcccgagacaggtcccagagcaggcttggtacatgaaccctgccttcaccattcttattggcgggattcttccattcggagcagttttcattgagctatttttcatcctcacttcaatctggcttcaccagttctactacatcttcggcttccttttcctcgtgttcattatcctcatcatcacttgtgcggagattgcaatcgtgctgtgctacttccagctctgcagtgaggattacatgtggtggtggaggtcctatcttacttcaggatcatctgccatctatctcttcctgtatgctgggttctacttcttcaccaagctgcagattactaaactggtgtcaggcattctgttcttcggctacatgcttctggcctcattctctttcttcgtgctcactggcacaattggtttctgtgcctgcttgtggttcacgagattgatttactcatctgtgaagattgactaggcgcagagttgctatacatccggcttccaatagttctgtatgattattgtggagaattgtgagacgaggatcaggcctttt

SEQ ID NO: 458 - DNA, 1082 bp, Glycine max
aaagtggttcacgaaccttagcagaggctctccttgggtgctcttcaaacatgggaaaacagagcacaccccaattctctgccctcaactgcatcgatctctccaaccccgacatcaaccaatccgtcaacttactcaaagaggcatgtttggattccggttttttctacgttgtcaatcatggaataagccaggaattcatggacgaggtttttgcgcagagcaagaagttcttctctcttcctcacaacgagaagatgaagactctcaggaatgaacaacacaggggatacacccctgttcttgatgagttgcttgatcctgaaaaccaagtacatggagattacaaagaggggtattatattggagttgaaaaaggtgaagatgatccacaatcgaagaaacctttttatggaccgaataactggcccgcaccagatgttctgcccgggtggagggagaccatggaaaagttccatcaagagacattagaagtggggaaagcagttgcaaagatgatagcccttgcacttgatctggatgctaattattttgatcggccagaaattcttggagagccaattgcaattctgcgtttgctgcactatgaaggtcaagtttcagatccctcgaaaggattatatggagctggagctcataccgactttggtttaattacactgttagcaacagatgatgtcccaggtcttcaaatatgcaaagatagggatgctaaacctcagaaatgggaggatgtagcaccattgaagggagcattcatagtgaatcttggtgacatgctggagcgctggagcaactgtgtttttaagtccacactgcacagagttctaggaaacggtcaaggaagatattctattgcatacttcttggagcctagtcttgattgtctagtggagtgcttgcctacctgcaaatcagatagtaatccacccaaatatcctcccatcttatgccatgactacatgactcagcgctacaaggacactcatgctgatttgaatatttataagaaacagcaagcttgagtagtcaacctttggaactgaacagcctggagattt

SEQ ID NO: 459 - DNA, 1984 bp, Zea mays
aaaggatccgtttcttcttggcaattcgttgcgcgggccatcgccccgacggcacctgggtacatcagctacaggacgggacaggtccctcttctaggagaggcttcgccagccgcctcccgcccccgtcactacgggcgccgtggagcggagatccatccggacttggatcggtctcgtcgcgtgattacagctcttgttttattgccagtttgagcaatatgggttggctgaccaagttttttagaggctcaacccacaatatctcggaagagcagtatcacagcaggcctgcagaagacacagcatggaatgaaccctctagctctcctgttgtgactgacatcctttcagagtttaacaatgaggatattgaccgtgctatagcgctctctctatcggaagaggagcaaagaaaggaaaaggcaatagataaggatatgcatttggaggaggatgagcaacttgcaagagctatccaggaaagtttgaatgttgagtcaccccctcgcagaaatggcagtgccaatggtggtactatgtatcatccgcctcgcgaaactggcaatgcatatcagccacctcgtgaaaatggcagtgccaatggtggaaatgcatatcacccattaccatttatgttctcatctggattcagagcatgcgcaggatgtcacagagagattggtcacgggcgttttctcagttgcatgggagctgtttggcatccggaatgttttcgttgccatgcatgtagtcaacctatatatgactatgagttctccatgtccgggaatcatccataccataaaacttgctacaaggagcagtttcacccgaaatgtgatgtctgcaagcagttcattcctacaaatatgaatggccttattgaatatagggcacatcctttctgggtacaaaaatactgtccttcacatgaaatggatggtactccgaggtgctgtagttgtgaaagaatggagccaagggaatcaaaatatgtattactggatgatggtcgtaagctctgcctggagtgccttgattccgcagtgatggatacaaacgactgccagcctttgtatcttgaaattcaggaattttacgaaggactgaatatgaaagtggaacagcaggttcctctgcttctggtcgagcgacaagctttgaatgaagccatggaaggagagaaggctggtcaccaccatcttcctgaaacaagaggactatgcttgtcagaagaacagactgttagcacgatactgagaccaagaatggctggaaacaaaattatgggaatgataacagagccatataggctgacacggcgatgtgaagtgactgcaattcttattctgtatggtctcccaagattgttgacaggttcaattttagctcatgagatgatgcatgcatggttgcggcttaaaggataccggacactgagcccagacgtagaagagggcatttgccaagttcttgctcacatgtggatcgagtcagagatcatggccggatcaggcagtagtgccgcatcgtcatcctcaggatcttcgtcatccacatcatcgaaaaagggcgggcggtcccagtttgagcacaggcttggggactttttcaagcatcagatcgagacggatacttccatggcctacggagatggtttcagaactgggaatcgagccgttcttcattacggcttgaagcgcacccttgagcatatccggctaactgggacctttccattttgaagtagcatggattcatattttgggaaagcttatattatatacatgattttcttccagagttccattacaaccaaagagataaattgtaaaaaaacattctttccagaatccagagatataatatctatgaaggccaaaatgaagtattaaatgattgagatcgatggtcagtctgcccaatcattttgtattctgatcaaactctggaatgaaacaatggcaatcttggtaccttt

SEQ ID NO: 460 - DNA, 1487 bp, Zea mays
aaaggatccgatggagagagtcctggtgtggtgcgggccgcaagtgtgagtgagacgtcaccatcgaatcccaccacaaaagctcctttcgtcacaccggccagcacccagcttctcctctcctcacccccacgccccaccccaccaaacaatggcgccggcggcgacttccacagcctctgcgccctcctccttccactccaccggtaggcatagggccagggtcggggcccggccatcgctcgtctctctccgcgtcagagcagccaatcccaacgttaccgccgatcccgcaccggccttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccgccaccgtctccatcgcctccgtcacatccccgtcccgccccaacctcgccgagcgcctctctagggacccgctccgcaactgcgcgggcgtcgccgccatcgccgcgctccgcgccctcggcgtccgctcccacgccgtgtccatccacctcaccaagggcctgccgctcggctcggggctcggctcctccgcggcctccgccgccgccgccgccaaggccgtcgacgccctcttcggctcgcgcctcggccgcgacgacctcgtcctcgcggggctcgagtcggagaaggccgtcagcggcttccacgccgacaacatcgcccccgccatcctcggcggcttcgtcctcgtccgcagctacgacccctttcacctcgtcccgctttccttcccgccagcgctccgcctccacttcgtcctggtcacccccgacttcgaggcgcccacgagcaagatgcgcgccgcgctgcccaggcaggtcgacgtccagcagcacgtgcgcaactccagccaggcagcggcgctcgtggcggcggtgctgcagggggacgcgggcctcatcggctccgcgatgtcgtccgacggcatcgtggagcccaccagggcacccctcatacctggcatggcggccgtaaaggcggcggccctgcaagctggagcgctgggctgcacaattagcggcgcgggccccacagtggtggccgtcatccaaggggaggaaaggggggaggaggttgcccgcaggatggtggacgcgttctggagcgcaggcaagctcaaggcgacagcaaccgtcgcgcagctcgatacccttggtgccagggtcatcgccacgtcatccttgaactagcaaaagattcggaaagtggtactgcaattgtatcaccaaacaaggaagaatgaaggggaaccccatggatttgtatgttttctcttctttcttgcatctttaggtggttaattggctttggaataagtgagatggaggacatcgctagaacaattctgttccgtgggctgtaatttcaatttggggtaccttt

SEQ ID NO: 461 - DNA, 1514 bp, Sorghum bicolor
gctgctacctttaacacgatcccctccctctccgtctgtgtccgtgcggcggcgccggagccgaaagcctccggcgagcccggggctacttgctgcggcgcgctatttcggcggttttgcgccacggcgggactggaaccgcccgggctgcgctgtcaggatcaccaagccggaacgaagttcagttgcgctttggcggttggattcgcctgttgccgcgcttcaggatactaaactgccatctcagttaaatgatacactgcacatcggtgggcaccgatagtttgaaacacatccgcaatgagttgttttgctcacttcttcaagaggaaaagagggccgcaacaacaagacaatccatctaacgattatttcaaaggttctgagaatataacaaaatacagctacagggaactggttagagctacatcaaattttgaccagagcaataagattggtgaggggggttatggacctgtctacaagggaacgctcaaggatggaacagctattgccgtaaagattctctctttacattctagacaaggtgcaaaggagtttcttaatgagcttcttgcaatctctgatgtagcacatgagaatcttgtcaaactctatgggtgctgtatagaaggaaaccacaggatccttgtctacaactatcttgaatataatagtcttgcacatacccttctaggtttgggacatagcaacatccagttcaactggagaactcgggtaaatatctgcattggtgttgcccaaggattagctttcctccatgacagtgtccgtcctcacattgttcaccgcgacatcaaggcgagcaatatacttcttgataaggatctcacgccaaaaatatctgattttggtctggcaaagcttctacctccagatgtatcacatgttagcacaagagtcgcagggaccctaggttacttggctcctgaatatgcgattcgaggacaagttacacggaaggcagacgtctacagctatggcgttctgcttatcgaaattgtgagtggaagatgcaacactgatacgaaattgtcctacgatgaccagattctccttgagaagacatggagatattacgaccggggggatctggagaagatcatagacagttccctgggcgatgacctggacgtcgatgaagcctgcaggtttctgaaggttgggctcctctgcacccaagacgtcacgaaacgccggccagggatgtctacggtggtcgccatgctgaaaggcgaggcagacgtggacacggagatgatcagcaagcccgacgtgatcagggactttggagacctcaagcagaggagcagggccacgtcgtcgacgctgctgacctccatcatggcgcggtcgtccccgctgtcgtctgaggagacgacgcgcacctccatcaccttcaccgagatatcagagcgcgactgatgatcgtgattcgccaacaagcagagattgcgaccgtgtagctagaggaccggaaattgtatgtagca

SEQ ID NO: 462 - DNA, 1964 bp, Zea mays
gctcgatgcagccgatccggcggcggcaccgaggctttgcactcctctgtctctccgccgccctcctcgctgccgccactctgctccccggcgccgccgtcgccgaaggtgtcacgccctccgaggcgcgccggctccgcgacgaggtgaaagatatgttctatcatgcgtttgatggatacatgaagtatgctttcccactcgatgagctgcggcccttaagttgccaaggtgaagactcccttggtggttatgcgctcactcttatcgattctttggataccttggctttactgggtgataaggagaaatttggtgctgctgtggagtgggttggtaagaatgtccactttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttagctcagaggttgttgcccgcatttgacactcctacaggtattccatttggatctgttaatttattgtacggagtcgatgaaaatgaaagcaagataacatcaacggctggtggtggtactttgacactggaatttggcatattgagtcgcttgactaataatactgtttttgagcgagttacaaaaaaatcagtgcgtggaatatggtcacgcagatcaaaactcaatcttgttggtgcccatataaatgtctttactggtgaatggacacagaaggatgcaggaattggcacaagcattgattcattctatgaatatcttctaaaggcatatttattgtttggagatgaagaatacctgtacatttttcaggaggcttacaaagctgccatgcactatctccatcatgatccttggtacgtggaggttaatatgaactctggtgctactgtttggccactcttcaatagtctgcaggcattctggccagggcttcaggttttagctggagatgttgatcctgctattcgcacacatgctgccttcttcagcgtctggaaaaagtatggttttacccctgaaggttttaatcttgctacatccactgtacagaatggacaaaggagctacccgctacgaccagagttgattgaaagcacatattggttgttcaaggctaccagagattacagataccttgatgttggaagggacatattagcaagccttcaatatggtgccagatgcccttgtggttactgccacatatcagatgtggaaacccacaagcaggatgatcacatggagagttttttccttgcagaaacggtcaagtatctctggcttctttttgatttagctgctggccctgacaatattgttgaaaatggaccatataagtacatatttagtacagagggccatttgttacctgttactcctgagatagccttggaagatgaacattgttcatattttggagcattctgtaatggcggtgccgaccatggatatggtgctagtgctagttctactaagcatcgaaatggaaactatacccaattagatgatattcaaaccccttccagtcactattcaatgtccaatgtgttgtttacgccaggttacatcaagggagtttgtccaggattgactcatgcgcagaaatttgggatatcatactctgatgaagaggataactttatagagcagacttctgagagtcttgatcatcatggtgaatctgccatagaatctagcgtccaagaccaatcaagttctattatattgatctctcacccagtcgcaagccaacaggatgaggcttttgagagcgagtctggaagtcaagatcatgcaaatattgttgtaacttctgattctgattctgattccacaagccgtgataatactgttggctctcccggaatgaactcggaagaacttatggacgacatatagtag

SEQ ID NO: 463 - DNA, 1535 bp, Zea mays
acgccatggaaccgacaaggctgctgcttcttctcctcgttctcggcgtgtcgctgcaaggatgcattgcgcagggcggcggcggcgccggagggctcacgcgggggagcttccccaagggattcgtcttcggcaccgcctcctccgcttaccagtacgagggagcggtgaaggaggacggcagagggaaaaccatctgggacaagttcgcgcacacgtttgggaaggttgcagacctgagtaacgccgatgtcgcggtcgatcagtaccaccggttcgaggaggatatacagctcatggcggacatggggatggacgcgtaccgcttttcgattgcctggtcgaggattctgcccaatggtaccggccaagtcaaccaggccggcgtcgaccactacaacaggtttatcgatgcactgctatcgaaagggattgagccatacgtgaccctgtaccactgggacctcccccaggccctggaagacaggtacaacggatggctggacaggcagatagtgtacgacttcgccgagtacgccgagacatgcttcgaggccttcggagaccgcgtgaggcactgggtcacgctcaacgagccgcacacggtcgccgtccagggctacgacgccgggctccaggcgccgggccgctgctccctgctgctccacctctactgcaggtcgggggactcggccaccgagccctacgtcgtcgcccacaacttcatcctggcacacgccaaggtctccgacgtgtacaggaaaaagtacaaggcggctcagaacggagagcttgggatagcgttcgacgtcatgtggttcgagccgatgaccaacactaccgccgacatcgaggctgccaagagagggcaggagttccagctcggatggttcgcggaccccttcttcttcggcgactacccggcgtcgatgaggtcgcgggtcggcgacaggctgcccaggttcacggcggccgaggccgcgctcgtcaagggggcgctcgacttcgtcggcataaaccactacaccacctactacaccaagcacaacagcaccgacctcgtgggccgactgctgcacaacaccctggcggacaccggaaccatcagcctcccgttcaggaacgggaaagccatcggtgacagggccaactcgatctggctgtacatcgtgcccagcgggatgaggagcctgatgaactacgtcaaggaaaggtacaacagcccgccgatttacgtcaccgaaaacgggatggacgacggcaacagccccttcacctccatcaaggacgccctcaaggacagcaagagggtcaagtaccacaacgactacctcaccaacctggctgcctctataaaggatgacgcctgcgacgtgcgtggctacttcgcctggtcgctgctggacaactgggagtggacggccggctactcctccaggttcgggctctacttcgtcgactacaaggacaaccttaagagataccccaagagctcggtgcagtggttcaagaacctgctggcctctagctgatga

SEQ ID NO: 464 - DNA, 1088 bp, Zea mays
aaataatggcgccactctcccctacccccgcctccgcctctgctcccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctgatgcaacttcaacagcagttctggcatggcgatttaacacatccacaccaagtggcttcacagtgggaaaagcgtggggatggccatcctcccgtctttagcaactccagtccctctctcttcggctatgatctaacaagctctggagcccagcaaaccccggcgagcaagctaaagacggagctttgatga

SEQ ID NO: 465 - DNA, 4682 bp, Oryza sativa
tgctgccttagctctagcaatctagctaggtaatttagctaagtaagctagcgacgctatctgggatggcgtcgtcggcggaggcggctgcggcgatggcggcggcgccgtcggcgagcgggcggcggagcatgagctgggggtcgtcgatctcgcagtcgttccggcaggcggaggcggacgacccgttcggtcgcgcggcgtcgcagcaggggcacgacgacgacgaggagaacctccggtgggcggcgctcgagaagctccccacctacgaccgcatgcgccgcggcgtcatccgcaccgcgctcctccatcacgacggcggcggcgacggcggcggcgcggcggcggcggcgaaggacgggaggatggagctcgtcgacatccagaagctcgccgccggcaacctcggccgcgcgctcctcgaccgcgtgttccaggacgacagcgagcgcttcctccgccgcctccgggaccgcatcgacatggtggggatcgagctgccgacgatcgaggtgaggtacgagcagctgtcgatccaggcggaggtgttcgtcggcagccgtgcgctgcccacgctcaccaacgccgccaccaacgtcctccagggtctcattggacgatttggttcttcaaataagaggaccattaacatactgcaagatgttagtggcatcatcaagccatccaggatgacacttcttcttgggcctccatcctcgggaaagagcacactaatgcgagcacttacagggaagcttgataaaaacctcaaggtgtccggcgacatcacatactgtggacacacattttctgagttctaccctgagaggaccagtgcatatgtcagtcagtatgatcttcataatgcagagatgactgtgagagagacattggatttctctgggcggtgcttaggcattggtgcaagatatgacatgctcgcggaactcgcgagaagggagcgcaatgcaggcattaagccagatcctgagatcgatgctttcatgaaagctactgcagtgcaagggcataaaactaacatcactacagatgttactctcaaggcacttgggttggacatttgtgctgatattattattggggatgagatgattagaggaatttctggtgggcaaaagaagcgtgtgacaacaggggagatgttaacgggaccagcacgggcattgttcatggatgaaatatccaccggtctagatagctctagcacatttgagattgtcaagtatattgggcatttggtccatgtgatgaatgagactgtgatgatatccctcctgcagccaccaccggagacctacaatctttttgatgacataattctactatcagaaggatatatagtctatcacggaccacgtgagaacatcttggaattcttcgaaaatgctggtttccgatgccctgaaaggaaaggaatcgctgatttccttcaagaggtcacttccaagaaagaccagcagcagtactggtaccatgaccaagaacggtatcggtatgtgtcagttccagagtttgcacaacgtttcaagtcattccatgtaggtcagaaaatgcagaaggagatgcaaattccttatgacaagtccagcacacatcctgctgcattgacaactaccaagtatgggctatccagttgggagtcactcagggcagtgatgtcaagagagtggttattgatgaagcgcaactccttcatctacattttcaaggtcacccagttgatcatccttgccttcatgtccatgactgtgttcctcagaacaaagatgcctagtgggacaatctctgatggcactaaattccttggggctctcacctttagtttgatcaccatcttgttcaatggctttgctgagctacaactgaccataaagaagcttcctgtgttctacaaacatagagatttcttgttcttccctgcatggacctttggagtagcaaatatcctcttgaaagttcctgtttctcttgtagaggcggcggtatgggttgtgctcacatactatgtgatggggtttgcaccctctgcaggaaggttctttcgtcaatttatagctttctttgttactcaccaaatggcaatggctatgttccgatttcttggtgctattttgaaaacaatggttgtggccaatacttttgggatgtttgtgctgcttattgtcttcatttttggaggatttctcatatctagaaatgacatcaagccatggtggatttggggttactgggcatctcctatgatgtatagtcaacaagcaatatcaatcaatgagttccttgctagtagatgggctattccaaatactgatgcaacaattgatgagccaactgttggcaaggctattctcaaatccaaaggcttgattactagtgatggggggttttggatttccattggagcccttataggattccttgttgtgttcaatatcttatacattttggcccttacatacttgagtcctggtggcagctcaaacacaatagtttcagatgaagatagtgaagataagacggacatgaaaacaagaaatgaacaacaaatgtcccaaattgtacacaataatggagctagtaatacatctgcaacatcgtcaatccccatgagtggaagcagatcaacaaatcagcaaagtagatcacaaattgtcttgcctttccaacccctttcactttgtttcaaccatgtaaactactatgtggatatgccaacagaaatgaaagagcaaggattcacagaaagccgtctccagttactatctgatatcagtggagttttcagaccaggtgttttgacagcattagttggtgtaagtggagctggcaagaccaccctaatggatgtcttagcaggaaggaaaacaagtggagtaattgaaggagacatcaccctctctggttatccaaagaaacaagaaacttttgcacgcattagtggttactgtgaacagactgatattcattcaccaaatgttactgtctatgaatccattctctactctgcttggctacgtctttcgtcagatgttgacaccaatacgaggaagatgttcgtggatgaagtcatgtcccttgtagagcttgatgtgttacgtaatgctttggtgggtcttcctggagttagtggtttatcaactgaacagagaaagaggctcacaattgcagtggagttggtagcaaacccttcagtaatattcatggatgagccaacttctggacttgatgctagagctgcagcaattgtcatgcgaaccgtgagaaataccgtcaacacgggacgcactgtggtttgcacaattcatcaacccagcatcgatatttttgagtcttttgatgagcttttgctattgaaaaggggagggcaagttatttatgctggtgaactcggccgccactcccataaactagttgaatattttgaggcagttccaggtgttccaaagataacagaaggatataatcctgcaacatggatgctagaagtcacctcccctatagctgaggctcgtcttaatgtaaattttgctgaaatttatgctaattctgagctttataggaaaaaccaagagctaatcaaggaattgagcactcccccaccaggatatcaagatctctcatttcctacaaagtattctcaaaatttctatagtcaatgcattgcaaacttttggaagcaatatcgttcttattggaagaatccaccatacaatgccatgcgctatcttatgacattgctcaatggccttgtctttggcacggtattttggcaaaaaggaactaagatatcatcacaacaagatttgttcaatttgcttggagccacttatgctgcaactttcttccttggggctgccaattgtatcacagttcaacctgttgtttccatcgaaagaacagtcttctaccgcgaaagggcagcagggatgtactcttcattgtcctatgcatttgctcaggcatgcgtggaggtcatctacaacatcttacaggggattctatacactattatcatctatgcaatgattggatatgactggaaagccgacaaattcttctatttcatgttctttattgtagcaagtttcaactacttcacattgtttgggatgatgttggtggcatgcaccccatctgcaatgcttgcaaacattctcatatcctttgtacttcctctctggaatctttttgctgggttcctcgttgttaggccgttgataccgatttggtggaggtggtactactgggcaaaccccgtgtcatggaccatctatggtgttgtggcgtcacagtttggtaaaaatggtgatgttctttcggttcccggtgggagccctacggtagtgaagcaattcttggaagacaacctagggatgcggcatagtttcctaggatatgttgtgctcacacattttggctacatcatcgttttcttcttcatctttggctatgccatcaagtacttcaacttccagaaacgatagagatggtatgttatggcatagagtgacattatttttggccgccactgccacttgcagctaaagagggctactacacaattacttagttaagttagaagtgcttgtagattgttctagtttgtaaacattcacttcatgtatctatatacacaccaatgctattctaagccatgg

SEQ ID NO: 466 - DNA, 1554 bp, Sorghum bicolor
accaattgtttaatttgccttatggccgtttcggcagctgcacaagcaattcctgaggatctcctttctctcaagagagagcaactcgtctgcttctttatgggaaagccagatttatccgggcattaggggtcagccattggttgtaatgaacaaggactatgtggcagcaatactatttttctcttcaattctaataatatgtgtatttctgcaatttgtttaatttttctttattttagtactgcagttttagggcatgtttttaatttttgaacgttgtcattctagatagtaaatttgcttcttggtggattatttattggtgagcgctaggggtacattttagattggattctttgtcattccacagtttagcttaagcgtgctgacaattctcagttaagttgtcgtaacattcaaggttcagctgacatgcacactacaacatatatttagcttaaattaccccctatctgttgctatcatgggctcatggctgcacaaccaccacagtacacattatataaatgatggtcagtatacttgctttgtctacagttgatatgaatttgtctgccttttagtatgtatctgtaaaatttttgtttcatgtttgtttttctgcttaccagggaaggggaagatacaatgtttacttccttatgattgttgcccaaatttctctactgtaaacactacacagcagaaggtgatccatagcttccggcgcctggtcatagatgatgcagtctttagtgctctgcaacccatgacaatgtctcctagcagtagtacaacaacgtccatgcatcaccagccaaaagaattttttgactcatgggaggacatcttttccagatttgcttggcttcaggcggatttgatgaaccatagaacattgcgacataggccgaggctgcacaatactgctggtcgtcggacaagcaccgcgaggtcaagataccggtaatctcacacccatgctcgttgtggaattgcttccgccactccctagccactgccatgaacaacactataggaattcagacttatggttgttgagttttggagtttttcatatttgtatattttttccaataggcttcacttgagcagatcaggatagaaggcatatgtgttattgagtaggctttgagcaacttaagagtcgtgatgtctggtttgaattcttttttaggggagaaaatatggtccaacagtattgctatctcaaattcaaaaatgtcattttttttgtcaaccttcaatagtcttgactttattttttccctttgcaacgcacgagtattaactttataataaaaacacatgaatcacatgataagataataatattgtaaaattttgccgatgttaaagtgacatttagtataaaaaacaaagtttataaaattaacatagtcatagcatttccatactatcatgtactacgaaattaaatatcttggagatttcttctcgctgatataaaagattatcttagtcgcatcagaaaaatgtatatacagtagagtttatgagcctatgacg

SEQ ID NO: 467 - DNA, 1869 bp, Zea mays
ccgtcggaaaggtttagaaagttagctaggtttcactgctcgtgcctcgagcaccacggcggcggcggcagcgggactgttctggccgacgacggcatcgatgacgacgaggttcgtctccctctgcgaccgctcgtagcccgtgatgtaggggtcgtagcaccacgactgctcgtagcccgctgcggacccggccagctcggtgcctgtcaggcggagggacacctcggcgccccggagcagctccatgtgctcctcgcgagggtatccctccacgtactccttgaggatcacccaccggttcgtcgccgccgtgcgtttcttccggggcagccattgccccatcccttgagcaaggtgtgtgcaccgctcaatagaggcggcttgggccccttgcgtctttgttgggaatggctttgcagaatggactgcctcgagggtctgggttgctttgcccaccgctcaggaggccatgctcaagacatcggtctcatttgtggtcgacggtggctccagatcttgcttgggcgctgatgagcttctgtttctagcttgcttgctgcttcttgcttcataattattatctatttcattatctatttattatatatttcatgattagccgcatcgcatgattagccgcatcacattgttttttcttgttgcttcttttagtttttgctacttcttttagtcattttacctcccctggccctggcgagttgcacagccttcaacgggccaagcgcaggcactggcgtcgcaccaaacttggattctgagcggtggaagaaatggtggctaacgacgcctcgggggtatagggctctgcaagctaggaagctcttgtttatttttttcttgtgttatttgtcattgtattaccatgttttgtctgatggttaaagaaccgcctttatgctatggtgaatttatttaaccttgcagcgccttaatcagttgatctctagccaattatataatctgcctagattatataatccatttgccatagattcatttgcaggagtgttaaaacagctcgttgttttgggatttgccgcctcaagtttcatctagctacctccaacaaacccttcaatctccatggctacatcggtacttctcctattccaccttgtgctcctactagtagtgtttttattcttgagtagagcattttcctttcaactagcatgtctaattgcatataaattacgtgttctagatatcaactcaatatactaacgaggaggaaattaaaaggaagagaaagaagcgaaagagagttgttgtattagcctagtgtacaataaagaccaagcaaatggagagggtgctaaaacagcagctgaaagttcaaaggaaatgggaaaagagaatgatatcggaggcaaggatgctccatattctgtatcttcctcgagtagtttaaaaagacaaagatcagatgattcatttaactctatatggtgtgataagtttgacatgtatctgcattgaaagatgatggtccaaagctaccctcttccgccgaagttctcgccacattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttagatctctgtgttgaactgattgtgtgaacttgtctttgtgaaacttttgtgtgcgaacttgatggctatgtgaaactgttgtgtgtgaacttggtggctttatgaaactgctatgtgaagatttgatgtctttgtagaacttttatgtgcgaac

SEQ ID NO: 468 - DNA, 747 bp, Zea mays
tttcgccatgtgcttgtgttgggacctgtctgccgcctaactaaagcaaccacaccaccacaccagcgaggcgggggaaggcgcggcgcggcgcggcgcggcgggcttcgctcgtcgaggctgtaagtctagggtggcgacctgcactctctacaacccgcatctctccgtccccggcgacgactgcgtgagcagccgcagcactactaagagcggacagcggactatggaggtggaggccatccgagttcccttcgaagcttctcgaggataggtacgcggaagatagcttcgtcgtcaccattgcggcatcgtaaaagggcttagcaagaaagagctccaggaccttctgcaagagggcgccaagatgctggtgcgtgctgcaagtgctagaggaaatcggatcctcgggtcgggcgatgagatggaagggatgctgcagccacacgggcgttgagtcatgacgtgactgctcgcctggtgttagctttgtcaggaactcgctctattttgctgccgtctgttatgtcgtatggtctggtacttgtgtgatgtaaaactctaaactcgtcggttggcatgttgcctggtaggggacccggctgttctgagtcatccgaagcggattggctcgtcagcgcttctgtttgcgggttcttcctgttattttgcgttggtagtgtggaaactatctgaaccactttgtatttctgttatgacaataatagaaatggggtcctcctctcg

SEQ ID NO: 469 - DNA, 812 bp, Hordeum vulgare
cacgaggactgataagagctgatctgcctgcgctgctctgctctgctcggtggacgcgggcctgcggcagtgccagcggtggagaagggaggggaggtgggcatcgggtgacctccgtgacactcttgatgttgggggagaagcccgacctggtctgcgagccgggcgacatgctcgggcaggcgacgcgaaccaaagacacaaaacaagcgaagcggaccccctcttcctcctcatgtcgccatccgccgccgccggcgaaaccccgtccggggagccgcggagagcaacaccagcaccgaggagtcgcggtggctcgcggccctctctgaacccgagctcgtccgtcctccacttccctcgtaatctctccttccaaccacagatttttcaacctttgatggtttcctgcaggatttgctcatcagcctgaagatgctggcctgtcacctgctgtcacccgctgattactctccaaatgcaaagttcatttccgtcctgtcacccgctgattactcacccgctgtcacctgcaggatggtttcttgctttatttccgtcctgtcacccgctgattactctccaaatgcaaagttcatttccgctttggtggcagacctattgtctttgttactgatttatgtgcacttacgccatgccttgggacattcagctgtttctgttattcttcaaatactctgaatctgtgtgtcaaggggggcagatttggagcaaaactttgaattcatggtaagcataggacggtttccctgattcagagttgcggcatataatagtcttcacacaaatgc

SEQ ID NO: 470 - protein, 468 aa, Triticum aestivum
MKKSVVLYPGVGVGHLVPMVEVAKLFLKHGLAVTVVLIDPQVESTDFSSAVARARASNPSVAFHVLPTPPADSNSDTAPTNPVVQIFRLLKSMNAPLLDFLRSLPSVDALVLDMFCVDAQDVAAELKLPVYYFYASAAADLALFLNLPTMLAGSKVKELGDSIITSPGVPPLKASDLPEVTHNDEVLKTILGMFDRMPDSNGILINSFESLETRAVRALKDGLCVPGRATPPVYCIGPLVSGGGDQEHECLRWLDAQPDQSVVFLSFGSMGTFSVQQLQEIANGLDKSGERFLWVVRSPRNPDYKYGDSLPEPDLDALMPEGFLERTKDRGLVIKSWAPQVEVLRHRATGAFMTHCGWNSTLEGITAGLPLLCWPLYAEQKVNKVHIVEGMKLGVEMRGYNEEVVKAEEVEEKVRWVMASEGGKALRERVAAAKDAAAEALKEGGSSHLAFVQFLNDLDISIAPTVQH

SEQ ID NO: 471 - protein, 201 aa, Unknown
  Sequence found in Organisms: Zea mays, Sorghum bicolor, Saccharum officinarum
MSRYRGPRLKKIRRLGALPGLTRKTPKSGSNQKKKFHSGKKEQYRIRLQEKQKLRFHYGLTERQLLRYVHIAGKAKRSTGQVLLQLLEMRLDNILFRLGMASTIPGARQLVNHRHILVNGRIVDIPSFRCKPRDIITTKDNQRSKRLVQNYIASSDPGKLPKHLTVDTLQYKGLVKKILDRKWVGLKINELLVVEYYSRQT

SEQ ID NO: 472 - protein, 359 aa, Sorghum bicolor
MEATPISVKPPSPALAAPPPATLGPRDMPTHAVGGTELEPSSMNQLAIAPDPKRQRVEEAADGNGCKHCACKKSRCLKLYCPCFSGGGYCSDKCGCQPCFNKEAFSETVQTTRKVLLSRQKRMSMKINRRPEANAEPMEDAHHSSSSTPPRRGCNCKKSSCLKKYCDCYQDGTGCSLFCRCDDCQNPFGKNEGIIADDSKRYLYTGADLDHSEGEHDFVVERSPRLQSPISKESSFHQTPPHLRVSSRDTHVFPQAISQWQALPRSWQHCANKRNSNDRVMDDSANYKNSNHDWQLSKHEDSYSISKCVQILNGMVELSQVEKSVAPDVFLQPGNREIFISLSGDVRAMWLKRKIQHLA

SEQ ID NO: 473 - protein, 291 aa, Oryza sativa
MEPDQSGAEQTSPRGNDWEVVQLTASTYASAPGPRMSEPSDEAEVKGYDTKGDDSAAALLMSGHFSVSPSEVESLLRGTDGKEHQKELSGQDAVSAEGDDEKFQDTCEHKLKDDLHWIPSFDKGKNLSLVDMEFDKAFQGMGLVGEEPLGFSSSRYNPIDANNEKKTEEPTVQNVNRVIDSSKVVASSEQNKPDDSEFPHEASWKKQLLSLYKNVRKSNKFWPIVVATALVGVTCFWRRWQKGKLQHQPVKLYPSSNEKINQAVGPLNRIKDILVANNHPAPAIHGHARLS

SEQ ID NO: 474 - protein, 446 aa, Glycine max
MLRSTPIPAPYNSVPVLSRARTCHSLAPARAVHSHSSFVSRLVFPQFRQYIVNVPGRVFVAAAAKKQRRGGAELAVTDDGFDDDEEYDDDDFYDEYDDDDDDEEEEFDDDEDDEGMLSLEKMNKWFEKKPRGFGEGKVYDTSVEDKLLEEMRQSRIAQAENLKKLMSNPVKHASNESVQKKKDAELVPIGGRVCLVNLPKKKNIHKDLKSALQGIPGIINIVPAVTGNKKTRDPICKGFAYVDFKREEDAVRFVELYTGQTITFGKIQKQIKCELLNVQSSSSLKLSKNLSAAPQLVAAAFEEDSNEDSNLDGSARSSWDETNSSDDLDDLDYQMNGEEQEDDEDNQESVTALGVDHDDNVEMRIDPENISLPSEQVDRNPAAVQKSSAKVKQENARKKKPISKEKTKKVLDVPGSSRRLKIREKAVLSEVFSKYGLKATLASKDN

SEQ ID NO: 475 - protein, 221 aa, Solanum lycopersicum
MAGVLSVLRRIYLTLYNWVVFFGWFQVFYFAVKTLKESGHEHVYDAVEKPLLLAQTAAILEILHGLVGLVRSPVSATLPQISSRLYVTWGILWSFPELRSHILVSSLVISWSITEIIRYSFFGTKEAFGSAPSWLLWLRYSTFLLLYPSGITSEVGLIYSALPYIKGSDMYSLRMPNKWNFSFDYYYAGLVALGIYVPGSPHMYGYMLGQRKKALSKSKKE

SEQ ID NO: 476 - protein, 374 aa, Oryza sativa
MEATPISVKPPSPVAAAPPPPPVQVPVPPPPPPPLPPAAAAVEPLPPQPVAVVVAEAEPCSMNQLALTPTPKRQKVEESADGNGCKHCACKKSRCLKLYCPCFAGGGYCSEKCGCQPCFNKALYAETVQTTRKVLLSRQKRMSLKINRRSEANAEAVEDAHHSSSSTPPRRGCNCKKSSCLKKYCDCYQDGTGCSLFCRCEDCRNPFGKNEGIMAEESKRFLYTGADLDHSEDEQDFIVERSPRLQSPISKESSFQQTPPHIRATNRDTHMFPQAISQWQPRSWHCSKRQSNDRVIDDSGEYKNSNHDWQLAKPEDSYSISRCVQILNGMAELSQVEKSVAPDVFLQAGNREIFISLNGDVRALWLKRKIQNLT

SEQ ID NO: 477 - protein, 602 aa, Hordeum vulgare
MSDAVNILTHTDEIKLKAERITAIEKKKESLARKDDRNLQASQIDPGRDMSIAELIKVPRPEGIEDGSVIKQPLSDALLDERDGAHQDVIADEAEGNLTLNGRVAIEGEGVHKDVVADEAEGNLTVNGRSSIEGDVDHTDLSISKEIEEGTVKEREGEGSPFSREDKSASPDNTDVTCEPTGHQTRPRRSATRYSNLSERKKKGSTGRKKKERKKKGSTEDEMSELPIYLEPKDDGLPFADENQPEGGALWDIFRREDASKLHEYLTKHSEEFRHYNYESVKQVIHPIHDQCFYLTNEHKRKLKEEYGVEPWTFEQKLGDAVFIPAGCPHQVRNLKSCIKVALDFVSPENLQECIRLTEEFRLLPKGHRVSEDKLEVKKIAFHAIKKAIHYIKKKPEDKSSDDEVQDKPVPRKRKPGPKKGKLGRPKKGKTGPVEPAEPEEHEEQSAQEMSPVEDEGAEMEADQGQSALDMCEAKPGTSVRCGSRKRKPGSLKKGEPGCAKKGDLVVQKRENLVQTNLQNQRNKTKVQKWRWTKGNQLWTCLKGKIELLKWSNKKSQLWACLNLKMNLQKWRSTRKSRLRACLNLKMTLQKWRSNRNGQLWT

SEQ ID NO: 478 - protein, 305 aa, Triticum aestivum
MEPDQSGTGRTSPRGSDWEVVQLTASNYASAPGPPRTEPSDEEAEGQVYGAEGGDSAAAALLMSGHFSVPQNEPESLLVETDTSIERQEARGSQYAVSDKGEDGMYEDQQEKLKDDGLDRIPSFDKGKSLSSVDMEPDNGNALHGVSQAGEEPVTFSSSGYSATDAEKEATESAIEKTEEKPPLQNIDPVTDSSNVVASGEESKPDGSGAPRNAWWQKQLISLYRSAKESNKLWPIVVAAAALMGMAYFRRRWQKGKLQLQQVKLQPASSKERINQATVPLNRIKDILVAGNHPSPATHGNARLG

SEQ ID NO: 479 - protein, 221 aa, Zea mays
MAGVGSALRRLYLSVYNWVVFFGWAQVLYYAVLTLRLSGHKAVYAAVERPLQFAQTAAIMEIVHGLVGLVRSPVSATLPQIGSRLFLTWGVLWSFPETQSHLLVTTLVISWSITEIIRYSFFGTKEAFGFAPSWLLWLRYSTFMLLYPTGISSEVGLIYIALPYMKASEKYCIRMPNKWNFSYDYFYSSVLALLIYVPGSPHMYRYMLSQRKKALSKAKAA

SEQ ID NO: 480 - protein, 529 aa, Zea mays
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNIASGTSENTKVVVESGAVPIFVKLLNSLSEDVREQAVWALGNVAGDSPKCRDLVLGHGGLYPLLQQLNEHAKLSMLRNATWTLSNFCRGKPQPNFDQVKPALPALQHLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNKEQIQAVINANIIAPLVQLLQTAEFDIKKEAAWAISNATSGGTHDQIKYLVAQGCIKPLCDLLVCPDPRIVTVCLEGLENILKVGEAEKNLGAGDVNVYAQMIDDAEGLDKIENLQSHDNTEIYEKAVKMLESYWLEEEDDAMPSGDNPQNGFNFGNQPSVPSGGFNFG

SEQ ID NO: 481 - protein, 128 aa, Zea mays
MAHYHPVSADTYQDLEAGFSGHSSSPLKPAASPRRPGRMFCDPCDDGDELHGRHHYLDICFRCRKLLSGNRDIFMYRGDLPFCSEECRQEQIEIDEAREQRLKQTGRAEQQRQRQQKQSPQRIPIWAW

SEQ ID NO: 482 - protein, 201 aa, Solanum lycopersicum
MSRYRGPRFKKIRRLGALPGLTNKKPRTGSDLRNQSRSGKKSQYRIRLEEKQKLRFHYGLTERQLLKYVRIARKAKGSTGQVLLQLLEMRLDNILFRLGMASTIPAARQLVNHRHILVNGHIVDIPSYRCKPRDIITAKDEQKSRALIQISLDSSPHEELPNHLTLQPFQYKGLVNQIIDSKWVGLKINELLVVEYYSRQT

SEQ ID NO: 483 - protein, 298 aa, Sorghum bicolor
MRCAAAALAVALIAAVAGAAAAGSPAAGTCARRGAPPFLDAVGSRCPFVRIEPSPPLEVRGEAVDTELNLRRRGASYFILFYAAWCPFSSKFQPTFEALSTMYPQIHHFAVEESSATPSLFSRYGVRGFPAILFVNETTMVRYRGSKDLNSLVNFYKETTGLDPIAYIDVVHQESTGSLSSVMPWDRSLREFAKDEPYLLAAVLFIILKVAAHFIPVVMSHLRAFLVVRVQNLNLGIRRGSNQLLERALNVLDMRRLWSKLRLSNKATDLRKGASNARAWASSFASVSLGEPSSSRQA

SEQ ID NO: 484 - protein, 95 aa, Oryza sativa
MPRIPLIKFPKRNLKIPSPPPPAAQPADQHASLLSRLGVKSEAPSSSGEIKNYRFRSDVPSPPSYTAVGGPASLLPKRKPLSEEEIEAIMQGGIY

SEQ ID NO: 485 - protein, 260 aa, Hordeum vulgare
MPLLQLQLPTACCAAAASAPFSFSRPPPSRLRASHVIFAFPRLRKYGRRSREPVPTTLDDDEDEEADEDDDDGVEEAVDEDIFLKNRPKPAGFGVGKTYTTDVEEQLLREMGLGGAGRKSKSAPPKSVKTNGSATETSADVSDDGVHVRIWNLPKKKNIHKDLNLAFKGFPGLVTINPANSGTKKTRDPICKGFAFVKLESVDAATRFVELYSRKAVSFGKVEKPIKCCIVEGHASTDPSGPASSSQAPGSNPQRLVAVR

SEQ ID NO: 486 - protein, 300 aa, Arabidopsis thaliana
MDSRVSILFVCAIAVSCFTSGSASSPVDFSVCNYEFELFRFDLEAKCPPSLYPTPPIEVDGDSLDRLMASQHGNAYMSVLFYASWCPFSRAVRPKFDMLSSMFPQIQHLAVEHSQALPSVFSRYGIHSLPSILMVNQTLNARYHGRKDLISLIEFYEEATGLQPVQYVAEGEPTGLNAGDGNLITWLRKGTSIREIFKQDPFLVLSLLFICLQMAILVFPIAESRMRALWASYVANLNLGRFGEISQLFNRGIHMVDVRRLWLKLSLVKTRNFHERAKNAQAWASSLASVSLGQTSSDQS

SEQ ID NO: 487 - protein, 988 aa, Zea mays
MPPPTRGRGRGRGRGRGRGRGRGRGRPSKDTVAEDSAHATEESGEENLQEKVQEGGKVNLTEKVQEGGEENLTEKVQEGGEENLTEKENEGIVEVSKPPQRRRKDPVADPSSLESSGFMRFRERRNASAVQEQGPKKRRITEDSNMCHQCQRNDSGRVVRCQGCVVRKRKYRYCVKCIKRWYPHLSEDDFANNCPVCQNNCNCKACLRGDITRANSRKKKNVSEQDKIKFSMRIVHFLLPWLKQFHQEQMQEKSAEAATKGIDADKLEVPLTICGKKERIYCNNCRTSIVDFHRTCNKCNYDLCLQCCQELRRGLVSGNDAKVDGGGKQDFLSGVSHDKIISKGPSDGQNDMLIDSVVPGENNTSSLRQWSVNKDGTIPCPPNAFGGCGSSLLELKCLFKEKFIAELLEKANSALNNEMEVKIEGSKCPCFTESGDMDDGISRKSSCRENSCDNYIYCPTATDVQNGSLDHFQEHWLKGEPVIVRDTLALTSGLSWEPMVMWRALREKKEKVERLSVLALECLGWCEVDVNIHMFFAGYSSGLVGPDDLPLLLKLKDWPPHSSFEERLPRHGAEFMSALPFREYTDPKWGPLNLAVKLPDNVNKPDLGPKTYIAYGVSKELGIGDSVTKLHCDMSDAVNILTHTDEIKLKAKRIAAVEKKKRCLGMKILSTKEASGGLQRCADYFGMPTAPSESNKEPRPEECVNELGIKQPVQHVASEEQEGVQDDAKADANVMNVSFGKGKSEDSFGTINGTNSGDKIESPSGLAERTLTQPTTKGCSKQRGRSSNGRGNRTKKIEEGNASGLIAVAPESEDDDDAPFIDGNQAEGGALWDIFRREDVSKLHDYLMKHADEFRHCNFEPVKQVTHPIHDQCFYLTIEHKRKLKEEYGVEPWTFEQKLGEAVFIPAGCPHQVRNLKSCIKVALDFVSPENVRECIRLTEGFRLLPKWHKVNEDKLEVKKIALHAFNQAIKDITDESSNSNESKWIRR

SEQ ID NO: 488 - protein, 190 aa, Arabidopsis thaliana
MAEEKVKDEAMQIMGMFQILPRLVVFDLDYTLWPFYCECRSKREMPSMYPQAKGILSALKEKGIEMAIASRSPTSDIANTFLDKLNIKPMFVAKEIYSSWSHKTEHFQKIHTRTGVPFTAMLFFDDEDRNIKSVSKMGVTSILVGDGVTLGAFRQGLTEFTQNHNSIEKNKQVWRDKYSGKPTSSETDKD

SEQ ID NO: 489 - protein, 619 aa, Pennisetum glaucum
MFYHAFDGYMKYAFPLDEPRPLSCQGEDSLGGYALTLIDSLDTLALLGDKEKFGAAVEWVNKTVSVFETNIRILGGLLSAHLIASDYATGMRIQSYDDQLLNLAADLAQRLLPAFDTPTGIPFGSVNLKYGVDENESKITSTAGGGTLTLEFGILSRFTNNTVFDRVTKNSVRGIWSRRSKLNLVGAHINVFTGEWTQKDAGIGTSIDSFYEYLLKAYLLFGDEEYLYIFQEAYKAVMHYLHHDPWYVEVNMNSGATVWPLFNSLQAFWPGLQVLAGDVDPAIRTHAAFFSVWKKYGFTPEGFNLATSSVQNGQRSYPLRPELIESTYWLFKATRDYRYLDVGRDILASLQYGARCPCGYCHISDVETHKQDDHMESFFLAETVKYLWLLFDLAAGPDNIVENGPYKYIFSTEGHLLPITPEIALVDEHCSYFGAFCNGSADHGYGTSASSMKHKKANYTHLDDIETASSHYSASNMFATRGYIKGVCPGLTHAQKLGISYSDEEGSDIEQTSDGHEHHDESTIESSAQAQSSNIILISHPVASQQDQALESRSGHGDHADIVVTADSDSDSVSDSMSHDNNDGSLGANTEQLIEDTKRTSKHSEDEDIAQNLKLEDIS

SEQ ID NO: 490 - protein, 164 aa, Solanum lycopersicum
MAASARRSTGPVLRSLSPAGRFYSSSSRTSSSSASSIRFTLDRETSPSRSISVMNRQKTLASSQKKRCMCSPTNHPGSFRCSMHKKMDIRRSSSTSQTASNSIRLHMRRSAMTNSLVRIGTVEGELVKRALAALIRPSSHQQRRRSDFQRRPSRLSVISSSGDS

SEQ ID NO: 491 - protein, 121 aa, Zea mays
MCCYVGKATKIFLCLVAALLVAGLVLGFGLARHTWRAERTRQQPDCRWPDCQQQHQGGDPPLVPDAVTTQPNPLTQPAVAAFPGATATPSPSAAVAAPPTGVPYFGPPGPFVVGLGPAAHA

SEQ ID NO: 492 - protein, 122 aa, Oryza sativa
MCCYVGKATKIFLCLAAALIVVGLVLGFGLAHRTWGERKVQPDCRWPDCQLQPAYGGGGGGGDPLPATSGAGDTPPGVPLTEPAVAAFPGVASASSAAPPTASMPYLGPPSPFAVGLAPAHG

SEQ ID NO: 493 - protein, 945 aa, Sorghum bicolor
MSLLLGVHDHIWFISDELKMMQAFLRAADGARENIGVLKAYSELIRDLAYDIEDSLEEFMVFIKNKSLVKQLLSLRERHRIAVQIRTLKLRVQEVSQRNTRYNAIKLTPSTSTNVIGDTEFTRNFTALNVEEAQLVGLDEPKKKLMELIGILDEPKEHESSNTGPRVVSLVGMGGIGKTTLTKKVFDSNDLSDKFGTRAWITVSQSFEQKEIFKEMVKHLFGAESLHKLLEDHQGQQVLEVHLADYLSKRLKETRYLIVLDDVWTIDAWNRIKVTFQDSGKDDSCVVVTTRNQTLAKYCSPPSHIHQPDFLGKEEARTLFLEKTNRSLDELEKGDKTKGIVEKILNKCGGLPLAILTIGAVLANKDTEEWENIYMQLPWDLANNPSLDALRRVVSLSYNHLPSHLKPCFLHLSIFPEDFEIEKKHLVNRWVAEGLVADDTTTRTLEEVAENYFYELISRSLIQPSKLDILGNVKTCRVHDIVHDIAVSISRQENYAFIHGEHTSNISTRVGIRHLSCVASRKLNTAMDLSCVRSLTAFSKPLELKSLVWSSKFKMLRILDLKHAGFTAIQQDIKYIGLLLHLKYLHFPKRINSSVYALPKSIGNLLGLQTLDLQRSSVSTLPIEITKLHNLRSLRCSKVPNYVYFNPAQPTTEWFTDAIECLTSESGATADLHMALSSCWSNSSGIKLPKGVGRLKELQILEKVDIKRTSRKAIKELGELTQPRKIIVRGRGASKKNCKAFCEAVPKLCSLRSLNVSTMESKKAAEALDMVVSFTSPVSSLERLKLKGLLQKIPAWVGECENLVKVDLKYCQLKELVALAELRNLVQLRLKKDAFDAENLVFHEHGFPKLRILIIKDHYAMALKEVTFEQSSSPNMETIGIFHCHLEAGINGIKHLPKLKKICINNNDLGKQSSMLQEEVENHTNHPVLQIIPGSAFDPGQNLYS

SEQ ID NO: 494 - protein, 158 aa, Triticum aestivum
MEGEKNSSGDLMSSSKLVAEAAKTAYEKKSVEGIDKEKVAAASADILDSAAKYGKLEDKPVGQYLEKAEGYLKQYSSGGTEKEKTDAPAAADAPKPDAPKEAAPAPAPAAEEEKSSDGFGLDDVMKGAASLSGKKSGEEEKESGGGGGFMKMAQGFMK

SEQ ID NO: 495 - protein, 183 aa, Sorghum bicolor
MDRHQSAMQGSSGANGAGAAVQEWLYPAGGWQPEQAVVVGSFLTELLEDAPVADQPPEDVDRLSRVIRSLEAEIRGGGGPPPSAAAADGGGTADRHVPGDVHNGGLQDYLLLPDLDSIPSPWVAEAPPSLEFWAEVPAAVGHDMGGWYVDGDGVMVGYEFREQCYYGYSESPHVEQVYSPLWE

SEQ ID NO: 496 - protein, 602 aa, Zea mays
MGTATAAMDRNADGEQGKRKKKGGFRTMPLILASEVCDRFATAGFGANLITYLTQQLHLPLVEASNTLTNFSGTSSLTPILGAFAADAFAGRFWTIIAGSVVYQLGMVGVVVSAVLPSLRPPPCDDPPAATPCQRASGWQLALLYLSLLLTSLGSGGIRPCVVAFGADQFERLDSAEEEEKAKAKAEAERKRRYFNLYFFTMGLAALLALTVVVYIQENVGWGWGFGIPAVGMFMSIVVFLVGYPLYVLVKPGGSPFTRLAQVVAAAFKKRNAAVPEDPRMLYQDKELDALISTNGRLLHTNQLTFFDRAAIVTAGDISPSGQPDPWRLSTVHRVEELKSIVRMLPIWSAGIMLATASSHNYTFTIMQARTMDRHMGPHFQLPPATLSIFSNAAMLVTLALYDRVFVPLARRVTGLPSGITYFQRMGIGLAISVLSVATAALVETKRRDAAARHGLLDSPAAVVPLSVFWLVPQFAVHGVGDAFSSVGHMEFLYDQAPESMRSSAAALFWLAASIGNYMGTVLVTAVQRATRGRGEWLQDNINRGRIDNYYWLVTCITLLNLGYYLVCFYFYTMKPLEVADDCDKDCELSSLQKNGSGAALV

SEQ ID NO: 497 - protein, 123 aa, Triticum aestivum
MEIYGDLEAGCLSHSVSPIKPTSPPRKAVPGRLFCDPCDDAGELLGHHHYLDICFNCRKLLAGNKDIFMYRGDTPFCSEECRQEQIEIDEAREKRSNQTGRAEEQRQRQQQKQSTPRIPVWAW

SEQ ID NO: 498 - protein, 173 aa, Sorghum bicolor
MGDERVKAEALQILGLFQVLPRLVVFDLDYTLWPFYCECRSKRDSPSLFRHARGIIYALKEKGIDMAIASRSPTPDKAKVFLDKLELQSMFVAQEIFSSWTHKTEHFQKIQRKTGIPYKSMLFFDDEDRNIDPVSNLGVTSVLVENGVNLDMFKLGLSNFATKYAASSRKEDE

SEQ ID NO: 499 - protein, 166 aa, Hordeum vulgare
MSSRPSRSDAHLSPVDEAVRVDEVRGYYDGAAPKRHSKPSRSDHSAVYTDALAGPGVDGSHPELDKFQDLEAHSEKLVCEGGKAGEEFVETEYYKDLGCVGKQHHTTGTGFIKVDRPAGGSFELSEDPGATERHASSKGNPATNDWIPSADTVYQEASDKPNRSDS

SEQ ID NO: 500 - protein, 126 aa, Solanum lycopersicum
MANIIHSIFSPFFIINIIFLSFSCYTLAGRDIAKINDKIKHPDTFFPYDGTVLIPGIGRVVVPPKGTHVNPFTYNPITGSNNGNGLVIPIPDSGTDVGSYIPGGDDTFIPNPEVEVPSGGTIPVPP

SEQ ID NO: 501 - protein, 354 aa, Sorghum bicolor
MSPAAATTTAFAAVSVAIPNPTAPSRGRVRLPLRGVPAAARRAVASMAVSAPRSGAAASFLERRESERALHFVKYQGLGNDFIMVDNRDSSVPKVTPEEAAKLCDRNFGIGADGVIFVMPGVNGADYTMRIFNSDGSEPEMCGNGVRCFARFIAEIENLQGTNSFTIHTGAGKIIPEIQSDGQVKVDMGEPILSGPDIPTKLLPTKNKAVVQAELAVEGLTWHATCVSMGNPHCVTFGAKELKVLQVDDLKLSEIGPKFEHHEMFPARTNTEFVQVLSRSHLKMRVWERGAGATLACGTGACAVVVAAVLEGRAERKCVVDLPGGPLEIEWREDDNHVYMTGPAEAVFYGSVVP

SEQ ID NO: 502 - protein, 170 aa, Solanum lycopersicum
MDPTRAKSTSGSGHSSTHKPNSHPKPSKSELMSSAKLVADAAKAKLHHDPKQFEKSELAGAAADLLNAASQYGKLEETGIGKFVGKAETYLHKYETSHHSTTTATAAATAHTQSSGHTSGGKHEKSGSGYGEYIKMAEGLLKKDSDGSQSSESGKKGDYLKMAGDFLKKH

SEQ ID NO: 503 - protein, 104 aa, Triticum aestivum
MWASPGRLPAMEEEEECEAGAGHRAPMASCWGRFGLAALWHRLRHLFLARRRARHGRSILGAGGLNYDPLSYAQNFDDSSLELHEPDFTARFAPARNACSPRRA

SEQ ID NO: 504 - protein, 935 aa, Solanum lycopersicum
MATPETAAPPATPTENNEMVPKNEMIHEHGDEMVPQNEMIHEHGDEMVPQNEMIHEQSHEIVPENEMQNEMIHEIVPENEMQNEMIHEHSHDIVPENEMQNEHSHEIMPENEMIREHSHEIVRENEMIPEHNHEIVPENEMIHECSHETVPQNEMVHEHSHEMVPDNEMTHEHTHEMVPENEMTHDHNHEMVQENEMTHEHNHEMVPENEMMHEHGHEMVPEHEMMHEHSHEMMPEHEMMHEHHMVLGHEIVPSNEMVPDDEMIPLNEMVLAEPQPNYIETPPNNPETQPSKRRKKKSIVWEHFTIENVGGGTRRAQCKQCKQSFAYSTGSKVAGTSHLKRHIAKGTCPVVLRNQQNNQLSPYSTPPKMSGYGGSTDAPKRRYRTASSPYLAFDPDRCRQEISKMIIMHDYPLHMVEHPGFLAFVQNLQPRFDMVSFNTVQGDCVATYLREKQAIQKVIEGVPGRICLTLDMWSSCYTVGYVFITGQYIDSEWKIHRKILNIIMEPYPDSDTAFSHAVAACLSDWSMEGKLFSVTINQPLGDASVDNLRALLSVKNPLVLNGQLLVGSCLARTLSSIAQGAFNFLHETVKKVRDSVKYVKTSEFHEEKFIELKQQLQVPSTKTLALDDQTQWNTTYEMLLAASELKEVFSCLDTSDPDYKDALSMDDWKQVEVLCTYLKILFDTANLLTAPTIPTTNTFFHEAWKIQLELARAAASEDPSISGLTKTMQEEFDKYWKSCCLILAIAVVMDPRFKMKLVEFSFTKIYGEEAATFVKFVEEGIHELFLEYVALPLPLTPAYAEEVDDGALKQENGGGGLTDFDAYIMETTSQQSRSELDQYLDESLLPRVHEFDVVGWWKLNRMKYPTLSKMARDILSVPVSTVTADSVFSTVGKEMDRYRCSLRPETVEALICAKDWLQNASVNTLHAPIKMEVPI

SEQ ID NO: 505 - protein, 315 aa, Solanum lycopersicum
MEEIEHKYIEVNGLKLHIAEIGSGFSPVVVFLHGFPEIWYSWRYQMIAVAKAGYRAIAPDYRGYGLSDQPTQPEKTTFLDLVSDLLALLDALNISKVFLVGKDFGSFVISYFSILHKERVSGFIVMGVPFLPPKPLEFKKGLPEGFYISRFGIPGRAEADFGRLDAKTVVRNVYILFSRSELPIANEDQEIMDIVQPSTPLPPWFSEEDLAAYGALYEKSGFRTALQVPYRSLHEQVNITDPTVHVQALYIKGEKDYFLKFPGIEDYISSGVLKSLVPNLQIVNLPEGNHFVQEQLPDVVNQLVLEFLTKHSKVQ

SEQ ID NO: 506 - protein, 229 aa, Solanum lycopersicum
MAGLTNLKLSLFPNSCSLSSLSSNPFLVSTSIFRRTSHCFPKIFAFSSNDIKVGSNIEVDGSPCKVIEFLHVKPGKGAAFVRTTLRNYVTGNSVEKTFRAGSKIEEANIYKETKQFTYKDGAQYVFMDLTSYEEYRLNEKEVGDKAKFLKEGMDCSLLFWNGKVIDFELPITVKLTVVDVDPGVKGDTAQGGSKPATLDTGAIVSVPLFINRGEEIMVDTRNGQYMSRA

SEQ ID NO: 507 - protein, 315 aa, Solanum lycopersicum
MCSTKQKQKQNLHNQRSVVPTSTSASGGDGGGGGDWREESITGGSLKHVDLDKGKNGWASPPGDLFNLRGPHYLTKKAKVPSGAWLLQPAGVDWLRSNSKLDHVLARHDNRVMNALKKSHSEGKSLKTFIVAVNLQVPGRDQHSAVFYFATNDDEPLEPGSLLYRFVNGDDAYRNSRFKIVNRIVKGPWIVKAAVGNYSACILGKALNCYYHRGPNYLEIDVDIGSSAIASAILHLALGSVTSVTIDMGFLVESQTEEELPEKLFGAVRICQMEMSSATFIDTTSSRKVLPTANLHNPCNSSKVQAEENGENKDD

SEQ ID NO: 508 - protein, 702 aa, Zea mays
MNGGGGRRRYSSEQLLFDVPSNAGAGRWAQQSGGVRRGDGEIFVSVEPATPARLRGGDAAAGDSPGQRQQLSPGLLDLHAFDTELIPDFQVPGMYDGAQKFGYGGGLDESDMRFTANKLMSKSAVFPDGNYLKAFTEKEKAAPVAKIKVVVRKRPLNKKEVSKKEEDIIDIEQRSNSLTVHETKLKVDLTEYVEKHEFVFDAVLDEDVSNDEVYRETVEPVVPSIFNRTKATCFAYGQTGSGKTYTMRPLPLKASQDILRLMHHAYRNQGFQLHVSFFEIYGGKLFDLLNDRSKLCMREDAKQKVCIVGLQEYRVSDVETIKELIEKGSATRSTGTTGANEESSRSHAILQLAIKRRVDGNDSKPPRPVGKLSFIDLAGSERGADTSDNDKQTRIEGAEINKSLLALKECIRALDNDQTHIPFRGSKLTEVLRDSFIGDSRTVMISCISPSSGSCEHTLNTLRYADRVKSLSKGSNAKKDVSLAVPLRESSPSPLPSVVPSFSASEVMNDITERNNFGWPKQQYVKERPAPTFVERMPKVKDAVEFATSDGAYLKGQRSQGCMAPNIAEIPDTMYQQRRQPARKAKDTALRNNMRNSVAYPTRSVEPDEDDHLNNLLQEEEGLVSAHREQVEATLDILKEEMNILGEADQPGFQLDDYNITRLSSILSQKAAGIVDLQARLEQFQRLLDENNVLLYAQSPRL

SEQ ID NO: 509 - protein, 147 aa, Triticum aestivum
MALLLSPTVSFLAPSPSSAPRARALSSSTATATAASNNAFPYLASRLQCKTGASVSHVSLAKKMPVVVHASAEAGPTDAAEQPEKPKPVASIEDMPFESKQRMILEQRARMKVAKKLRQRRKRLVQKRRLRKKGRWPPSKMKKLKNV

SEQ ID NO: 510 - protein, 133 aa, Triticum aestivum
MAKLLPAGLAFLLALAAAAALAPSPASALKGAGGLGLGGAAAVVMRRGGRTCRGTVGECMEYFGVDGEGEGEVAAMAGKRRVLQDGSGYIGYDALRRDNVPCSQRGASYYNCQPGAEANPYSRGCSAITQCRG

SEQ ID NO: 511 - protein, 704 aa, Solanum lycopersicum
MNAVGRQRSGTSTAHHQRQYSDNFLETSSNGRWLQSAGLQHLQTSNNNVPQAPQEYGYYGGAQGSRMLRGAQRTYSGGSDLFAEPLTPPGNYRHSSQRRNGDEEVCPNEFSPGLLDLHSLDTELLPEMPVAGLYDAPSMHHFARAKSFDDSEQFLANNKQTGRVRGLPESNVSKSFAVDKDKASNVAKIKVVVRKRPLNKKELTKNEEDIVETRFNSLVVHETKLKVDLTQYVEKHEFVFDAVLNEEVSNDEVYHETVEPIVPIIFQRTKATCFAYGQTGSGKTYTMKPLPLRASRDLLRLIHHTYRNQGFQLFFSFFEIYGGKLYDLLNERKKLCMREDGKQQVCIVGLQEYRVSDVEMIKELIDRGNATRSTGTTGANEESSRSHAILQLSVKRSADGSESKPPRVIGKLSFIDLAGSERGADTTDNDKQTRIEGAEINKSLLALKECIRALDNDQNHIPFRGSKLTEVLRDSFVGNSRTVMISCISPNAGSCEHTLNTLRYADRVKSLSKGNNSKKDVSSSTLNLKESTTLSFSAVVPSTSTFEDDTGDSWPEQTDKDEYDEDFYEQEKPMSKKNEKLDGYSISNSEDKMKRANAQTKWKEPPRTEAKYSNSDDDLNALLKDEEDLVNAHRKQVEETMDIVREEMNLLVEADQPGNQLDNYISRLNAILSQKAAGILELQNQLAHFQRRLKEHNVLVSSGN

SEQ ID NO: 512 - protein, 747 aa, Vitis vinifera
MSKEQKRGKQEKSSEAAEKVVVAVKASKEIPKTALVWALTHVVQPGDCITLLVVVPAQSPGRKLWGFPRFAGDCASGHRKSHSGASSEQQCEITDSCSQMILQLHDVYDPNKINVKIKIVSGSPCGAVSGEAKRTEANWVVLDKQLKHEEKCCMEELQCNIVVMKRSQPKVLRLNLVGSPKMESETACQLPSEPGETAEKHSKTKNDSMKSIRGPVVTPSSSPELGTPFTATEVGTSSVSSSDPGTSPFFNSEVNGDLKKEESSHTKENLDLDESSSDTDNENLSPSSSVGFQPWMAGVLTSHHQSSQHIEQSSKKSRDKTQPPTSKALLDKFSKIDRDARIGMMNYRSELDFSGNVREAISLSRNAPPGPPPLCSICQHKAPVFGKPPRWFSYAELELATGGFSQANFLAEGGFGSVHRGVLPDGQAVAVKQHKLASSQGDVEFCSEVEVLSCAQHRNVVMLIGYCIEDRRRLLVYEYICNGSLDSHLYGRHRDPLEWSARQKVAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIDELVDPRLGNCYSEQEVYCMLHAASLCIRRDPHARPRMSQVLRILEGDMVMDSNYMATPGYDVGSQSGRIWSDQHQHYSGPILNEAYEEFSGKLSLEALRSAFWEKDKGRRTSSEDKL

SEQ ID NO: 513 - protein, 568 aa, Zea mays
MMHGQELSYDSYPSSFLAMDDMHRQLQAPPACQSHSSSSSIFFFFFLAAVIIYCVVIIRRLIKFQGRRRVKNDHAAAAAAPPPPPPPRRGSRWWWSVVETLAFLSANSSGRGFYHFVEARHRRYGPGPCFRTSLLGATHVFVSSADAARSLLGAEPAGFSKRYVRTVAELLGEHSLLCASHATHRALRRAVAPLFNAQATASLAATFDGLTRRLMKRDWSSSTGAVVVLDAALDLTFEAICDMLIGRTLRPDARRRLQSDVLAVTRAMLAFPLRLPGTRFHAGLRARKRIMDVLRQEIGSRQRQIMDMEEEEEEQQHGDDFLQSLLLLRSRRRRRSQQQQHLLPSSSAHHNDDDDLFLTDDQILDNILTLIIAGQVTTASAITWMVKYLADNKVFQETLRSVQLELKQQQQQEEADHDLLQHLNSMELAYMTVKESLRMASIVSWFPRVALEDCQVAGFHIHKGWIVNIDARALHYDATLYHNPTMFDPSRFKGGHSMHTKQPYSFLVFGAGGRTCLGMNLAKIMMLIFLHHLVTTWRWEMADDDPSLEKWAMFPRLRNGCPIHLARI

SEQ ID NO: 514 - protein, 236 aa, Triticum aestivum
MAALRHLAGATHNHRIAANSSSLFDLQRPPSCLAAARPLSLAPLRSRFTRLYALSSNDIKVGFNLEVDGAPWKILEFLHVKPGKGAAFVRTKMRNYITGNTVEKTFRAGSTIQEASISKETKQFTYKDGSQFVFMDLTSFEESRLNESDVGDRQKWLKEGMDCTLLYWNGRIIDFDLPITVRLTVTEADPGQGDSAQGGTKPATLETGAVVNVPSFVDVGDDVLIDSRTGQYMSRA

SEQ ID NO: 515 - protein, 523 aa, Triticum aestivum
MAGLRLLVGALWLLAVLREGAAAEAGAVAVDGRRAIAATGEDFVCATLDWWPPDKCDYGTCSWGNASLLNLDLSNKILLNAIKAFSPLVLRLGGSLQDKVVYGTADRPGPCAPFNKSKSEMFGFTQGCLPMPRWDDLNAFFEKSGAKIVFGLNALNGRVPLQGGAMGGNWDTTNAASFIRYTAGKGYKIYGWELGNELSGTGVGTKIGVAQYVKDAIALKTTVDAIYRGSPEKPLVLAPGGFFDARWYGEFIAKTKPDMLNVVTHHIYNLGAGVDRDTQLMDRILNPKTLDGMAGPFRDLQGLLKAAGTSAVAWVGESGGAYNSGHHLVTDAFVFSFWFLDQLGMSAKFDTKSYCRQSFIGGNYGLLNTTTFQPNPDYYSALLWHRLMGTKVLEAKFTGTNMVRAYAHCAKHAPGITLLLINLHVNATNHVSVAGRGAHAGRKHGGRFAQPPGAAREEYHLTPEGGNIQSQVMLLNGRALAAGADGSIPGMEPVKVDAARPIAVAPRSIVFVHMPDYHAPACA

SEQ ID NO: 516 - protein, 317 aa, Solanum lycopersicum
MAEATEMPYIELNTGFSIPAVGLGTWQSDPGVVGKAVETAIKMGYRHIDCAQIYKNEKEIGEVLSRLFKDGVVKRRELFITSKLWNTNHAPEDVPVALDKTLQDLQLEYVDLYLIHWPVSMKPGSVDFKPENLMPTNIPRIWEAMEKVYDSGKARVIGVSNFSTKKLEDLLQVARTPPAVNQVECHPSWQQAKLRELCKSNNVHLSAYSPLGSPGTTWLKSDVLKQPAVISVAEKLGKTPAQVCLRWGIQMGQSVLPKSTHEARIKENLDVLNWSIPDDLLAKFSEIPQARLLKGASFAHETHGQYRTLEELWDGEI

SEQ ID NO: 517 - protein, 133 aa, Triticum aestivum
MAATSGLTATVTSPPAALRTSPPPVLFLRPISRCSRLHSLKAKAAAKDQDEKKPEATKKKAYSLVCTACEGNGAIACTQCKGGGENLEDHFGGRFKAGGLCWLCRGKREILCGSCNGAGFLGGFMSTADDTSE

SEQ ID NO: 518 - protein, 69 aa, Triticum aestivum
MSDWGSVVIAVVLFVLLSPGLLLQLPGKHHFVEFGNMHTSAMAILVHAIIYFALIALFVIIIGVHITTD

SEQ ID NO: 519 - protein, 255 aa, Triticum aestivum
MESGGEEQARQNGHGGDGGDPAEWKKVAELRAVVEAQDPAAKEEDDFMLRRFLRARDHNISKASAMFLKYLAWKRAAQPRGSITEADVRGELVQDKLYVQGFDKTGRPMIYLFGNRHFAAKRDLEEFKRYVVYILDNTCTKLPAGQEKFASVVDLKGWGYANCDIRAKLAALEIMQNYYPERLGRVFLIHVPYVFMAAWKMVYPFIDDNTKKKFVFVADKDLDSTLRDAIDVSQLPEQYGGKLRLEGYKSSSTCN

SEQ ID NO: 520 - protein, 374 aa, Sorghum bicolor
MSDGKDALDLSAIGAALPNSAELSAEDKAHLVASIKNTLEGLASRHTDVLENLEPKVRKRVEKLREIQGQHDELEAKFFEERAALEAKYQKLYEPLYSKRYEIVNGVVEVEGVTEESAAETPAEQKGGDETSAEPKEEKGVPAFWLNAMKNHEILAEEIQERDEEALKYLKDIKWYRISEPKGFKLEFHFDTNPFFKNSVLTKTYHMIDEDEPILEKAIGTDIEWYPGKCLTQKVLKRKPRKGSKNTKPITKTEDCESFFNFFSPPQVPDDDEEIDEDTAEQLQNQMEQDYDIGSTIRDKIIPHAVSWFTGEAAQDEDFEVMDGEDDDDEDGDDDEEDEDDEDEDDDDYDTKKTKGTAGGEGQQGERPAECKQQ

SEQ ID NO: 521 - protein, 70 aa, Sorghum bicolor
MSDWGPVVIGLVLFVLLSPGLLIQLPGRHHFVEFGNLQTSAVSILVHSIIYFALITIFVIVIGVHITTGN

SEQ ID NO: 522 - protein, 138 aa, Zea mays
MARLLRAAAVLALLAVSTAALSAPAWAGGVSAGDLAHLGAAVVIRRGGGRACRGGTTVGECMEYLDVDAEGEADVAGMATGGSKRRVLQGGSGYIGYDALRRDNVPCSQRGASYYNCQPGAEANPYSRGCSAITQCRG

SEQ ID NO: 523 - protein, 225 aa, Glycine max
MATVTFSFSAKTLTLPYHPKTPISNFTPVTNLRLPPSIVTRTRNCNRIRAALDGDFSAKRSSSSNNNDQRETIMLPGCDYNHWLIVMEFPKDPAPTREQMIDTYLDTLATVLGSMEEAKKNMYAFSTTTYTGFQCTVDEATSEKFKGLPGVLWVLPDSYIDVKNKDYGGDKYINGEIIPCKYPTYQPKRSAPKNESRRYERRRDGPPPDRRRPRQEAAASDSSST

SEQ ID NO: 524 - protein, 316 aa, Triticum aestivum
MAEQQQQIEHSHLAIRGLNLHVAQAGTGELGTVLFLHGFPEIWYSWRHQMLAVAAAGYRAIAPDWRGYGLSDQPPEPEAAVYRDLEEDLLAVLDALSVPKAYLVAKDFGAMPAYDFALRHPNRTCGVMCLGIPFLHGGSSFTAMPEGFYILRWREPGRAEADFGRYDVKRVVHTIYILFSRSEIPTAKEDQEITDLADLSTPLPEWFTEEDLAVYTSLYEKSGFVYPLQMPYRSLHKRQPIEDPKFEVPVFVVMGEKDYVIKFPGVEAVLKNGTMEKFAPDLKITYIPEGSHFVQEQFPDKVNELLLGFLKDHPVA

SEQ ID NO: 525 - protein, 254 aa, Triticum aestivum
MAAPRPTVLVTGAGGRTGQIVFSKLRERSDQFAARGLVRSEESKQKIGGADDVYVADIREAEHLAPAVQGADALVILTSASPKMKPGFDPTKGGRPEFYYEDGAYPEQVDWIGQKNQIDAAKAAGVKHIVLVGSMGGTNPNHPLNSLGNGNILVWKRKSEQYLADSGVPYTIIRPGGLQDKDGGVRELIVGKDDELLQTDTKAIPRADVAEVCVQALQYEEVKFKAFDLASKPEGEGTPTKDFKALFSQVTARF

SEQ ID NO: 526 - protein, 421 aa, Triticum aestivum
MLPTGRSRPQPRPAPRSWSFSDMDFSDPKRNSRYLSKIIMVALLTAMCVVMLTQPPCHRKAPSVFSIHELGVTHVLVTGGAGYIGSHAALRLLKDSFRVTIVDNLSRGNIGAVKVLQNLFPDPGRLQFIHADLGDPKAVNRIFAENAFDAVMHFAAVAYVGESTLEPLRYYHNITANTLVVLEAMATHNVKTLIYSSTCATYGEPEKMPITEETPQFPINPYGKAKKMAEDIILDFSKSRKSDMSVMILRYFNVIGSDPEGRLGEAPPPELREHGRISGACFDAALGIIPGLKVKGTDYETADGTCVRDYIDVTDLVDAHVKALNKAERGKVGIYNVGTGRGRSVKEFVEACKKATGVDIKVDYFPRRPGDYAEVYSNPARINRELNWTAQHTELQESLRVAWTWQKKHRSGYADSGRYIF

SEQ ID NO: 527 - protein, 544 aa, Triticum aestivum
MARCGVEVIASRGCSRLILPGMQPSSASAASSSVSASRSAAAARRPPDGPFAGLVVCVTGLSKEARSQVKEAAERLGGEYSGSLHPKCTHLVVQSFAGRKFEHALKHGPRNGLFVVTLGWFVDCVRRNMRLDESLYSIKNIGENGLLLGESNRLVGLPVNEKSCLPPMIFQDKACSDTTHKRQLQAHREEPEDDVFVFTNDTIYIDPGISGEMKKKISDAATSEDAKLLDHWFIGCHATYVVCEDASVKRYVGHSDNIVTPFWILKTVKEKNLQRLVHLSSDLARHVAVVLENFHTSRENTKLGSVPSLNSSELPTQGEIDETHQERQKFVEAAKKDIRDRRVRRMQSCEVPIHPLTPVTLLDSICWTISEPVSSASIYMDSSWSEDADEQQSTTYFDADGDGKDRDQSADNLSRPLRESERSEVIFKNHFFTILFPLDRFGELGPSSRTFFSNGGFTREQVLDHIYNFYQENMSTDEINVALHTDSRHADRLRSLYASAECAERGFVVAFKRIDFLGSRRSFEALKRLSRENNSNVYELVIRA

SEQ ID NO: 528 - protein, 69 aa, Triticum aestivum
MASFATQLLDVFYDLVQRVTGYSARAEDDKDLQKHSNLATTEAFRTEEVIEIRSRNHPDVPGGSGAQVN

SEQ ID NO: 529 - protein, 309 aa, Triticum aestivum
MASHFVLSTGAKIPSVGLGTWQSEPGVVGDAVYAAVKAGYRHIDCAQVYGNEKEIGFALKKVFDEGITSRQDLFITSKLWCTNHAPEDVPVALDGTLQDLQTDYVDLYLVHWPIRMKKGAGFSPENVIPADIPATWAAMEGVYDSGKARAIGVSNFSCKKLEDLLAVARVPPAANQVECHPVWQQAKLRDLCASKGIHFSAYSPLGSPGTFKAFTVLEHPVVVSTAEKLGKTPAQVALRWGIQSGHSVLPKSTHEERIKANFDVFDWSIPSDLFAGFSEIEQTRLIRGKFWTHPEGLFKSEEEIWDGEI

SEQ ID NO: 530 - protein, 472 aa, Solanum lycopersicum
MANLISKSTKFNHFLQNTRVCFLRSFTTSAAGAGAGGYIKPAGSFSGESAAIFRPERYQSGKAGEQLDTIDYEEDENQVMDFPGGKVPITPQMKFISESSEKRLPCYRVLDDDGYPLPGTIFEEVSKELAIKMYSSMVTLQTMDTIFYEAQRQGRLSFYLTTAGEEAINVASAAALSLDDFVLPQYREVGVILWRGYPLEQVANQLFGNKFDYGKGRQMPCHYGSNELNYLTVSSPIATQIPQAVGVAYSLKMEKKEACAVTYFGDGSTSEGDFHAALNFAAVLDAPVVFICRNNGWAISTPINQQFRSDGIASRGQAYGVRSIRVDGNDALATYSAIRAARQMAIKEQRPILVEAMTYRVAHHSTSDDSTKYRPVEEIEHWKTAKSPISKFRKYIQRNGWWNDENESELRGDIRKQVLQAIQAAEKVDKPSLKDLFTDVYDKMPLNLQDQEKFVKDAVKRSPKEYPSDVPI

SEQ ID NO: 531 - protein, 289 aa, Solanum lycopersicum
MGDQIAKGEEFVKKAEKKLSGWGLFGSKYDDAADLFDKAANCFKLAKSWDRAGAVYVKLASCHLKLDSKHEAAGAYANAAHCYKKTNMREAISCLEQAVHMFLDIGRLNMSARYYKEIAELYEQEQNLEQAITYYEKAADLFQSEDVTTTANQCKQKIAEFSAKLEKYQRAIEIFEEIAQHSIKNNLLKYGVRGHLLNAGICQLCRGDVVAINNALERYQELDPTFSGTRECKLLVDLEAAIDEEDVAKFTGCLKEYDSMTKLDEWRTTLLLRVKEALKAKELEEDDLT

SEQ ID NO: 532 - protein, 927 aa, Zea mays
MLSFSRSAILSYLLWCLLFLTLASSNGAVATAKPKAGCGYKLVSLVQLPNGGGLVGYLQVKQRTSTYGPDIPRLRLFVKHETRERVRVQITDADKQRWEVPYNLLPREPAPPVTGGKVTGAPFTGAEYPGEELVFTYGRDPFWFAVHRRSTRQPLFNTSAGALVFKDQYLEVSTALPKNAALYGLGENTQPGGIRLRPNDPYTIYTTDISAINLNTDLYGSHPVYMDLRSLGGRGVAHAVLLLNSNGMDVFYRGTSLTYKVIGGLLDFYFFSGPTPLAIVDQYTSMIGRPAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNSSYGVYQRGMERDIFIKLDGQPYLAQVWPGPVYFPDFLNPNGVSWWIDEVRRFHDLVPVDGLWIDMNEASNFCTGKCTIPKTHQCPIPDTKTPWLCCLDCKNLTNTRWDEPPYKINASGQTARLGFNTIATSATHYNGILEYNAHSLYGFSQAIATHTALQGLQGKRPFILTRSTFVGSGAYAAHWTGDNKGTWENLRYSISTMLNFGIFGMPMVGSDICGFYPSPTEELCNRWIELGAFYPFSRDHANFASPRQELYVWDSVAKSARNALGMRYKLLPYLYTLNYQAHLTGAPVARPVFFSFPDFTPCYGLSTQFLLGPGVMVSPVLEQGATSVSAMFPPGTWYNLFDMSKVVVSRSGAPVKLDAPLNEINVHVYQNTILPMQRGGFVSKDARATPFTLVVAFPFGATQADAEGAVYVDDDERPEMVLAEGQASYVRFHASVRGKAVTVRSEVLMGSYSLHKGLVVEKLSVLGLEGTGKDLAIQVDGTDATAVATSSPYFAAGGNAKLQGEEGVEDSKNGVMVEIGGLALPLGKSFTMTWNMRIEA

SEQ ID NO: 533 - protein, 218 aa, Zea mays
MAFTPATACCKASLALAPRASPRGPAACAQAALLCTPSTSVFRGLRAPASAAPAPRRRRSAASTGIVCGKVAKGSVPPNFTLKDQNGKPVSLNKFKGKPVVVYFYPADETPGCTKQACAFRDSYEKFKKAGAEVIGISGDDAASHKAFAQKYRLPFTLLSDEGNRVRKEWGVPSDLFGTLPGRQTYVLDKQGVVQYVYNNQFQPEKHIGETLKILQTL

SEQ ID NO: 534 - protein, 704 aa, Zea mays
MERSCYFPLRWESTGDQWWYASPIDWAAADGHYDIVRQLLHLDPNLLIKLTSLRRIRRLEALWDDDARFADAARNRASVARSLLLECECRNHRPGAGENTLLRAGYGGWVLYAAASAGDAAFVRELLERDPLLVFGEGEYGVTDMFYAAARGGSADVFRLLLDHAMSPRCSTSCRNGEASARRSSVFRLEMMSRAVHAAARGGSVEMLRELLDESSVSTYLDIRGSTVLHAAAGRGQLQVVKYLVASFDIINSTDNHGNTALHVAAYRGHQPVVEALVAASPSTLSVVNNAGDTFLHSAVTGFRTPGFRRLDRQLELMRYLIRERTADIQKIINLRNDAGLTALHLAVVGCAHPDLVELLMATPSIDLNAEDANGMTALALLKQQLRSATSDRLIKQIVSAGGVLNSSILRTRSAIASQIKMQGGIASSPGTTFKVSDAEIFLFSGMGAAESLRPSSCSSNGKDDDPTHADADCAENRGSSEKRLSSASRAKDRLKMMLRWPRHKDKTPKKSEDSSPLGSISRLNEHGAETPAPLRQKFTKTTALNGKRTLAVKSSTPSSSSTKKKLNTKLIHGIMEAMPQLAPSTARSASPTDTFLRSSVSSTPQPLAKLKDICLDDEISMVTPPAGRLKDSDDAMEDPSCSNNSSMDDGCGAGTAESAARKHGCGNGRLINICFGAQGLTVEDSASGQQTSKMFKQQCLRVS

SEQ ID NO: 535 - protein, 134 aa, Oryza sativa
MAARGRGSACNGAAVLGAAAAVVIVGFLVMSAAPLAEAARYTVGDSSGWRFYAEGWAKGKTFRAGDVLEFKYNAVVHDVAAVDLAAYRSCTVPKGVRKMRSGRDKVTLRKGTHYFICTEPGHCKAGMKLAVRAI

SEQ ID NO: 536 - protein, 187 aa, Oryza sativa
MALTVRLHTAVAAVAVAVVVAMGMAAAQMSPAGAPAPAGGISPACMDAVLNMSDCLTYVMNGSTARKPDEPCCPELAGLLESKPVCLCQLLAGGASSYDISVDYKRAMALPGICGLAAPPVTACALLGVPVPMAPSASPMAGLGPSTEPQMPEKSPSASPSESSNHAPGRFTALAAVVLAVAAAGMV

SEQ ID NO: 537 - protein, 227 aa, Oryza sativa
MASAVSLLLLSSPRPLRRAAPVPALRSQARHPLLLGHAGETALGVWATRARLPAPPPRASNPNNDNDNSGAVEAPDRLVAAVAYLYPFLDGVHHGRFLLAQFPLFSTLLSPLAPAARLFRSSPLTPFLLFLTLYFAVVRNQQAFSRFVRFNAMQAVALDVLLIFPDLLVQSFAPSTGGGIGFELFQSMESTVFLFLLVCLVYGGGACLLGKTPRLPIVADAAERQVM

SEQ ID NO: 538 - protein, 491 aa, Oryza sativa
MGSIAADGDKPHAVCMPFPAQGHVTPMLKLAKILHHRGFHITFVNTEFNHRRLLRSRGAAALDGLPGFRFAAIPDGLPPSDADATQDVPPLCRSTRETCLPHFSRLLADLNANASPESPPVTCVVADDVMSFAVDAAREFRVPCALFWTASVCGYMGYRYYRSFLDKGIFPLKEEQLTNGFLDAPVDWTPGMSKHLRLKDFPSFFRATDPDEYMFHFALHVTERLAEADAAVLNTFDELEPEALDAMRAMLPPSVSIHTIGPLGFLAEQVVPKGSPLDALGSNLWKEDDSCFGWLDGKPPRSVVFVNYGSVTVMTNEELVEFAWGLANSGHDFLWIVRPDLIHGDAAVLPPEFMESVGGRGLLASWCPQEAVLRHEAVGVFLTHSGWNSTVESLCGGVPMLCWPFFAEQQTNRRYSCTEWGVAMEIDDDVRRDAVEAKIREAMGGDKGREMRRRAGEWKETGLRATRPGGRAHASLDALVADVLLSGGKAR

SEQ ID NO: 539 - protein, 250 aa, Oryza sativa
MALQQRPGMLGIGCSNVLARARVQQCLAAASHSNMPCLPVLLHVNGSKKQGSSFLSSQRIGLSRRRRRRDLSGVVVAEVSAAAGVTPASSSSSPGGISVSDVLWPSAGAFLAMAVLGRMDQMMAYKGVSLTIAPLGAVCDVLFTAPGSPAAKKYNMFVAQIGCAAFGVLALSLFGPGWLARGAALSASIAFMTITGASHPPAASLPLLFIDGPKFHHLQLWYALFPGAAGCIILCLIQEVVIYLKKNFKF

SEQ ID NO: 540 - protein, 717 aa, Oryza sativa
MEKPASCCCYFPLRWESTGDQWWYASPIDWAAADGHYDIVRQLLHLDPNLLIKLTSLRRIRRLEALWDDDARFAGAAGHRAGVARSLLLECECSKNGGAAAAAENTLLRAGYGGWLLYSAASAGDMAFVQELMERDPLLVFGEGEYGVTDMFYAAARGGNAEVFRLLLDHAMSPRCSTNCPNGGEGARGGGGGRSSVFRLEMMSRAVHAAARGGSVEMLRELIERRSDVSEYLDFRGSTVLHAAAGRGQLEVVKYLMATFDIVDSTDNQGNTALHVAAYRGHLPVVEALVAASPSTISAVNRAGDTFLHSAIAGFRTPGFRRLDRQMELMRHLIRGRTSNIQKIINLKNDAGLTVLHMAVVGCVHPDLVELLMTTPSIDLNAEDANGMTPLALLKQQLRSSTSDKLIRQIVSAGGVLNSTVLRTRSAIVSQIKMQGGIASSPGTTFKISDAEIFLYSGIGTAESRRPSSCSSNGKCDHAHHGDAKCGNAENHGSSEKRLSSASRAKDRLKLMLKWPRQKMSRGHKKSDDGDAMDSIKKLSEQAVETPAPLRQTFTKTTALNNKRTLAVKTSTPSSATKKKLNSKLIHGIMEAMPHLASSSPASAFPRSSTPPPPQSGKMKGVCLELDDENSMTTPVFGKLKDIVLNNDDDDDAMGEPSSSGSSVNDDASAEMPARRHGCGNGRLINICFGAQGLTVEDSASGQQTSKMFKQQCLRVS

SEQ ID NO: 541 - protein, 323 aa, Triticum aestivum
MGAQRALLASFLLAALATQAFVSVSARTGPTDKAGQDDVKKPDCVPSLDPHNFPGHGGTTVPLPSHGGSSGTPPYHGGSGTTPSHGGSGSTPSHSGSGSLPDPSHGWYGTPPSHGGSGSLPDPSHSGGYGSTPDAPSHGEGAYGSSPTPSTGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAAAGGVDSAAAAQAASFKKANEGRKA

SEQ ID NO: 542 - protein, 406 aa, Triticum aestivum
MNGPSAGAGSGGEGPLVYQAWKGNNVFFLQGRFIFGPDARSLFVTMFLIIAPVTVFCVFVAKELMNSFSYGLGLPVMVVAVVFTAYDLSLLFLTSGRDPGIIPRNAHPPEPEGFEGNAEVGANQTPPLRLPRVKDVVVNGITVKTKYCDTCMLYRPPRCSHCSICNNCVERFDHHCPWVGQCIGLRNYRFFYMFVFSTTLLCLYVFGFSWVYIIKIRDAEQITIWKAMAKTPASIALVVYTFIAVWFVGGLSVFHLYLMSTNQTTYENFRYRYDQRANPYNRGVVENIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 543 - protein, 197 aa, Solanum lycopersicum
MAITNLLSTTITLKHSPFLLLKPSTKLRNPKRPTIRAQSKNDDSVDGPDRLISAITYFYPFFDGVQYGKYVITQFAPIQTLIQPLVPAIRVFKSFPLNGLLVFFTLYFIVVRNPNFSRYVRFNTMQAIVLDVLLIFPDLLERSFNPSDGFGLDLMMSFDSTVFLFLLVSLVYGTSSCLLGQLPRLPIVAEAADRQVL

SEQ ID NO: 544 - protein, 345 aa, Zea mays
MASADAGTCPWDALPLHLQERILSLLPITELLPVAAVSRAFHRLLRSPTFHALLSPHRLDAFFLLSPRLAVHPLSRRVRTMPAFAALSPPSYPLVSSPSPSLLITCASLQFLPPIPDGAYLLSAIVPSRGSSTSCTLVAVITGAAARSYTLDTGDPSPQWASRGDLPLSLTLLENAAVSGDRSKLFVLGRGPEALLVFHLVTGTWEVLHVVMPQGLTTAHLFLFDGSLFLVGGIESFGVVDRVVVWRLDDDKVEEVWWREVSVMPTEVFDELLAGRFGRFWHFQAADRLGIVCLYNAVDRRLVMFDAADGMWTVLPRLSALDACESFRWFGHVLEPGVEILMGLR

SEQ ID NO: 545 - protein, 466 aa, Triticum aestivum
MATSATAARHMVALPYPGRGHINPMLAVCRLLVAADGALTVTVVVTEEWHGLLASAGVTPTLPDRVRLATIPNVIPSEHGRGADHGGFIETVNCKMGEPVERLLDRLALELGRMPDAIVADTYLQWAVAAGAQLGVPVCSPWTQPATFLLALCHLDLWRPAVEGFSEEELSRKSLEQYVPGLSSVRLSDVKIFLAWEGPIKISAEVFVKVRKAQCVLFTSFHELEPSSMSKIAELLPCPIYPIGPAILRAPDNEEKARDEEHRRWLDAQPENSVLYVSFGSFVAMPPKQFEEIAVGLRDSAVRFFWVARDRATDGLREMCGDRGLPVPWCDQQEVLRHPSVGGFLSHCGWNSVLEAVCAGVPVLGFPVAWDQLVNARMVADEWKAGIDLREQRGKDGIVSRAAVSAAARKLMDLDSGAGQEMRTRAAQLREASRGAVIEGGSSHRSLTGFLEDLGKGKLDVPESSA

SEQ ID NO: 546 - protein, 783 aa, Oryza sativa
MEEEQSPRLAAGEPERKLEDGVTDAEDPGCTGNAAMSSLEQPLLKRSNTLTASHLAMVGAKVSHIESLDYEIIENDLFKHDWRRRSNVEVLQYIFLKWAMAFLVGLLTGVIASLINLAIENISGLKMLHMVQLVRKKRYWAGFLYFAGVNFGLTFIAAMLCVVFAPTAAGPGIPEIKAYLNGVDTPNMFGAPQLIVKIIGSICAVSSGLDLGKEGPLVHIGACLANLLSQGGSGRHRLRLRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPEISPIVGILTRQDLIAHNILGAFPHLASKRKTH

SEQ ID NO: 547 - protein, 188 aa, Oryza sativa
MGTAAGDAAEQPPAAPEAKRAAAPRTLVFTYGTLKRGFSNHGLLQDLARDGDASFVGAATTAPRLPLVCGPYRVPFLLNLPGAGHRVSGELYAVTPRGLDRLDELEGVSRAHYERLPISVLLAEGAQVDAVAYYAHRGYADDLWARSGKKGYPEYSPAVADGYIRRKDRPQQLTFLEQIRVFVSSQSS

SEQ ID NO: 548 - protein, 360 aa, Solanum lycopersicum
MADLNPFDLLGDDDNDDPSKLIAIHQQKVDPAKKASAPAPAAAKKQPAKLPTKPPPPTQAVREAKTESGRGGGRGGGRGYSCGRGGGGFNREGSNNENFARNREFSGGIAAPEYVEGGRPSERRGGYGGPRAFRGGRQGGFGNGEMPEGDRPRRTFERRSGTGRGSEIKREGAGRGNWGTEADEVTLMTGEVADEGEKNLNVEKPSTEEEAGVDKKENPAAEAADKEPEDKEMTLEEYEKLLEEKRKALQALKTEERKVDTKVFESMQQISKKSSDEIFVKLGSKDKRKESAEKEEKAKKAVSINEFLKPAEGERYYAPGGRGRGRGRGSRGYSEANTMSNVEAAPPIEDPGHFPTLGGK

SEQ ID NO: 549 - protein, 470 aa, Zea mays
MATAAAARHVVAVPYPGRGHVNPMLVVCRLLAAADAALSVTVVVTEEWHALLAAAGVPGTLPDRVRLATIPNVIPSERVRGADFAGFVEAVHIKMVAPVERLLDRLSLERKPDAIVADTFLAWGVGVGSARGIPVCSLWTQPATFFLALWHLDRWPPVDGHQGEEGLSCRSLDQYLPFPALAPVKCSDMKTLRSMVLPMKRLAQVFSNLRKAQCVLFTSFYELETGAIDGTSQVVPCPIYAVGPSIPYMPLEGDSGEFHHEEDYFGWLDAQPRSSVLYVSFGTHVSMPSSQLEEVALGLHESTVRFFWVARDRASTATLEQISAGGKGLVVPWCDQLKVLCHPSVGGFLSHCGWNSTLEAVFAGVPMLAFPVAWDQLVIGHLVADEWKIGVDLRERRREDGVVGRAAICDTVTKLMDLTDDDSLEMRRRAAELREASRRAVQEGGSSRCSLNSFVRDVIEGRLNVAETSR

SEQ ID NO: 550 - protein, 179 aa, Sorghum bicolor
MGAAGDPAPLVFTYGTLKRGFSNHRLLEELSASGDATLVGPAVTSARLPLVCGPYRVPFLLNLPVPAVAAAHRVRGEAYAVTPRGLARLDELEGVATGHYERLPVQVEVEVEGEGEGGTRVVEAIAYFAHRSYAGDLWRRSGEEGVPEYTHGVAAGYVRRKDRPQGQTFLDQIRVFVSS

SEQ ID NO: 551 - protein, 356 aa, Triticum aestivum
MSSLSMKCLLFTSAVAVVLALFPVAAVGAGLKVGFYSKSCPSAENLVQQAVAAAFKNNTGVAAGLIRLHFHDCFVKGCDGSVLIDSTANNTAEKDAPPNKPSLRGFEVIDAAKKAIEAKCPKTVSCADILAFAARDSIALAGNVTYKVPAGRRDGRISTNASALSNLPSPLSTAAELVGNFTLKNLTAEDMVVLSGAHTIGVSRCSSFTNRLYAFSNTSQVDPTMSSAYAFLLKSICPANSSQFFPTTTTDMDIITPTVLDNKYYVGLTNNLGMFTSDQALLTNSTLKASVDEFVKSEKRWKSKFVKSMVKMGDIEVLTGTQGEIRLSCRVINKGSAGLEINNGPDYGEFAEIATS

SEQ ID NO: 552 - protein, 289 aa, Sorghum bicolor
MGDHEGRGDDFEKKADQKLSGWGLFGNKYEEAADLLDRAGNFFKLAKNWSRAASVYKKIADCHLQGDSKHEAASAYVEAANCYKKFSPQDAAQALNNAVNLFLEIGRLNMAARYSKDIGDIYQQEQDLENAAVYLNRAADLFDSEGQSSQANSMTQKIAEIYAQLEKYQKATELFEEIARKSINNNLLKYGVRGILLNAGLCQLCRGDTVAINNSLERYQDIDPTFSGTREYKLLADLAASMDEGDVDKFTDAVKEFDSMTRLDPWKTSLLLKAKNELKKKDEDEDDLT

SEQ ID NO: 553 - protein, 963 aa, Triticum aestivum
MDAATRRAWLLLLLVAATVPAGLCQTNPDDAAALRSVMGAWTNYPSSWNSGDPCGAPWDGIMCSGNGRVTSLRLSSANMQGTLSDSIGQLGQLMFLDLSFNGGLSGTIPASIGNLGKLTTLILAGCSFSGDIPKELGNLLQMTFLALNSNKLTGTIPPQLGLLSKLFWLDLADNAITGSVPISTGTTPGLDLLTNTKHFHFNKNQLSGTLTGLLKSNMTLIHILFDSNQFTGSIPRELGSITSLQVLRLDRNQFAGAVPNITNLVNLNELNLATNKLTGSVPNLSSMNVLNVVDLSSNSFTASAIPAWSTNLTNISSISMSSASLTGEVPQELFNLPQLHDVLLSKNQLSGTLKMAAGISTQLQTVDLEENSIVDIAGTSNYKKTLLLAQNPVCADKPIQFCSAQKQNVIAYSTSMAKCNTARGCQSGQDQNPANCGCAYSYNGKIVFRAPSFKDVSSTANFQQLEETLWRLLSLREGAVVLNRIHFNEDNYLQVQVSLFPSTGTLFNVSEVSRIGFLLSNQTYKPPPIFGPYFFIADPYVPFIVAGGKKSKFSTGAVAGIAVAGGVLVIALILVGLFALRQKRRNKELKERSTDPFASWGATQKDSGGAPQLKGARFFSFEELKSCTDNFADSHEIGAGGYGKVYKGTLVDGIRVAIKRAQSGSMQGAPEFKNEIELLSRVHHRNLVSLIGFCFQQGEQMLVYEFVAGGTLRENLVVRGTYLGWKKRLRIALGSARGLAYLHELADPPIIHRDIKSTNILLDENLKAKVADFGLSKLVADTEKGHVSTQVKGTLGYLDPEYYMTQQLSEKSDVYSFGVVMLELVSGRQPIEKGKYVVREVRQAIDPADRDYYGLRAIVDPAIRDAARTPGFRRFVQLAMQCVDESAAARPTMGTVVKEVEAMLLNEPDGEGSNSAGSSATEFDGAGRGAPSHPYSDVEITRSSYGGAGEASDYMPYFEVKPK

SEQ ID NO: 554 - protein, 101 aa, Unknown
  Sequence found in Organisms: Sorghum bicolor, Triticum aestivum
MDGSAFLSLSPELRDALAKVAVFVLVQGLVYLILRSSSDVFSKDGGGLRSLSFRPMRSMSVRRVLAPLSDVPVGTDEPSPSPSWSMSPAASSSRRRAARED

SEQ ID NO: 555 - protein, 876 aa, Arabidopsis thaliana
MNTYSPLQLIPTPIHLKSSRAASPSSLRVASPLIIRAASSDDSQSVENQTLEVLEWRALCNQLSPFASTTMGLSATKNAEIPVGNSPEESRNLLNETSAALAAMEMMKSRGLGLSEIQDLSDIVERAVSGQLLTVRELCTVRSTLTAATSTFQKLRKAAISDNRVTPLVDILQGCDFKDTLQQKISFCIDCNMTMILDRASEDLEIIRSERRRNMENLDSLLKKISTKIFLAGGINKPLITQRRSRMCVAIRATHKSLLPGGVVLSVSSSRATCFIEPKEAVELNNMEVRHANSEKAEEMAILSILTSEVVMAQREILHLLDRILELDIAFARASHANWINGVYPNVTSEHTKTPGLAVDIDSAQHPLLLGSVLGSPNGGDIFPVPVDIKVESSAKVVVISGPNTGGKTALLKTLGLLSLMSKSGMYLPAKNCPRLPWFDLILADIGDPQSLEQSLSTFSGHISRIRQILDIASENSLVLLDEICSGTDPSEGVALATSILQYIKNRVNVAVVSTHYGDLSRLKDNEPRFQNAAMEFSMETLQPTFRVLWGSTGLSNALRVAKSIGFNKRILENAHKWTEKLNPEQDVERKGSLFQSLMEERNKLKLQATKTAAFHRDLMNLYHELEHESHDLDKRERALLKKETQKVQEDLNSAKSKMERLVAEFESQLEITQADQYNSLILKTEEAVAEIIEACCPMDPDSLEEEYSDYSPQAGEKVLVTGLGDKLGTVVEEPGDDDDTVLVQHGKIRVRIKKKDIKPLPRSTSSQTSNRSLRSKRQINMKELGSVLQMQSEPVRIQTSKNTLDLRGMRAEEAVHQLDMAISGRDSGSILFIIHGMGAGIIKELVLERLRKNTRVSRYEQANPMNHGCTVAYIK

SEQ ID NO: 556 - protein, 608 aa, Solanum lycopersicum
MASATTSSSTNKIQEYDEVTSYKNKNCEVFVNRQEIKDAIAKAIELRALHAALLQQQQGNSPMKKFPSSASPTLSLHSHHFSSQDYPIFTPSYEDEPLPGYKQLHLDHNPNYAEVWDEYGVVNGNNESVLSDYRKANSTFKNGFTNSLINLEPHMCPADDQRSVTSSCTDHVTTRKASPIARYIKSRRNSLGDLNSISSCNKCKPATISTEVDGGGSSTSKSGKNSNVIVPLTDSHVSVQSQPKSKGGMNLSWLFPKLKKKNKVEISPNRTDQSDEVLKDHHIGMVSIETLKKELMEANESRDAALIEVSGMKSSLGELKQKLEYLETYCEELKKALRQAIQATESPVSSNKLRTFPNGKSIDGDGENVIPVNDEVMLEGFLQMVSESRLSVKQFSKTLIGQIEATDNLLTDNLNLLLQPYKLSLNSKYSKAVLYHIESIINQSLFQDFENCVFQKNGSAKHLDPQQDRHAQFSSFVALRNLSWNEVLRKGTKYYSEEFSKFCDQKMSCIIATLNWTRPWPEQLLQAFFVAAKCIWLLHLLAFSFNPSLGILRVEENRTFDMHYMEDVFADRQRSQGPSKVKVMVMPGFYVHDRVLRCKVICRYKNVS

SEQ ID NO: 557 - protein, 215 aa, Solanum lycopersicum
MAGGGASTKASNGGPTRVRKRVEVESAASAASLKRAKDGSAFARCEECSKDVPIALISFHNCSLDAKIKMNLEAQVVENQTEVKKPAAKSKEKSTEPKAKREKKPKNPNAPKRPPSAFFVFMNDFRQEFKAANPDCKSVSMVAKEGGEKWKSMTDEEKKPYQEKAAELKAAYEKSFKSNTDADNSNDDDEEPEKEVKEEIAVDEEAKEEIEVDEE

SEQ ID NO: 558 - protein, 455 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQSKPRGFGSSRSAASAPSVGDDFEKRTESIAAKSRLKAEERFKADIVSPEQWESWIRDQQESEGVTPGEDVYIILRLDGRVRRSGRGMPNWNDILQELPRLEELLSKLER

SEQ ID NO: 559 - protein, 683 aa, Oryza sativa
MLVSFSPLFDASGSLTLASPMPLHSHLLLLLLALSTSVVAGSVSSSPSVCAGGGGGGGDAAIVAAAFRGVRNFQLPPCGAVRELRLPSRNLTGAVAWAALANLSGLAVLDLSGNALQGAIPGGFWRAPSLRHVDVSGNQLGGALRVVEASPRLESLNVSGNRFTGVAGAEALAGLRVLDVSANRIRAVPQGLRRLARVNRLDLSRNAMQGRFPGDLPPLAGLRFLNVSYNNFSGVVDGGAVKKFGHSAFVHSGNTSLVFSENSTARRPPPPPSPPPSHPHRSGGKNDTATPARRTRTRSRRKHLSVVTVAVVCGVVSVAMLLCLVGCVACGVLRCRKNRGKEAEEEKRKAHWGGKDEEEVVAVAAAAAKGGSAAPVVLFERPLMELTLADLAEATSGFGRESQLAERGGRSGAAYRAVLPGDMHVVVRVVDGAMAVGEDDDPATAATAFRDLARLRHPNILPLLGYCIAGKEKLLLYEYMEKGDLHRWLHELPAGRPDMEDDTGGDIWEVAEDKRSISDWPTRHRIALGIARGLAFLHQGWAGSGRPVVHGHLVPTNILLGEDLEPRISDFGHPSDTTPEGDVYSFGVLVLELITGQAGWDEASVSWARGIIRDQKGLDIVDPRVRDEAGGGPETSTVEREMVECLRVGYLCTAQSPEKRPTMQQVVGVLKDIRVAPASSSST

SEQ ID NO: 560 - protein, 571 aa, Sorghum bicolor
MAAAMARRAAGLLPLLLLSSRSGARIALHRAVSQIPPPRSYRLLSQQANPSPSSSFSASASASNGTAAERTRELHLYNTKSRKKEQFRPRDPGGEVGMYVCGVTPYDDSHIGHARAYVAFDVLYRYLRYLDYEVRYVRNFTDIDDKIIARANQLGEDPFSLSKRFSDDFLSDMANLQCLPPSVEPRVSDHIHEIINMIKQILDNSCAYVVGGDVYFSVENFPEYGELSGRKLDDNRAGERVAVDERKRNPADFALWKAAKDGEPWWDSPWGPGRPGWHIECSAMSAHYLGHSFDIHGGGEDLIFPHHENEIAQSRAACCDSTINYWIHNGFVNVNSQKMSKSLGNFVTIRKVIEMYHPLALRMFLLGTHYRSPINYTIEQLNVASDRLYYTYQTLRDCEESCQQQGSNTGNSLPPNTLNYIQKLHDEFETSMSDDLHTSVALAAISEPLKVMNDLLHTRKGKKQDKRLEALSALDEKIRVVLSVLGLLPSSYHEALQQLRDKALRRASITEELVLQKIEERTAARKAKQYEKSDEIRKELAAVGIALMDGPNGTTWRPSLPLSEEAVVAKT

SEQ ID NO: 561 - protein, 921 aa, Oryza sativa
MAAAAAAAAAKPNLLLPVSVAIPSSRVSLPTGLVCSARSPPPRLRAAAAAAAASQALTSPVAAETPEAKQMRVETEAALEWGGVCARLAGFASTAAGRAACGEGRVPVGRSREESERLLEQTAAAALLPAPLDFGGVEDVSAAIAAAAGARLLAVREICGVGRSIRAARRVFDQLKTLSEETPDGRSYTPLLDIMQDCDFLTELVQRIEFCLDYTLSVVLDRASDKLATIRKERRKNIDMLESLLRDTSTKIFQGGGIDSPVVTKRRSRMCVGVKASHKHLVPGGIVLSSSGSGATYFMEPRDAIRLNNMEVKLSGDERAEELAILGLLTSSIADSEMKIRHLMGKILELDLACARGSYALWINAVRPAFTDRDSDTQLNPNSECSVFIEGIQHPLLLEQSLSMVKESTRVGKGQLSDEHLVSPMPIPLDMQVRNDTRIIVISGPNTGGKTATMKTLGLASLMSKAGMFFPAKGTPRLPWFDQVLADIGDHQSLEHSLSTFSGHISRLRKIVQVVSKDSLVLIDEIGSGTDPSDGVALSTSILKYLASRLNLAIVTTHYADLSRLKAVDDRFENAAMEFCLETLQPTYQILWGSTGNSNALSIAKSIGFDQKVLARAQEWVEKLLPDKQKERQGLLYGSLLDERKLLESQANEAASVLSDVERLYNEIRSEADDLDSRVAALRATESEKVQQELKFVKSQMDQIIKNFESQLKNSELEQYNSLMRKAEAATASLAATHQPTDFTFGDEENESSYVPEIGDKVYVEGLGGGSMASVVETLGEDGSCMVQYGKIKVRVKGNKIKLVQRGTKDTSASSPVKGKGRTPKRSAAEANQDGNVSFGPVVQTSKNTVDLRGMRVAEASHELQMAIDGCRSYQVLFVVHGMGTGAVKECALGILRNHPRVAKFEDESPLNYGCTVAYIE

SEQ ID NO: 562 - protein, 494 aa, Solanum lycopersicum
MDYYTLVFVSILVLANIIAKICSKGSKKLPPGPSPWPIIGNLQLLGAKPHISLANLAKNYGPIMSLKLGQITTIVISSSTIAKQVLKTQDQAFSSRFAPNALQAHNHYKFSVAWLPVCPQWRTLRRILNTNLLSSNKLDANQHLRSQKVKQLIDYCDKCSQQGEALDIGQVVFKTSLNLLSNTLFSKDLADPFSDSKVELKEVIWGIMAEVGKPNLVDFFPILEKIDLQGIRRRAIIHFGKLFKLFDDLINERLEEKKRPGFMEKSDVLEIFLNITEKNPQEIDHNHIKSMFMDLFGAGTDTTTSTLEWAMAELLKQPEIIKKAQVELAEIIGKGKLIEEADVFRLPYLQCIIKETLRLHPPVPLLVPRKVDQDVELCDYIIPKGSQVLVNVWAIGRDFTFWKDPLEFKPERFLNLDLDMRGQDFELIPFGAGRRICPGLPLALRMIPVMLGSLLNSFNWKLDAGIEPQELDMEEKFGITLAKAHPLRAIPSPL

SEQ ID NO: 563 - protein, 366 aa, Hordeum vulgare
MSDVTAESTPRLRLPTPSPSLSQQQSRGRQPPPPGSDPLALGVVIFIAVCFLLVSISAPSSILHQVPEGHVGVYWRGGALLKTITTPGYHLKLPFITQFEPIQVTLQTDQVKGIPCGTKGGVMISFDKIEVVNRLNKDFVYDTLLNYGVHYDKTWIYDKIHHEINQFCSAHSLQQVYIDMFDQIDETMKEAIQRDCTRYAPGIEIISVRVTKPNIPVSIRRNFELMEEERTKALIAIERQKVAEKEAETQKKIALSEAEKNALVSKILMQQMLTEKDSSKRQQQIDNEMFLARERALADANYYRITKEAEANKLKLTPEYLELRFIESIANNTKIFFGEKIPTMIMDQRLIRNHLDSALSKDRLEI

SEQ ID NO: 564 - protein, 521 aa, Oryza sativa [sequence omitted]

SEQ ID NO: 565 - protein, 270 aa, Sorghum bicolor
MPLLLLPPAACTTAATAPASLAFSRPRSSRARWSSLSFAFPRLRKYGRRQREPVAAPSLDDDEDEEETGAGEWESDEGEEEMEVDEEEFLATRPKPAGFGEGKTYSTDIEEQLLREMGFGGGSERRRGEAAPASRRAGDSSTKVMAADASDDGVQVRVWNLPKKKNIHKDLKQAFKGFRGLLSIEPAVSANKKTRDPICKGFAYLKLESAEAATRFVEIYSHQTVSFGKVQKPISCCIVDKGSSVEPSKASSSQATPQPMLKHQKLVAAS

SEQ ID NO: 566 - protein, 121 aa, Sorghum bicolor
MWAPGSPGRLPALEECVEGEDGEAYHGAMASCWGRFGAAALWRRLRQRLSLVRRMRRRGRSSLLGAGGLNYDPLSYAQNFDDGCLELEEHEPDFSARFAPARHAAGFPRPTAAARDVVATA

SEQ ID NO: 567 - protein, 108 aa, Sorghum bicolor
MEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLS

SEQ ID NO: 568 - protein, 370 aa, Sorghum bicolor
MAMGRASAATLLVALAVLALAVMAQATCDDELPAQLAGNFSGLACAPVWNNFVLRYAQGKDNVLRVVLSTMYSTGWVGMGFSKNGLMVGSSAMVGWMGKTGVPHIKPFSLEGKTPSKVVADQGFLASSDHHKPTVLVQQAKIYLAFQLSFTEPLKSQNVLFAIGSAIPVNDHLSEHQDKTAIVFDFTTGSASSSSSFPDGLKRTHGALNLFAWGVLLPIGAIVARYCRRWDPLWFYLHAGIQFVGFILGLAGVVAGVSLYNKIQADVPAHRGLGIFVLVLGILQILAIFLRPNKDSKYRKFWNWYHHWVGRLALFFAAINIVLGIKVGGAGNSWKIGYGFNLAILLITIITLEVLLWTRWKNNSGSTGAY

SEQ ID NO: 569 - protein, 262 aa, Triticum aestivum
MTLLATVGQPHPPSKVISRREHSNRGHKLTREPTGQAKFKCNGCLEEITGCDRDTCKPCDFDLHQACNYKEGTTLEHQLLPKSKFVLRLEAPPSKQRCSACGTRTQGTHYHCARTGHYLHPCCAMLPMEIKLSDELSFELREKGSRRCAKCREGGGVRDYWFYCSNSNSKKVHLHVACAREDFLLPSSSSTESHSDVGGNGRASKETALRKYGSGKSGMNLGTIGDIVKALAGIVLAVLTGNPLPLISAGVDLLSSVAKLKK

SEQ ID NO: 570 - protein, 253 aa, Sorghum bicolor
MAMATSTFSPRPATLNKPLRPGAKPASLLPFPCRRAGRLVCATAAGEAPPVEVEQRDEAEPAPAAASNGAAVKAEAPAPKAVQAEAPPAPAPVPAFRDARWVNGTWDLTQFDKGGVVDWDAVIDAEARRRKWLEDYPEATSTDEAVVFDTSIIPWWAWMKRFHLPEAEKLNGRAAMVGFFMAYFVDSLTGVGLVDQMGNFFCKTLLFVAVAGVLLIRKNEDIESLKKLIDESTFYDKQWLATWQDDSTGGPKN

SEQ ID NO: 571 - protein, 233 aa, Triticum aestivum
MEDFVLSYVVTGLAFWSTAFLVMRALMPKRSYEFCNRAVSTMHAVAAVCMACLSVQEWSCPVCPLNAPSSPRQMKSLAVTLSYMIYDAACCHLNGDVRLDNTVHHLVSIVGIGAGLAYQRCGTEMMACMFITEISSPLLHLREMLKELGVKDTDLNLLVDILFAATFSVGRMVGGPYLTYVTLTTDYPILIKAMAAGLQLVSAYWFLRILRMVRYKLGKKRPAAAAATKLNAK

SEQ ID NO: 572 - protein, 321 aa, Sorghum bicolor
MGQSQGRGRTKPETRHATREGEEEEEQHQQRGDIARPDATAEEKGQSRPPGVPATTMDTFFLSHGSPTLSIDDKIPARHFFKSWVPAKVAGDQAPRAILVVSGHWETATPAVNVIRGSNDTIYDFYGFPKPMYQLKYPAPGAPDLALRTKELLEQAGFGPVKEDHSRGLDHGAWVPLMLMYPDANIPVCQLSVQSDRDGTYHYNLGKALAPLREEGILIVGSGSATHNLRKMGPFDAPVPRWVAEFDTWLKDSLLGGRYEDVNRYEEKAPHGRAAHPWPDHFYPLHVALGAAGDAAKAEQIHHCWTNATLSYASYRFTTNS

SEQ ID NO: 573 - protein, 146 aa, Solanum lycopersicum
MGLKAFILLTLVLAIFAIVTSHVAARELAESSTTTMENTKENEVNDAKYPGGGYGGYPGGGRGGYGGYPGGGRGRGGYGGYPGGGRGRGGYGGYPGGGRGRGRGGYGGGYCSYGCCERNYYGNGCNRCCYSKSEAMNKVTQAKPHN

SEQ ID NO: 574 - protein, 632 aa, Hordeum vulgare
MQHLTLAASLSAAVLFACILYAESADLNSDKQALLAFAASLPHGRKLNWSSTTPVCTSWVGVTCTPDNSRVHTLRLPAVGLFGPIPSDTLGKLDALEVLSLRSNRLTVDLPPDVGSIPSLHSLYLQHNTLSGIIPTTLSPSLTFLDLSYNTFDGEIPLRVQNLTGLTAILLQNNSLSGPIPHLRLPKLRHLNMSNNNLSGPIPPSLQKFPASSFLGNAFLCGLPLEPCPGTAPSPSPTPSVPSKPKKSFWKRIRTGVLIAIAAAGGVLLLLLILVLLICIFKRKKHTEPTTASSSKGKAVAGGRTDTPKEDYSSSVQEAERNKLVFFEGSSYNFDLEDLLRASAEVLGKGSFGTTYKAVLEDSTTVVVKRLKEMVVGKKDFEQQMEIVGRIGQHQNIVPLRAYYYSKDEKLLVYDYVPAGSLAAVLHGNKATGRAALDWETRVKISLGVARGLAHLHAEGSGKFIHGNLKSSNILLSQNLDGCVSEFGLAQLMTTLPAPARLIGYRAPEVLETKKPTQKSDVYSFGVLLLEMLTGKAPLRSPGREDSIEHLPRWVQSVVREELTAEVFDVDLLRHPNIEDEMVQLLQVAMACVAVAPDQRPRMDEVIRRIAEIRNSDSGPATPPEEAAAQAP

SEQ ID NO: 575 - protein, 56 aa, Hordeum vulgare
MFLGAVPRKPSKEAAYKELRSHLYIMAGCIAAIRAAPYILHFLNREPGMTELKLEL

SEQ ID NO: 576 - protein, 456 aa, Hordeum vulgare
MVKAPLHSSSSAAAAAATFSLVAKKARLSPFILLSLLFMLLFSFLYGEELAALIGQRAGRRSADLDVDVNREHQQPAGVEDGWKRKKKRWQGRLAFAVNDEDEDEECDVFSGSWVRDEEAHPLYREEECPYIQPQLTCQAQGRPDRGYQSWRWQPHDCTLPFNPTQMLETLRGKRMMFVGDSLNRGQFTSMVCLLQSAIPSPEAKSFEVSPDQQHTVFTAREYNATVEFYWAPFLPQSNADDAVVHKISDRMVRNGSIAHHGRHWEGVDVLVFNTYLWWCTGLRFRVMNGPIGDAREEDAAWVSTEEAYGMAFRDMLQWVRDNMDFNSTRVFFTSMSPTHGKSQDWGDAQGGNCYNETAMIEDAEYWGTDARRSVMRVIREILDGDGADVPLTFLNVTQLSMYRKDAHTSIYKKQWNPLTPEQVADPRTYADCVHWCLPGLQDTWNELLYSKLFYP

SEQ ID NO: 577 - protein, 253 aa, Triticum aestivum
MTSVAAAVALLRLPLAHLSSHLRSLPSRPVPSARLRLSAPHRPLCSLLTSGHGLAVAAVSEAVVAADEEEFEATEEQQEEAPPSFVLPRLPRPKLDVKERKELASYAHGLGKKLKSQQVGKGGVTPNLVTAFTDNLESNELLKLKIHGNCPGELPDVIRQLEESTGSIAVDQIGRSVILYRPSSSKMKKREEVARNREEYARNNPRFGKSENAFEERPRNNSAGRRFVKSGSTFRTQQKRRPVASKGSSYSRG

SEQ ID NO: 578 - protein, 258 aa, Solanum lycopersicum
MRTIMSKNQHESFSFSRRYFNFKKKVEDEEYDDEVYLNTFHSSSLRGSEEEYFGMHSLSGTATNASTVSKKLSRSTVSKLRSALTFGKSRTQIGLGTKVIGTLFGYRRGHVHFAFQEDPKLGPAFFVEMATPTSHLVREMASGLVRIALESDKRTGKKGVKLLEEPNWRTYCNGRKCGYAMKRECGPDEWKILNSIGPVSMGAGVLPSDGDGIGLEGELMYMRAKFERVVGSKDSEAFYMMNPDGHGGPELSLYLLRV

SEQ ID NO: 579 - protein, 216 aa, Gossypium hirsutum
MAGGSKSNPPKPRKRVDAASAPAPTPATASSLVRAKDGSAFAKCDECNKTVPMALINMHSCSLEAKIKMNLESQVIEKPAEAKKKPAERKKPPATTESNPKKPKKLKKGKDPNAPKRPPTAFFLFMDDFRKSYKEANPDAKGVTGVAKEGGEKWKSMSEEEKKCYVDKAAELKAEYEKAMEEAKNADHQNEEEEGGSDKETPAAEKATEEEVLDDY

SEQ ID NO: 580 - protein, 261 aa, Solanum lycopersicum
MSSVMLSSSSSSMALHRLLRPAPILSFSFLKQSLSLLPHQTTSLHPIINNSLSSFPSLRTHTSIFLRSRTFSNLPISCTSQALLESSEDVEDEEIVKQNEEVTAPRPSESERKILRAKLPNLTVKEKKELASYAHSLGKKLKSQQVGKSGVTDTVVMALEETLEANELLKLKIHGTCPGGELDDVVKHLEEATGSVVVGQIGRTVILYRPSLTKMKAEEKKKQAQILFLKKQKQYAERRSFQDKGPVPRSYARNRRGSSRV

SEQ ID NO: 581 - protein, 284 aa, Triticum aestivum
MVYGGEEALRRQYSIGDEIGHGRFGTVRRCHSNATGEALALKTTPKAPLRDALDLALAEQEPKLHLLASSPPCSPHLVALHAAFDDADAVHLVVDLCAGGDLLSLLSARGGRLPEREAAGLAAQLASALAACHRRGVAHRDVKPDNLLFDAATGALKLADFGSAEWFGDGRRMSGIVGTPYYVAPEVVAGREYGEKVDVWSAGVVLYMTLSGSVPFYGATAPEIFEAVLRGNVRFPPRAFAGVSPEAKDLMRRMLCKDVSRRFSAEQVLRHPWIASCGGDAVAG

SEQ ID NO: 582 - protein, 253 aa, Sorghum bicolor
MAAEEQTPCTKPRPDKAKKRKKPKKDKWGQPIATAEEPSVEPEQEHPAGEVEAVVQVDKEEEEATAAAEGYEFGKVVASGMPYTTTEADIRKLFEFYGPLQSVQLSRFPDSGNFRGLAFICFETNEDAIKSLELDGFKIGSRYMRVERCRVTATSNKKRKAEFQTDPKKSEGCLSAYVGNLSWNVTEKDLRDFFRSSKIASVRFAIDKRTGGSRGFCHVDFQDDESLEKAVAMNQSELQGRPVKVAYSVSNRG

SEQ ID NO: 583 - protein, 343 aa, Brassica juncea
MAPTLQGEWIKVQQKGGEGPGARSSHGIAVVGDKLYSFGGERTPNISIDKHLYVFDFNTHTWSIAPANGQAPNVQALGTRMVAVGTMLYLFGGRDEKKQFDDFYSYDTVKQEWKFITKLDEEGGPEARTYHSMASDENHVYLFGGVSKTGRIKTPFRFRTIEAYNIADGKWAQLPDPGEQFPRFERRGGAGFIVVEGKIWVVYGFATSPDPNGKNDYESDLVHYFDPATQKWTEVETKGEKPSPRSVFAHAAVGKYIIIFGGEVWPDPNGHLGPGTLTNEGYALNTETLVWEKFGGGAEPGELGWPAYTTATVYGKQGLLMHGGKRPTNKRTDEMYFYAVHSA

SEQ ID NO: 584 - protein, 365 aa, Triticum aestivum
RPRVRYHWDLPQALEDKYNGWLDRQIVDDFAEYAETCFAAFGDRVKHWITVNEPHTVAIQGYDAGLQAPGRCSVLLHLYCKSGNSGTEPYIVAHNFILAHAAVSQLYRTKYKAAQNGELGMAFDVMWYEPMSGAAIDVEATKRAQEFQLGWFADPFFFGDYPATMRKRVGERLPRFTAEEAALVKGALDFVGINHYTTYYTRHNDTDIIVRLLNDTLADTGTISLPFKNGRAIGDRANSIWLYIVPRGMRSLMNYVKNRYNSPPIYITENGMDDSNSPFIALKDALKDTKRIKYHNDYLTNLAASIKEDGCDVRGYFAWSLLDNWEWAAGYTSRFGLYFVDYNDKLKRYPKSSVQWFKSLLRPSY

SEQ ID NO: 585 - protein, 374 aa, Solanum lycopersicum
MAHSAISQVSVAVPLQTDSSFRRSTFKATSLTFSDKSCISMPSIDLKATRSRSQYIVCMSVQHASKAKVSVSPLSLENATEPPLNIYKPKEPYTATIVSVERIVGPKAPGETCHIVIDHDGNLPYWEGQSYGVVPPGENPKKPGSPHNVRLYSIASTRYGDSFDGKTASLCVRRAVYYDPETGKEDPSKNGVCSNFLCNAKPGDKVKITGPSGKIMLLPENNPNATHIMIGTGTGVAPFRGYLRRMFMESVPMKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAEERGESWEQKLSQLKKNKQWHVEVY

SEQ ID NO: 586 - protein, 164 aa, Unknown
  Sequence found in Organisms: Sorghum bicolor, Triticum aestivum
MSRPNRSDAHLSAEDEATLEAEVRGYYDDAAPKRHTKPSRSEHSAVYADALVPDAGGNTPPELDKFQELEAHTERLVYDGGNVGEEFVETEYYKDLGGVGKQHHTTGTGFIKIDKAKGASFKLSEDPSAEERHASCKGNPATNEWIPSADTVYPASDKPSRSDS

SEQ ID NO: 587 - protein, 431 aa, Sorghum bicolor
MDSTKGTAVARLCDDLMVDILSRLPVKDLRRSTCVSKPWRDLVTDPLHRKKLPQTLEGFFHGGAGERHSYGHFTSLSGRGESAPPVDPSFSFLTAKLPWVERMDLLDSCNGLLLFGCTTENKFGYIVCNPATEELVTIPASSGSCPPPSLTPLEDKTIAVCDGDIYAHTYLMFDPIVSSRFHLVQFWQDRSTCEVKKVHSYSSETRAWSDTSNKWEPGEERCGWGVLRGRGEAIIEFTRGRALVDGLLLYIEAVLLFMRGRAWVNGLLHFVAYHFEEGENLIVAVDGEGTICRIICPPVKHVDANAFIGQSQGHLHCISTNLISQYFNYHFTQLSIWVLEDYDTQEWILKHNVSFPQLFGSPSCPIDNHDIVVIHPDHNSIILVQHWNQKLVSYDMDSKEHRVLCTLGEGYRSITPYVPYFMESPVLATKD

SEQ ID NO: 588 - protein, 225 aa, Sorghum bicolor
MAASLPTTAAAARLAAQAFAFPSLKPPSASAFSALPRAAAFPSFAVAAAAPPRPRPARPTAARAAGDERETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPAASRKPRQQAPQTESASS

SEQ ID NO: 589 - protein, 250 aa, Sorghum bicolor
MAELQQLQQVASDDAAEWKQVAELRAVTQAQDPSCKEEDDYTLRRFLRARDHNIGKASAMLLKYLKWKPTAKPHGGEIPASEVAREVAQAKLCLQGYDREGRPLIYGFGARHHPARRDMEEFKRYVVHVLDATVARLPPPGPGRQEKFAAVADLKGWGYANCDIRGYLAALDIMQSYYPERLGRVFLIHVPYVFMAAWKIVYPFIDDNTKKKFVFVADKDLDRTLREAIDDSQLAEIYGGKLKLVAPPAN

SEQ ID NO: 590 - protein, 253 aa, Arabidopsis thaliana
MANLPTVLVTGASGRTGQIVYKKLKEGSDKFVAKGLVRSAQGKEKIGGEADVFIGDITDADSINPAFQGIDALVILTSAVPKMKPGFDPTKGGRPEFIFEDGQYPEQVDWIGQKNQIDAAKVAGVKHIVVVGSMGGTNPDHPLNKLGNGNILVWKRKAEQYLADSGTPYTIIRAGGLLDKEGGVRELLVGKDDELLQTDTKTVPRADVAEVCIQALLFEEAKNKAFDLGSKPEGTSTPTKDFKALFSQVTSRF

SEQ ID NO: 591 - protein, 231 aa, Hordeum vulgare
MEDYGGVASLVASGVVFWSTAFLLLRALLPKRSYDFCNRAVSTMHAVTGVALGCLSVQDWASPVSPVASPSSPRQMRALAVTLSYMIYDGACCHLSGDARLDNALHHLISIVGLAAGLAYQRCGTELVACLLVTEISSPLLHLREMLKEVGVKDTDLNLLVDILFAVTFSVARMVCGTYVTYRTVTADNPILIKAMATSLLLVSAYWFLRILRMVRHKIGKKRLASKAAGK

SEQ ID NO: 592 - protein, 329 aa, Oryza sativa
MSPRREQAEEQQQQGWREEAVSGASLRQVDLERGANGWASPPGDLFHLRARGYFSGGGGGGGGGGGGGRRGKAPSAAEWLLRPAGVDWLRSHSRLDHVLARDDIPVAAAFRRARLRKDPSAHFLLAVNLQVPGRPDAYSAVFYFAAEAAIPAESLLGRFVHGDDAYRNARFKIVNRIVKGPWLVRATVGNYAACLLGRALTCRYHGGDGYLEIDVDIGSSAIASAILHLALGAVTSVTIDMGFLVESQSEEELPERLFGAVRIAQMEMGAAKYVETAPDDVVPDAGRAGAGFRVHSAKVANDSRHQERAAGKVGRSMSCQERGSGGGGK

SEQ ID NO: 593 - protein, 252 aa, Oryza sativa
MAAEEQTPRTKPSTGNSKKRKKPRKDKWGQPIIDAGDRPAVEPEPEPEPEPVPAPAAAAAAEEEEEAGIYETGKVVASGLPYTTTEAEIRELFERFGPLRSLQLSRFPDSGNFRGLAFVSFESNEVVMKSLELDGFKIGNRFMRVERCRLAAGSKRKRTVEFQTDPKKADGCLSAYVGNLKWDVTETDLRDFFKSLKISSIRFAINKRTGDSRGFCHVDFEDDESLEKAVGMNQSELRGRPIKISYAVSNRG

SEQ ID NO: 594 - protein, 266 aa, Solanum lycopersicum
MGGDHKEKTTVMVLKVDLQCPCCYKKAKKILCKMPQVRDQMYDEKANTITILVVCCSPERIRDKLCCKGGKAIKSIEIKEPLKLKAPEKPKEPEKPKEKPEKPKEPEKKPKVVTFETPKEPEKPKEKAKEPEKLKDKAKEPEKPKGQEKPTVIDKPKDKTKDPEKPKDGPTSAMVATPWISEPIMMMPPVHGYPQVMPSCGCGQCHYTGGPCYQYYGTPVPPQPAPYYGNYSYGYGPGPGPSSYGKGYYGNNDYYNEEDGQGCTIM

SEQ ID NO: 595 - protein, 284 aa, Solanum lycopersicum
MIDNIDDIINWDDVDHIFHNVLDNPDDDQFTLHDSSPQSFQQIEQLLMNDDDFGLVSDPQFAAESLSDFLVDSPLHSDHSHSPAEQAIGFSDPKVSSADQDKHKVSQSPSDGDDELNNHDPVDKKRKRQLRNRDAAVRSRERKKLYVRDLELKSRYFESECKRLGFVLQCCLAENQALRFSLHNSSANGVSMTKQESAVLFLESLLLGSLLWFLGITCLLILPSQTWSVPEESQGSRNHGLLVPIKEGKKTSRILLFLSFMMSKRCKASRSRMKLNPHPLGVVM

SEQ ID NO: 596 - protein, 352 aa, Sorghum bicolor
MRHASPPQELPAAAAGGEIQAALSPATASSSAARARGGGGGGGGSFTALLGLPTSQAMELLLPRTAPPPALAPSPAPAAAAPAPTFPSDPHLVDRAARFSTFAPPSPSPSSPSPAPPPPPPPAAANAGKRKAEPVDRASKGKAAKKGKTAAAEEKPTGGDGDGDDEKPAYVHVRARRGQATDSHSLAERARREKINARMELLKELVPGCSKVSGTALVLDEIINHVQSLQRQVEYLSMRLAAVNPRVDFGGLDSFLTTECGRIAGFNCKNGIDLEQVTWPEMGVHGTRQLMQLQQHFWHGDLAHPHQVASQWEKRGDGHPPVFGNPSPSLFGYDLTSSGTQQTPASKLKTEL

SEQ ID NO: 597 - protein, 371 aa, Sorghum bicolor
MEAARSYFFVAAVAVVLIALLPASAIAAGLKVGFYNKSCPSAEALVQQAVAAAFKNDSGIAAGLIRLHFHDCFVRGCDGSVLIDSTANNTAEKDAPPNNPSLRGFEVIDAAKAAIEAQCPKTVSCADILAFAARDSVALSSSSASGSGKNLTYKVPAGRRDGRVSRDTDANSNLPSPLSTAAELVGNFTRKNLTAEDMVVLSGAHTVGRSHCSSFTNRLYGFSNGSDVDPAISSAYAFLLRSICPSNTTRFFPPNTTTDMDLITPAVLDNKYYVGLTNNLGLFTSDQALLTNATLKKSVDEFVKSDSKWKSKFAKSMVKMGNIEVLTGTQGEIRLSCRVINNGAGSSSSSAGLFELQMTTDNSAQEESAAN

SEQ ID NO: 598 - protein, 382 aa, Sorghum bicolor
MPAFAGSAAEPPLADSYYALLRRRGGGGNNDDEEASGGAYYYDTTSSTVPSSDDDVAECELPMIDVGCLTTLTRSEHGSSSEAERAACTAAIARAAEEWGFFQVRNHGVSQELLDEMRREQARLFRLPFEAKATAGLLNHSYRWGTPTATSPQQLSWSEAFHVPLAGVSGSAAAGTCDFGDLTTLRDVTREVAGAMSKLAGTLARVLAEEARPRPCLPAGGGGGGGGERFPEGCDETTCFLRLNRYPPCPIAADAFGLVPHTDSDFLTVLCQDQQVGGLQLMKGGRWVAVKPIPGALIVNIGDLFQAWSNNRYKSVEHKVMTNAKTERYSVAYFLCPSYDSPIGTCEEPSLYRTFTFGEYRRKVQEDVKRTGKKVGLPNFLV

SEQ ID NO: 599 - protein, 1005 aa, Sorghum bicolor
MKSLFKSKIRWQHRSTDPASPAGQQASGPPSPSPASSPSGTAPAPALSVSTAVSSSPPSAAATPTGAAAAAAAAAPAPAGAGAGAGGEDYISSEEEFQMQLAMALSASSNGDFVGDLDGEQIRKAKLMSLDRFAAHRDEGHTAELLSRRYWDYNFLDYHEKVIDGFYDIFGSSMESSRQGKMPSLADLQTGIGDLGFEVIVVNRAIDSTLQEMEQVAQCILLDFPVANIALLVQRIAELVTDNMGGPVKDANDMLTRWLEKSTELRTSLQTSLLPIGCIKIGLSRHRALLFKILADSVGIPCKLVKGSNYTGGDDDDAINIIKMDNEREFLVDLMAAPGALIPADILSWKGNSLNSNRKLALNQTVGSSSTVDSNMDPTVLPLEPKGGQLPLFSSGDWISDSGSGYEAAETAGSTQTSSGATSSVPAGNVFDSSWLLVNHDQSDGPSTSAGTSSQQKVVPQSEHQQNLNRLPDLQEIPESKNLFADLNPFGDMKSKKKSVPFKGPDHRNNELQKRRENVVPNAGRPQQRLVMKNWSPYNDVSNNKQYNYVEDSFARRNVGNNAASSSSQMPRPASRSNLNSGLRNDASYHNYDSIMAGTSAMKITSTAETGKVPERVLRGDLDKGQTNYRLEDQHVVVQPPQERLPWGNPAEGRFPMNRVQSPAKQHIENMDVKQDHKKMLPDPKKSPLDRFMDTSLPSRNMDMRSQRLDFDDVSECEIPWEDLVIGERIGLGSYGEVYRADWNGTEVAVKKFLDQDFYGDALDEFRSEVRIMRRLRHPNIVLFMGAVTRPPNLSIVSEYLPRGSLYKILHRPNCLIDEKRRIKMALDVAKGMNCLHTSVPTIVHRDLKSPNLLVDNNWNVKVCDFGLSRLKHSTFLSSKSTAGTPEWMAPEVLRNEQSNEKCDVYSFGVILWELATLRMPWSGMNPMQVVGAVGFQDRRLDIPKEVDPLVARIIFECWQKDPNLRPSFAQLTSALKTVQRLVTPSHQETQSPHVHQEISVNLTP

SEQ ID NO: 600 - protein, 318 aa, Hordeum vulgare
MAGKEDSRIFVGGLSFHTDERKLEDAFRRFGKVVETQIMLERHTNRHRGFGFVTFSDPRAVETAINDMHNKELDGRTISVNRAEPKLQTDDTRYSGGGGGGDRGDYRGGKGDGPPPGNCFECGRAGHWARDCPNPGGGRSGRFPSKFSGGGGRGDRFSGSDRFGDRYVDDRYDSGRYGGYREPIDSRDRYDGGRDRYASDRYPSGGDRYGTDRYGAAPDRYAPSGGGGGYGRERERSYERDTVRGGAYDRSGPRGGASYDRDGPRGGIGGGYDRDGPRGGGADYGSGGPTRYEGGGYRERPAPYDRPSRGGGRFDDRY

SEQ ID NO: 601 - protein, 356 aa, Hordeum vulgare
MASYDQQFKVLEVPPIVQELVGAGVKEPPSQYVLPEQDRPAAAAVSEMPEPIPIIDLSRLSAGSPEEFAKLRSALENWNLFLAVGHGMEPSFLAEAMKATREFFNLPLEEKQKYSNIVNGEKMGMDGYGNDMVVKENQVLDWNDRLNLLVEPESLRTYRLWPTQPPSFRDILCEYTVRCKAAANLVFRNMAKMLNLQEDHLVNMIGNNSITQAIFNYYPQCPRPDHVLGLKAHTDGSIITVNFADAEGLQLERNGVWYNVPIVPNALVMNIGDIMEILSNGFFKSLVHRVVTNAEKERLSLVLVYTLELETQLEPVSELVDDKRPARYMKIKLNDYMEKYHDTYATGTLAIDGVKI

SEQ ID NO: 602 - protein, 604 aa, Hordeum vulgare
LSLSFNHVNYYGDMPAEMREQGFAESRLQLLSDISGAFRPGVLTALVGVSGAGKTTLMDVLAGRKTSGSIEGSITLSGYPKKQETFARISGYCEQTDIHSPNVTVYESILYSAWLRLSSDVDEKTRKLFVEEVMTLVELDVLRNAMVGLPGVDGLSTEQRKRLTIAVELVANPSIIFMDEPTSGLDARAAAIVMRAVRNTVNTGRTVVCTIHQPSIDIFESFDELLLMKRGGQVIYAGELGHHSYKLVEYFEAIPGVEKITEGYNPATWMLEVSSPLAEARLNVNFAEIYANSELYRKNQQLIKELSVPPPGYEDLSFPTKYSQNFYNQCIANFWKQYKSYWKNPPHNAMRFLMTLINGLVFGTVFWQKGTKIGSQQDLFNLLGATYAAVFFLGASNSITVQPVVSIERTVFYREKAAGMYSPLSYAFAQTCVEVIYNVVQGIEYTVIIYAMIGYEWEAAKFFYFLFFIVASFNYFTLFGMMLVALTPSSMLANILISFVLPLWNLFAGFLVVRPLIPIWWRWYYWANPVSWTIYGVVASQFGDDKSPLEVPGGIDTFVNQYLEDNLGIKHDFLGYVVLAHFAFIIAFFFVFGYSIKVLNFQKR

SEQ ID NO: 603 - protein, 637 aa, Hordeum vulgare
MAITGGPRGRLLLLLFLAAACLVCAPARAFYLPGVAPRDFQKDDDLQVKVNKLSSIKTQLPYDYYFLDYCKPEAIKNSAENLGEVLRGDRIENSVYNFKMRRDESCKVVCRTKLSAEAAKNFREKIDDEYRVNMILDNLPVVVPRQAREGSPTPNFDHGYRVGYKLKDDKYYINNHLSFKVLYHEDLNSPEARIVGFHVIPSSIKHEYGAWDDKNPTVQTCNANTKITPGSHTPQEVAPDAYVVFSYDVTFEASEIIWASRWDVYLLSSDSQIHWFSIINSLMIVLFLSGMIAMIMMRTLYKDIANYNQLDNQEEAQEETGWKLVHGDAFRPPVHSGLLCVYVGTGVQFFGMTVVTMMFALLGFLSPANRGGLMTAMVLLWVFMGVLAGYTSSRLYKMFKGTEWKKITLKTAFMFPGIIFGVFFVLNALIWGEKSSGAVPFGTMFALVLLWFGISVPLVFVGSFLGFKQPAIEDPVKTNKIPRQIPEQAWYLQPAFSILAGGILPFGAVFIELFFILTSIWLNQFYYIFGFLFIVFVILLVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 604 - protein, 303 aa, Sorghum bicolor
MAMAMATAKLVLLMVLVAGSSCGGSAWRGPLSLLRTLPTTTAAQSVEAAAERLKEDLSSAASSASASSSLIHALRPLMGSAGDLGLRAGVPCDSWRLAVETYNKRDWTTVPGSCEGYVGHYMLGGHYRRDSRVVVDEAIAYAEGLKLAGNGKEVWVFDIDETSLSNLPYYATHGFGTKPYNATSFNEYVLEGSAPVLPESQRLFKKLISLGIKPVFLTGRTEDQRAITVTNLRRQGYSGWMDLLLKPVGLKATAIAYKSGERQKLQDAGYVIVGNIGDQWSDILGAPEGARTFKLPDPLYYIG

SEQ ID NO: 605 - protein, 259 aa, Sorghum bicolor
QVYQPTEEEIRRWLDPYENVVCIECNQGGDDSLMLLCDICDSSAHTYCVGLGREVPEGNWYCGGCRLGDEGPSYTGIQRTVAYERQTYRNHVDSSSVSFGMLASSGTFERPPSINPRHSFQGIDLNLSPREFPGESHPAESQVSTDSVSTPTGRRTVSARRQIHRYIRILLARPRQPSRPDVFHNIAQHSGGVPRTEPNRQNFPSSSEANTSHNLPDGIQNHHGSLPFVQAQNNFAPFMSLDGDDFQQIEGVKSNLRNM

SEQ ID NO: 606 - protein, 246 aa, Solanum lycopersicum
MGVVHTLHFVFGIFGNATALFLFLAPIITFKRVIQNRSTEQFSGLPYVMTLLNCLLSAWYGLPFVSPNNLLVSTINGTGAVIETIYVLIFIAFAPTKEKKKISALFLLVLTVFAAVALVSMLGLHGSKRKLFCGIAATIFSIIMYGSPLSIIRLVIKTKSVEFMPFFLSLFVFLCGASWFAFGLLGKDPFVAIPNGFGFGLGTVQLILYAIYCEKKGFTRKSNLDESNGKSHQEEKQSSKSRLEQV

SEQ ID NO: 607 - protein, 517 aa, Brachypodium distachyon
MAPFPVSPPSSGGGKQAGAVIGSPRSSLQRSSSECNVVVQRNIKSSLLLLLAISAVFAFSILYSSRNLTVATMAGEAVTQGPLLAALDMGRMVHDDEAVDGPAGPDTDVNEQRGGPADDVSLPAANDPSAAAVVAPAPSTADQTAGLSMQLEEKCDISMGKWVKEPKGPVYTNLTCPMLPDYKNCQKYGKDTGHLYWRWQPDGCDLPRFSPARFLDVVRGKRLAFIGDSLARNQMDSLLCLLSQAETPAEVYSDALDKFGTWHFPAHNFTLTVMWTEFYAHAEPVLDSSGKPTASFHIHLDRLGADWTSRLRDLDYAVISGGNWFFRVNYLWEGGRLVGCLNCGGKGNLTQFGVADAVRRVVRAAIEGIAKCKDCKSGLVTILRTYSPDHFEHGSWFSGGYCNRTQPLEEREVSFESVGWELRKVQREEVRRAMRKENLASGAGKRYFGVMDVTKAMMMRADGHPDRHYDKRWVRNGSDCLHWCLPGPVDMWNGVLLQRLAEIDPAPLPIDRGEVVN

SEQ ID NO: 608 - protein, 225 aa, Gossypium hirsutum
MSLTIPTNLSKSILKPKLETQVIPKASSRSLIVCSSSNPSSSDKSASPLQAFSAALALSSILLSAPLPAVADIAGLTPCKESKQFAKREKQQIKKLESSLKLYAPDSAPALAIKATIEKTKRRFDNYGKYGLLCGSDGLPHLIVSGDQRHWGEFITPGLLFLYIAGWIGWVGRSYLIAISDDKKPAMKEIIIDVPLATGLIFRGFIWPVAAYRELINGDLVVKDV

SEQ ID NO: 609 - protein, 483 aa, Glycine max
MDSPLLENIDNSCSNVEEEKTPNTVVKRFGFESKKLWKIAGPAIVTSICQYSLGALTQTFAGLVGDLDLAAVSVENSVIAGLAFGVMLGMGSALETLCGQAYGAGQIRMLGVYMQRSWVILFITALILLPLYIWSPPILRLAGQTAEISDAAGKFAVWMIPQLFAYAINFPIVKFLQAQRKVLVMLWISVVVLVLHTFFSWLVIFKLGWGLIGAAVTLNTSWWVIVIAQLLYIFITKSDGAWSGFTWLAFSDLFGFVKLSLASAVMLCLEFWYLMILVVITGRLENPLIPVDAISICMNINGWDAMIAIGFNAAISVRVSNELGAGDFKAAKFSVWVVSITSVSIGVVVMIGVLLTKDYFPYLFTTSVPVANETTRLSALLAVTVLLNSLQPVLSGVAVGAGWQSLVAYINIVCYYLVGLPAGIILGFKLGLGAEGIWSGMIAGIVLQTTILIIVTSIRNWKKEAEEAESRVRKWGGAISYDQ

SEQ ID NO: 610 - protein, 344 aa, Glycine max
MWESIVLTVVATAGNNIGKILQKKGTVILPPLSFKLKVIRAYALNKTWVIGFLMDIFGALLMLRALALAPVSVIQPVSGCGLAILSVFSHFYLKEVMNVVDWVGITLAGFGTIGVGAGGEEQEAAALSIFHIPWLAFVVFILFIMLNGWLRIFKRNRREQEMMEYDVVEEIIYGLESGILFGMASVISKMGFLFLEQGFPKLLVPICIIISVCSSGTGFYYQTRGLKHGRAIVVSTCAAVASILTGVLAGMLALGERLPSAPKARFLLLLGWLLIIVGVILLVGSTKLVRFFRFSSHHFKRSSVDKNYGPRRSGTSRVREPSPTAVIQAATLNHLLSSSSKEKA

SEQ ID NO: 611 - protein, 123 aa, Hordeum vulgare
MGARQRGERGGMPTTTTRSRLADASSWCLALSALAALLLVCSLGETTEAVTVRGASLSARWRPCEEIYVVAEGETLHGISDRCGDPYILERNPHVHDPDDVFPGLVLRITPSNPRPSVPASPP

SEQ ID NO: 612 - protein, 277 aa, Hordeum vulgare
MATTTCLLAAWALVAAGLFGTGLARASFAPAAVGKEQREFDYFALALQWPGTICSSTRHCCAVNGCCRKEPLHTFTIHGLWPDYDDGTWPSCCRHTSFDMDKITPLKPTLDKYWPSLYCSSSSTCFSGRGPFWAHEWEKHGTCSAPAVREELQYFSTALDLYFKYNVTEMLATGDILVSNGKEYALSDVIDTIKHAFGGSPQIICKKGSVQELRLCFTKDLKPRDCLTTSAMYKNLSKSKHCPRKISLPTYDPIVLANSTLEIVPEASDNGLYFFTS

SEQ ID NO: 613 - protein, 276 aa, Gossypium hirsutum
MGKGPGLYSDIGKKARDLLYKDYQADHKFTVTTYTSNGVAITSTGTKKGELLLADVNTQLKNKNITTDVKFDSRSNLFTTVTIDEPAPGLKTIFSFVVPDQKSGKVELQYRHEYAGISTGIGLTAKPLVSFSGVIGNDSVSVGTDLSFDTASGNFIKLNAGLNITHSDLIASMTLNDKGDTLTASYYHIVSPLTNTAVGAELTHSFSSNENTLTIGTQHALDPLTTVKARMNNYGRASALIQHEWRPKSLFTISGEVDTRAIEKSAKVGLALALKP

SEQ ID NO: 614 - protein, 359 aa, Gossypium hirsutum
MALETPNHTQTVAGWAAYDSSGKIAPYIFKRRENGVNDVTIQVMYCGVCHTDLHHVKDDWGITMYPVVPGHEITGVITKVGSDVKNFKLGDRVGVGCLAASCLECEFCKNSQENYCDQIQFTYNGIFWDGTITYGGYSEMLVADHRYVVHVPDNLPMDAAAPLLCAGITVFSPMKDCQLLESPGKKVGIVGLGGLGHVAVKMAKAFGHQVTVISTSPSKENEAKQRLGADYFLVSTDAKQMQRGKRTLDVILDTVSAKHSLGPILELLKVNGTLVVVGAPDRPIELPSFPLIFGKRAVKGSMTGGMKETQEMMDVCGKHNITCDVELIKPDKINQALDRLARNDVRYRFVIDIAGTSKL

SEQ ID NO: 615 - protein, 360 aa, Solanum lycopersicum
MAQTTPNHTQTVSGWAAHDSSGKITPFIFKRRENGENDVTIEILYCGMCHTDIHHVKDDWGITKYPVVPGHEITGIITKVGRNVSKFKIGDRVGVGCLAATCLKCEYCKGSQENYCDQVEFTYNGIFWDGSITYGGYSKMLVADHRYVVCIPDNMAMDRAAPLLCAGITVFTPFKDNNLVDTKGKKIGIIGLGGLGHVAVKFGKAFGHHVTVISTSPSKEQEAKHNLGADDFIISTNPKQMMEKKRTLDFILDTVSAKHSLGSYLELLKVNGTLVIVGAPDKPIDLPAFPMIFGKRTVKGSMIGSIEETQEMMDLCGKHNILSDIEIITTDQINEGLERLANNDVKYRFVIDIAGPSSHL

SEQ ID NO: 616 - protein, 926 aa, Sorghum bicolor
MGAAQLVILFLALGAAMRAASAAGARPSEVTVGALFTYDSTIGRAAQLAIELAVDDVNADGKVLPGTQLNLVPQDTNCSGFIGTIEALRLMEKSVVAVIGPQSSGIGHVISHVVNELHVPLLSFAATDPTLSASEYPYFIRTTISDYFQMNAVASIVDYYQWKRVTAIFVDDDYGRGGMEALGDALALKRAKISYKAAIPPNSNTDVINDVLFRANMMESRVMVVHVNPDTGMRIFSVAKNLQMMASGYVWIVTDWLAAVLDSSAYRDLKDMGHIQGLIVLRQHIPESEAKDKFISKWNDVARNRSITSGLNSYGFYAYDSVWAVARAVDKFLSSGQQINFSTDPRLQNLNDSTLHLSTLKIFDGGEQMLQQLLLSKFTGVTGPVQFDSDHNLVRPAYDILNIAGSGSRLIGYWSNYSGLSVAAPEILYQMPRNTSTSAQQLHDVVWPGDSTTKPQGWIFPNTGQPLRVGVPIKASFKELVSGRGDNMSGYCVEIFNAAIKLLPYPVPYQFITIGDGTKNPSYIDIIRMVAANSLDAAVGDFAIVRNGTQLAEYTQPYIESGLVIVAPVKHVTSSAWAFLEPFTLEMWCVTVALFILVGVVVWLLEHRTNEEFRGSPRRQVITMLWFSFSTMFFAHRENTVSTLGRFVLIIWLFVVLIITSSYTASLTSILTVQQLSTGITGIDSLVSSSLPIGYQNGKFTKRYLSENFNVPLSRLVPLNTIQEYADALNRGPKYGGVAAIVDEKPYIDIFLSNYCKFRIVGEEFTKEGWGFAFQRDSPLAADLSTAILQLSESGQLQRIHDEWFSRSSCSSDDSEVGATRLGLGSFWGLFLVCALICLFALLVFFIRVCWQYNQYSSSESSGEPSAATPGPVIRQRRLSRLGSFKELIQFVDKKEEEIKKTMKRRSSDKDSQAAGFSYAQSVASA

SEQ ID NO: 617 - protein, 585 aa, Solanum lycopersicum
MAGGGGGGRSLEQTPTWAVAVVCFVLVAISIVIEHIIHLIGKWLKSKNKSALYEALEKIKAELMLLGFISLLLTVGQSPISNICVSEKLGNSWHPCSKKEEDSSIISEDSLSEQHRRRLLMDAAGGGVRRILAGGGGDDKLPFVSADGIHQLHIFIFVLAVFHVLYCVTTLALGRAKMRSWKSWENETKTAEYEFSHDPERFRFTRETSFGRRHLSFWTKNPVLLWIVCFFRQFVRSVPKVDYLTLRHGFITAHLAPQSHQKFDFRKYIKRSLEEDFKVVVGISPPIWFLAVLFLLFNTHGWYSYLWLPFIPLIVILLVGTKLQVIITKMGLRIHERGEVVKGVPVVQPGDHLFWFNRPRLILYLINFVLFQNAFQLAFFAWTWYEFGLKSCYHDHTEDIVIRITMGVLIQILCSYVTLPLYALVTQMGSNMKSTIFNERVATALKNWHHTAKKHVKDQSKHSNPVTPMSSRPGTPSHHGMSPVHLLRGHYRSDMGSLQNSPRRSNYDFDHWDNEGSPSPSRFYQEAVDGSLHHIQLGQLDHELQQVIEPNSSQVVPLSQEGRDQHEITIAGSRDFSFEKRTTSI

SEQ ID NO: 618 - protein, 210 aa, Solanum lycopersicum
MVKNEVMVDEIPFPSQFMVNNKPLPLMGHGITDIEIHFLQIKFTAIGVYLDPEIVTHLQQWKGKTGAELTENDEFFEAIVNAPVDKFLRVVVIKEIKGSQYGVQLESAIRDRLAEVDKYEEEEEEALEKIVEFFQSKYFKKDSVITYYFPGASGSAKISFAIEGKEDLEIEVENANVVEMMKKWYLGGTRGVSPTTISSLANNICVELSK

SEQ ID NO: 619 - protein, 217 aa, Hordeum vulgare
MGSEQEKKPAATVEVEGIPFPREIAGAKTLSLVGHGVTDIEIHFLQIKFNAVGVYLDVDGAMEHLQGWKGKSQLMEDEAFFDALVSAPVEKVLRVVVIKEIKGSQYGVQLESSVRDRLVAADKYDDEEEEALEKVSDFFQSKYFRPGSIVTFHFPATAAAAPEISFVTEGKEEAKVAVENAAVAEMIQRWYLGGEAAVSQTTVRSIADGFAAMLSSA

SEQ ID NO: 620 - protein, 798 aa, Solanum lycopersicum
MEGGENLVRVSSARLSGSNVWRNSAMDVFSRSSSREDYDDEEALRWAALEKLPTYSRIRRGLLLEEEGQSREVDITKLDLIERRNLLDRLVKIADEDNEKLLMKLKQRIDRVGLDLPTIEVRFEHLNVDAEARVGSRALPTIFNFTVNILEDFLNYIHILPSRKKPLPILHGVSGIIKPGRMTLLLGPPSSGKTTLLLGLAGKLDKDLKVSGRVTYNGHGMDEFVPQRTSAYISQNDLHIGEMTVRETLAFSARCQGVGDKYEILAELSRREKEANIKPDPDVDIFMKSAWNEGQEANVITDYTLKILGLEICADTLVGDEMIRGISGGQRKRLTTGEMMVGPARALFMDEISTGLDSSTTYQIVNSIRQSIHILQGTAVISLLQPAPETYDLFDDIILLSDGKIVYQGPRENVLEFFEYMGFKCPERKGVADFLQEVTSRKDQEQYWSRRDEPYRFITSCEFSDVFQSFHVGRKLGEELAVPFDKSKSHPAALTTKRYGISKKELLKACAAREYLLMKRNSFVYIFKMVQLTMMASIAMTLFLRTEMHRDTTIDGAVYLGALFYAVITVMFNGFSELALSIMKLPSFYKQRDLLFFPAWAYALPTWILKIPITLVEIAIWVCMTYYVIGFEADVGRFFKQLFLLICLNQMASGLFRFLAALGRNIIVANTFGSCALLVVLVMGGFILSRDDVKQWLIWGYWTSPMMYAQNAIAVNEFLGKSWSHVPPNSTGTDTLGVSFLKSRGIFPEARWYWIGAGALIGYVLLFNFLFTVALAYLNRKNPPTIMQFNLISIYRRS

SEQ ID NO: 621 - protein, 141 aa, Gossypium hirsutum
MENVIPQQWASPCGNQCTHKYAALMQIPWRVFCKKGCNADGDTWEECLAECDEICYKDPVLKDQQWSAYIDRSPGAVNYSQDCFNACVTGCGYKFEICKEKVDQVRPRPLPSEPLPEVKPPTSPAATKPDEPAEDVPSTSA

SEQ ID NO: 622 - protein, 131 aa, Zea mays
MRRRGSNSSPLAAAALPLLLLLVAGCFHCMAAAARHLPSPGAPVQALDHQAENGVKAASAGADGAGGLVLQEGGTGNNGDDLSSKTLLETTTTTMGAEACEEGNDKDECVQRRLLVDAHLDYIYTQHKGKP

SEQ ID NO: 623 - protein, 568 aa, Zea mays
MAAALRFPGVARESLSLDAPVAASKLGRERRPAPASANPGPQCWRRRRGLAVRCQTGSTAPPVLRTEEAPAAAAGARNAQAGFTVVMKFGGSSLASAERMREVAGLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEATYPAVAKRLHEDWMDDPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDCVATSEVSISLTLDPSKLWSRELIQQELDHVVEELKKFAVVHLLQRRSIISLIGNVQRSSLILEKAFNVLRRNGVNVQMISQGASKVNISLVVNDSEAKQCVQALHSAFFENGFLSEVEGADVPQNGASLNSNGAVYGN

SEQ ID NO: 624 - protein, 567 aa, Solanum lycopersicum
MATLSHFSGVKTPCPSIFKRSVHFPQLDFVATVPFVSAPSKSVKVSCCERVQRLVCKAQATDVNRKETKNESFGEAPDELTCVMKFGGSSVASAERMREVADLILSFPEERPVIVLSAMGKTTNNLLLAGEKAQSCGVSNVSDLQELAFIKELHLRTIDELGVESSTISKHLLELEQLLNGIALMKELTPRAKDYLVSFGECMSTRIFSAYLNKLGVKARQYDAFEMGIITTDDFTNADILEATYPAVAKRLTGDWMSNPAIPIVTGFLGKGWRTCAVTTLGRGGSDLTATTIGKALGLREIQVWKDVDGVLTCDPNIYPRAETVPYLTFDEAAELAYFGAQVLHPQSMRPAREGDIPVRVKNSYNPKAPGTLIVKTRDMSKAVLTSIVLKRNVTMLDIASTRMLGQFGFLAKVFSIFEDLGISVDVVATSEVSISLTLDPSKLWSRELIQQASELDNVVEELEKIAVVKLLQNRSIISLIGNVQRSSLILEKAFHVMRTNGVNVQMISQGASKVNISLIVNDSEAEQCVRALHHSFFESDLSELVWESQSGNGYATTTTPLPTLSN

SEQ ID NO: 625 - protein, 347 aa, Solanum lycopersicum
MAENQKTVFKSVQELANENQVPEKYIHTQGSINSSCPMLNVPVVDLRLLTSTARKQELNKLQSGLKFCGCIQVINHGLADSFLDKVHEISKQFFALPAEEKLKYARTVDDIYGYGNDSVLSDKQKLDWTDRLYLNVFPEAIRNLKLWPQKPECFREVFEEYINNMKLLSESLLKAMAVSLNLEENCFLDQCGEGREMIARFNFYPPCPTPEVVLGIKPHADASAITILLQDKEVEGLQVLKDDQWFRVPIVPYGLLVNVGDQVEIMSNGIFKSPVHRVVTNADQERNTLAVFIMPDVTDGIGPVEKLINEEMPRAYKDVKNYVELFFQSYQHGKRPIETAMICQEQD

SEQ ID NO: 626 - protein, 279 aa, Vitis vinifera
MMEWEAQELQQQPQHHNQNQNGVVVGGGSGGLYVKVMTDEQMELLRRQISVYATICEQLVEMHKAITTQQDLAGMRLGNIYCDPLMASAGHKISSRQRWTPTPVQLQILERIFDQGNGTPSKQKIKEITTELTQHGQISETNVYNWFQNRRARSKRKQSVPLPNNADSEVETDVESPKEKKTKPDNIQSHENSALGTENIYFQSPEMGSEMHCLDTLPNKGEPMFPSDRSLRSSGSLGHSSLYETGVPNPRMDQLIGKVEVPGSFSPYRQGGEGFDMVG

SEQ ID NO: 627 - protein, 347 aa, Vitis vinifera
MWESICLTLAATAGNNIGKVLQKKGTVILPPLSFKLKVIRAYAFNKTWIVGFLMDIIGALLMLKALSQAPVSVIQPVSGSGLAILSIFSHFYLKEIMNPIDWMGIAMAGIGTIGVGTGGEEQKAYSISIFHLPWLAFSVAILFVLLNGWLRIYRRQRKVQEMMQSEVVEEIIYGLESGILFGMASVISKMGFVFLEQGFSKILVPICISISICCSATGFIYQTRGLKDGRAIVVSTCAAVASILTGVLAGMLALGEQLPSAPDARLSLLFGWLLIIIGVILLVSSTWLVRHLPRPLRHYVQSGVERNFGVKHSGLRSGTRVRDSSPSAVIQASTLHHLITSPAKAKA

SEQ ID NO: 628 - protein, 260 aa, Sorghum bicolor
MGSECKDHLQLHAAGYGVGVASPQEEEEEEQAGAIAPFVAKTFHMVSDPATDAVVRWGGASNTFLVLDPATFSDYLLPSYFKHRNFASFVRQLNTYGFRKVDTDRWEFAHESFLRGQAHLLPLVVRKKKKKKAAGGCREQLCEEGEEVRGTIRAVQRLRDQQRGMEEELQAMDRRLRAAESRPGQMMAFLAKLADEPGVVLRAMLAKKEELALAGKGSTTPAPGKRRRIGAEAGVGDVADMAQSRGAVPFPFSVLGQVFY

SEQ ID NO: 629 - protein, 459 aa, Hordeum vulgare
MERTQGFFAALKQEVARGLSPARARRRSAEAADLDAALRFSGPGAGGEMLAPLMEGPDPESGDGDARGAGGARREGWGRWVRGQLARTPSSVAAAAAGAGAARNDLRLLLGVMGAPLAPVHVCAAEPLPHLSIKDTPIETSSAQYILQQYLAASGGHKLLASVRNSYAMGKVRMVATEFENAGRLVKNRNAARCAEPGRFVLWQMAPEKWYIELAVGGSKVHAGCNGKLVWRHTPWLGSHAAKGPVRPLRRALQGLDPLTAASMFAGARCIGERKVNGEDCFILKLCTDPETLKARTEGLAEIIRHVMFGYFSQRTGLLVHIEDSHLTRIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGEKNKFGPPHGHRAKVAALEKTDGDELAWRGTRT

SEQ ID NO: 630 - protein, 593 aa, Hordeum vulgare
MGRGDGEKEAKRRRRGRSSKRSRHATPSSDSDSSPSSASSSPSRSPGPRSRSGSKPEKSSSSRRRRHHRKSSGRSRSSRDDDRRRHRRRRRDERARHGSDASDLSGSGSDDSGWMEEAQEIVRGILSEFPAITSELRQLLQMIDSGEGIDISGISDKPLVKRLKKLFRSLKLKESANGAYLLAPKGVPTLDVVGPVLEGSAKLGNDPNETVASRNRQQVPSPNFDVQNKDDIPPEDGGKVDREEDTPIKRVIGPAMPSRELLAAAAEMTEALRCRDAELEADDGFLIGPPPPAMVAEAASANEAERFEEVTRILGADADALYDVLGINWKMSPDNIKKRYWKLSLLVHPDKCPHPSAQEAFVKLNNAFKDLQDPQKRGAIDEKIQKKEEMEQFEVELKAMREAAEWRRLQGISLEGDEELLAVPKQPEAPPTRDEWMTTLPPERKAGVPMHSTTAFSMNGKEGRGDTSAWTDSPLDRAQKAQQNYLEAYNKAKAIADGHEEKGKSSDASLVDKYNSSKRSVSLVQKHRESKKEKKKQKQQRGKEEWEENHPWKPWDREKDLTAGRQNVALDPENTAQGLSSRFSSGAVQRNFL

SEQ ID NO: 631 - protein, 240 aa, Solanum lycopersicum
MRRSRAAAAARQVPATEVPVPAPVAGEHNGSGGSKEIRFRGVRKRPWGRFAAEIRDPWKKTRVWLGTFDSAEDAARAYDAAARTLRGPKAKTNFPLPSSHHLPPYPHHHQFNQSINPNDPFVDSRLYSQDHPLVSQRPTSSSMSSTVESFSGPRQPPRQQTAASVPSRKYPRSPPVVPDDCHSDCDSSSSVVEDGECDNDNIASSSFRKPLPFDLNLPAPMDDFSADAYADDLHCTALCL

SEQ ID NO: 632 - protein, 582 aa, Zea mays
MGRDGEQTRRRSRKRSRDASPSSSDSDSFDSPSSPSSSPERRSRSSKRNRSSSSHRHSRKKSDRSRRSRDEDRRRRRRRGQERKRHGGDGGRSSDSQSSEEDRAEEAREIVRDILIELPAIAEELRQLLQIIDSGESIDISGISDKLLVKRLKKLFRSLRLKESASGAYLLPSKNVPTLDIVGSLLLASSKLADNKSGKPVSPNREALQQANFDVQNKDKDYIVSEEPKIVDVEEEPPKRRIIGPAMPSRELLAAAAEMTEALRCRDAELEANDDLLIGPPPPAVVAEAASANEAERFEEVTRILAADTNSPYEVLGVNWKMSTDNMKKRYWKLSLLVHPDKCPHPSAQEAFVKLNNAFKDLQDPDKRGAIDEKIKKKEEMEQFEVELKAMREAAEWRRIQGVSLAGDDELLAGPKESQRPTRDEWMTTLPPERKAGVPMHSTTSFSMNGKEGRGDTSVWTDTPLDRAQKAQQSYLEAYNKTKAIAEGDDVKSKNPDASIVDKYNTSKRSVSLVQKHRESKKEKKKQKQQEKEEWEGSHPWKPWDREKDLSAGRQNVALDAENMSQGLSSRFASGAVQRNFL

SEQ ID NO: 633 - protein, 352 aa, Hordeum vulgare
MIRRRMGALHVGEPRVSFQQQVGKNGGGHGAVVEEIHGLIRVYKDGHVERLPAIPDVPCTWGSTAAASGVLARDVAVDRATGVWARLYAPAAAAGKVPVVVYLHGGGFSVGPAAWSCYHEFLAQLPARAGCAVMSVDYRLAPENRLPAAFDDGLTALRWLRQQASRGAAASDEVSWWRSRCRFDRVFLMGDSAGAAIAFHVAARAPAPLAVKGAVLIQPFFGGEARTASEKSMPQPPGSALSLSTSDSYWRMALPAGAGRDHPWCNPLARGAPRLESLALPPMLVCISEADILRDRNLELCRALRKAGKSVEQATYGGVGHAFQVLHNCHLSRPRTQEMLAHIRAFVSARSS

SEQ ID NO: 634 - protein, 170 aa, Zea mays
MAAMVRGPAMASAAGPGATSAAAAAAAAAAEEMRWRQLDSGVSAVSFGFVATAILVSMFLAMAILEHFLRPTTSTHAPPRGRGVLRRLRLFLLGRGGGAPGGTDLEAARKLHGHAPLEMPVYPRGVSVLMPGQDVPTFIAHPAPAPCPPERIRWPSHQPPPFTGSSPNPS

SEQ ID NO: 635 - protein, 140 aa, Hordeum vulgare
MFSGDWTPPCGSCCTKKYATLVQIPWRVFCKKGCNADGDTWEECIGKCTEICYKDPVLEDRQWSAYIDRSPGEDSYSLECFNACISGCGYRFDIPAEKVGLIKPNRPSKPPPPLPPVVERAKPSSGSPAAAGEDVPGTSA

SEQ ID NO: 636 - protein, 614 aa, Sorghum bicolor
MPPPPPQGPAPSHAGRANLFSAPPPALSNRRYPSQRSLPLPPVPPRRRDPKNHRPQPSQEEERPTDSGPRRTAATNPAFRASHLRTAYRKPVPPAAAAGEGEALLAADPTDAASGRAVVVGPSGLSFRLPGAPFDFQFSYSEGPRAPPLAIREPAFVPFAPPTMPRPWTGKAPLLTKEEKARRRGVRLHTPLGQEPPQTVSAHGIMMEVRDRRQMDLARVSPGDGRSREEVLGEPLTPSEVRALVKPHISHNRQLNIGRDGLTHNMLEMIHCHWRRQEICKVRCRGVPTVDMKNLCYHLEEKSGGKVIHRVGGVVFVYRGRHYDPKTRPHYPLMLWKPATPVYPKLIKEVPEGLTKEEADEMRRKGRDLLPICKLAKNGIYITLVKDVRDAFEGNDLVKIDCEGLNPSDYKKIGAKLRDLVPCVLLSFDDEQILMYRGKEWKSRYSKPLTLIPKVPKNNLAMSSDMNSSDEVSDANTQVAIREVLRPKMFKLWKSAVDSSLALLLDDAEANDLTPDSLLTLVEEFSVTSQAVEHSFPALLVTNGEVNTESLSAEYINDDESETSIAGNEEGQLEQSPDLSGDEHFELDMLERLESSVPLGSLPIDGMIEQLNSE

SEQ ID NO: 637 - protein, 319 aa, Glycine max
MMEHNIIVNNNVIAPFVIKTYNMVNDPTTDKLITWGPANNSFIVLDPLDFSNSLLPTFFKHNNFSSFVRQLNTYGFRKVDPDRWVFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 638 - protein, 331 aa, Zea mays
MASTTTTFLAVLLVVAASAAPARSCSPRDIHALLSVKQALGNPASLSTWTPASPNCCAWDHLRCNDAGRVNNVFIDGADDVRGQIPSAVGGLTELMSLTLFRLPGLTGAIPACLTALSNLQFLTVSHTNVSGAIPESLARLRGLDSVDLSSNRLTGGIPAAFADLPSLRSLDLRHNQLTGPIPAGLVQGQFRSLVLSYNQLTGPIPRDDARDEINTVDLSHNRLTGDPSHLFAAGRPIGKVDLSWNYLNFDLSRLVFPPELTYLDLSHNLIRGTVPLSLERLSTLQKLDLSYNRLCGPLPKGHGVIKHGCKPYAHNQCSKGTPLAGCQDLE

SEQ ID NO: 639 - protein, 498 aa, Sorghum bicolor
MAMALRRLAGVSGSPSASAAAAALLLRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVEINSRFIPSLQQLHDSLHSKTVEFKDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEQEFHELVVPEKMIGPSD

SEQ ID NO: 640 - protein, 465 aa, Sorghum bicolor
MATSPAASSSSAPTASAAAAATMAAEATDGPVLSVVSKRLRALRKKYNRITQMEESLAAGKTLNREQEEVLRSKPVVAALIDELERLRPPLASAVAEELSSRPAPAPAPAPAAAASSSDSDSSVQDLLALIYFGSLFDVKQQSDFVSLVYASELERSSCITYDYVGDDPEDSLAETDLNAVSALASLAASRPPAAAGVSHRDALQACAHHARLWLRRADEPIHPDSTVTYAGVRAKLDRIMASGYYTAQLEMRPPLDLAAAVASFGAGGAQMQESMVVSPQAPEAVEENPAVEGHKDEKDDSQATEIYSDHQAPVVDAEHVEDEGLVNPTDEVPSAEAEQETFDADVEDQEQKDQQFTQRRSYQNQRGGGGRGGGRRGYPNGRGGRGGRGGGYQNGRGGGGYQNGRGGGGGYYYESGYYQPRNYNNNRGRGGRSGGGNSYYNNHGGGAQGGGHGNPGRVELGANA

SEQ ID NO: 641 - protein, 611 aa, Sorghum bicolor
MAPVDPHSYTDGAHPVVSRAALAFYLDFAASTIHASALLTLSAPHSGDLLLDTRALTVHSASTDADTPEPIPFSLAAAPDPVLGTALTLTLPPDTTSFRLTFSTSPAASALQWLAPPQTASGQPFVFSQCQSIHARSIFPCHDTPAARITFSLLLNVPEQLSAVASARHVARRDPLPSDHRGACDDELWCAPGRIVEEFQMEQSVPPYLFAFAAGGIGSRDLGPRTRVYAEGGDKVLDEAAREFAGVEEMVKVGEGLFGPYEWERFDLLVLPPSFPYGGMENPRMVFLTPTVIKGDAAGAQVVAHELAHSWTGNLITNKTNEDFWLNEGFTTYAERRIVEVVQGEERAALNMGIGWRGLNRMMERFKDNMEFTKLKPNMAGIDPDDVYSEVPYEKGFQFLWRIEREIGRPAFDEFLKKYIATFKFQSIDTETFLEFLKTNVPGIENQIDLNLWVEGTGIPPDAMEPDSATYKKICSLAAEFKSGKLPSEDEVANWSGQEWELYLENLPTDVEASQVTALDERYKLSESRDYEVKVAFLQLAIPTGCKCYFNEVEKCLKQVGRMKYLRPLYSSLAKCSSEEKMLAQRIFSEAQEFYHPIARSVAESILSKHS

SEQ ID NO: 642 - protein, 201 aa, Sorghum bicolor
MAAEQQQQPAKAAAAGSRFAVTCGLLRQYMKEQGGSGATRCLAPAVAMGLMPEADAAAAATEERTTVLELFPQQAGTLKDEQQRKRKEPADGRAPLTIFYGGKMVVFDDFPAEKAEELMQLAGSGGNAAPAAENALGQPSLTDMPLARKVSLKRFLEKRKNRLTAADPYPAAASESSTKQPPAVKEEGAPWLGVSSALSLS

SEQ ID NO: 643 - protein, 283 aa, Gossypium hirsutum
MEEINWDTLLLEVDLPDFGDILDNEPEPVTEPPPQPCSTQNSDEEPAVSSWIGEIEKVLMEDDNFDHRVETQPVSDDDFLADLLVDSPPSSGGDVAGVDGADLHKQSQTHTDVDKDDPIAKKQRRQLRNRDAAVRSRERKKMYVKDLEMKSRYLEGECRRLSRVLQCFIAENQALRLTLHKGCAFDASSAKQESAVLLLESLLLGSLLWFLGIMCLFTLPILPKSVLEAVPMANEETQGPERVAPRGAGSNRVGPSFVKSRRCKASRGKMKEISCFMGILVPF

SEQ ID NO: 644 - protein, 323 aa, Oryza sativa
MAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 645 - protein, 812 aa, Oryza sativa
MMMLLMPRSSSSCCRRSPGGKKQGAQPRVMAPRRGVTRVYIEKRLGVGGGNASSLQDMHRKELQARTRDQLQTLELSTSLYDTAWVAMVPLRGSRQHPCFPQCVEWILQNQQDDGSWGTRGFGVAVTRDVLSSTLACVLALKRWNVGQEHIRRGLDFIGRNFSIAMDEQIAAPVGFNITFPGMLSLAMGMDLEFPVRQTDVDRLLHLREIELEREAGDHSYGRKAYMAYVTEGLGNLLEWDEIMMFQRKNGSFFNCPSTTAATLVNHYNDKALQYLNCLVSKFGSAVPTVYPLNIYCQLSWVDALEKMGISQYFVSEIKSILDTTYVSWLERDEEIMLDITTCAMAFRLLRMNGYHVSSVELSPVAEASSFRESLQGYLNDKKSLIELYKASKVSKSENESILDSIGSWSGSLLKESVCSNGVKKAPIFEEMKYALKFPFYTTLDRLDHKRNIERFDAKDSQMLKTEYLLPHANQDILALAVEDFSSSQSIYQDELNYLECWVKDEKLDQLPFARQKLTYCYLSAAATIFPRELSEARIAWAKNGVLTTVVDDFFDLGGSKEELENLIALVEKWDGHQEEFYSEQVRIVFSAIYTTVNQLGAKASALQGRDVTKHLTEIWLCLMRSMMTEAEWQRTKYVPTMEEYMANAVVSFALGPIVLPTLYFVGPKLQEDVVRDHEYNELFRLMSTCGRLLNDSQGFERESLEGKLNSVSLLVHHSGGSISIDEAKMKAQKSIDTSRRNLLRLVLGEQGAVPRPCKQLFWKMCKIVHMFYSRTDGFSSPKEMVSAVNAVVKEPLKLKVSDPYGSILSGN

SEQ ID NO: 646 - protein, 523 aa, Oryza sativa
MGSLDANPAAAYAAFAADVEPFRPLDADDVRSYLHKAVDFVYDYYKSVESLPVLPGVEPGYLLRLLQSAPPSSSAPFDIAMKELREAVVPGMTHWASPNFFAFFPATNSAAAIAGELIASAMNTVGFTWQAAPAATELEVLALDWLAQLLGLPASFMNRTVAGGRGTGGGVILGTTSEAMLVTLVAARDAALRRSGSNGVAGITRLTVYAADQTHSTFFKACRLAGFDPANIRSIPTGAETDYGLDPARLLEAMQADADAGLVPTYVCATVGTTSSNAVDPVGAVADVAARFAAWVHVDAAYAGSACICPEFRHHLDGVERVDSISMSPHKWLMTCLDCTCLYVRDTHRLTGSLETNPEYLKNHASDSGEVTDLKDMQVGVGRRFRGLKLWMVMRTYGAGKLQEHIRSDVAMAKTFEDLVRGDDRFEVVVPRNFALVCFRIRPRKSGAAIAAGEAEAEKANRELMERLNKTGKAYVAHTVVGGRFVLRFAVGSSLQEERHVRSAWELIKKTTTEIVADAGEDK

SEQ ID NO: 647 - protein, 515 aa, Solanum lycopersicum
MGWLEKIFGGSTHRISGGQYHSGYEGAQYHGGYDGGQYHSGHEGEQYHGGYQDSTTWDGPTTSVDESSDFDKEEIDRAIALSLAEEDQKGKKVIESEPHLEEDEALAKALQESLNVESSPPPPPPRYDYGSPFPSLSYSFPYGYRVCAGCNAEIGHGRYLSCMGAVWHPECFRCHGCNQPISDYEFSMSDNRPYHKSCYKEQHHPKCDVCKSFIPTNPAGLIEYRAHPFWLQKYCPSHETDGTPRCCSCERMEPVDARYLILEDGRKLCLECLDSSIMDTHECQPLYLEIQEFYEGLNMKVEQQIPLLLVERQALNEAMEGEKNGHHHMPETRGLCLSEEQTISSISRRPRIGGYRILDMFTEPYRLIRHCEVTAILILYGLPRLLTGSILAHEMMHAWLRLKGYPSLSPEVEEGICQVLAHMWLDSEIIAGSGSTSTSASTSASSSSSSSPSTSSKKGKRSDFEKKLGDFFKHQIESDTSAAYGDGFREGNKAVLKYGLKTTLDHIRLTGTYPC

SEQ ID NO: 648 - protein, 1089 aa, Populus trichocarpa
MVRLLGLTRGESDDSPREITSRTTPLTSESGESGWLIRFFDSSFFCEWIAVSYLYKHDHAGVRDYLCNRMYTLPLSGIESYLFQICYMMIHKPSPSLDRFVIDMCSKSLLIALKVHWFLLAELEDSDDNDGISRIQEKCQIAATLMGEWPPLLRPRNESSSPGSKNQVLNRILSSKQKLLSLTSSPPLQKSTQLSGNSLQEDGTGSQLSPDENKIFKKFIPGPKFRDALLFRKKSVDKDEDEGGKDGFFKRLLRDSSRREDEELTTSSDGFFKRLRDSIKSEDEELTSSSDGFFKRLLRDNSRVEDEEVMSSSDGFFKKLFRDSKSDGDEKLVSKSAEDDEKEGFLKRFFKEKFEDKKDGNDQNEDEERLKLEEKGSKSAEDDEKEGFFWKLFKDKFEDKKDGADKPDEGTVNGEEEEPSDFSLFRRLFRVHPEEVQSSPVNENNSSGSLLESSLGTENFFRKLFRDRERSFEDSELFSFKKNNEKHPGSPKQQNEKSNTKPPLSNTAALFRKGAYHESLDFVMTLCETSYGLVDVFPVEDRKSALCESLAEINMHLAEAQNSGGVCFPMGKGMYRIVHIPEDEAVLLNSREKAPYLICVEVLKSEMPSNSKETSGTQKLSRGGIPLANGDAFLQKPPPWAYPLWTAQEVYRNSSDRMSRSTAEAIDQAMSHSSEMKMKFVSVSLSVEKQFPSQSTIIEAPKLNSGINCMHQNASHCNDLEWVRVVLTADPGVRMEDTGYAGAPRRKEHRRVPSTIAMEEVKAAAAKGEAPPGLPLKGAGQDSSDAHPKVDGNPKASDALSGELWEVKKERIRKASLYGKLPGWDLRSVIVKSGDDCRQEHLAVQLISHFYDIFQEAGLPLWLRPYEVLCTSSYTALIETIPDTASIHSIKSRYPNVTSLRDFFVAKYGENSPSFKLAQRNFVESMAGYSLVCYLLQVKDRHNGNLLMDEDGHIIHIDFGFMLSNSPGGVNFESAPFKLTRELLEVMDSDAEGIPSEFFDYFKVLCIQGFLTCRKHAERIILLVEMLQDSGFPCFKGGPRTIQNLRKRYHLSLTEEQCVSLVLSLISSSLDAWRTRQYDYYQRVLNGIL

SEQ ID NO: 649 - protein, 127 aa, Sorghum bicolor
MAGGQRQRRWGATDVASWCALLALVMVVGSLAGSGDDEEQYDRGGRRLVVRGARLAAARPCDELYVVAEGETLHSISARCGDPYILEHNPHVHDPDDVFPGLVIKITPRAADSNSNSNSGDGGGAKK

SEQ ID NO: 650 - protein, 946 aa, Oryza sativa
MTNLSGKKSLNTVTLVFKLPYYTQWGQSLLIAGSEPALGSWNVKQGLSLSPVHQGNELIWSGRVSVATGFTCQYNYYVVDDNKNVLRSESGEKRKLVLPEGVQDGDVVEIRDWWQDASEALFLRSAFKNVIFNGSENAKRELKTTSLNKSLEPEDIVVQFIVSCPRLGAGSTVVVTGSNPQLGRWQTQDGLKLNYVGDSIWKANCLLRKSEFPIKYKYCKISEAGVSSLEFGPNREADVDLSSPKPSRYVLLSDGALRESPWRGAGVAVPIFSIRSNEDLGVGEFLDLKLLVDWAVNSGFHLVQLLPINDTSVHGMWWDSYPYSSLSVFALHPLYLRVQALSDAIPGDIKDEISQAKKQLDKKDVDYEASLASKLSIARKIFKLEKDKVLNSSSFKQFLSENEEWLKPYAAFCFLRDFFETSDHSQWGRFSQFSKEKLDKLVSEGTLHHDVICFHYYIQYHLYMQLSEAAAYARKKKVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLVGKFRPSIALSQEELLSEGLWDFDRMSRPYILQETLEEKFGSFWTVIAANFLNEYKKQHYEFKEDCNTEKKIIAKLKNSSEKSLWLEKEDSIRRGLFDLLQNIVLIRDPEDSTKFYPRFNQEDTSSFNDLDEHSKNILRRLYYDYYFARQENLWRQNALKTLPVLLNSSDMLACGEDLGLIPACVHPVMQELGLIGLRIQRMPSEPNLEFGIPSQYSYMTVCAPSCHDCSTLRAWWEEDGGRRSRFYQTVIGSDDEPPSRCTPEVANFIVKQHFDAPSMWAIFPLQDLLALKDKYTTRPAKEETINDPTNPKHYWRFRLHVTLDSLLDDKDIQATIKELVTSSGRSFPGKVDGAEESGEKLAKVQLNGKP

SEQ ID NO: 651 - protein, 443 aa, Oryza sativa
MATRPLAASTLLPPLRFCSPLKTPPPSPPPPHLRRLQTLTRALASSSSAMASPPAKKVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 652 - protein, 306 aa, Zea mays
MLLPHSSSASATATTRGLALAAAAPPPRPTARPRRARLLPPRARAETHATGVGADRAAEALLQSGLRRESLPRHVAVVMDGNSRWARERGLTPADGHKAGGRNLERVVALSRAWGIRALTAFVCSRENLSRPKAEVDYMMGLSEWLIGDNIDKLSRQGIRLQVIGDAAKMPASLRSAAAQADEATRQNSQLHVMLAICYSGRWDMVQACRELAREAQANRLSPDDIDESIIAGKLATSAAGEFSCPDLVIRTSGEMRLSNFLLWQSAYSELFFTAKMWPDFGEAEYLEALRSFQGRDRRFGQSKLL

SEQ ID NO: 653 - protein, 391 aa, Sorghum bicolor
MALAVRTPRFQPRRTSISAPAPPASTSLAAANARARACARAAVRASPFTEGTSSSRYRRDAWSYAAADGSSSSASPSSSDAAAAAAAAAAAAARRDDEIALQLPELRRLLDALRASRGKGAEGADGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAGSAADPDTTLVVYMGLSTLPSLAPKLMKHGLPPDTPAVAVERGTTPQQRTVFSLLKDLVDEVKSADLVSPTLIIIGKVVSLSPFWVESSEHYALKIESSYTNETR

SEQ ID NO: 654 - protein, 385 aa, Triticum aestivum
MSCFSRIFKRTSGGQQQTGPLNEDLPGVENITRFSYKELDRATARFDQSNKIGEGGYGPVYKGTLRDGTAVAVKVLSLQSRQGAREFLSELITISDISHENLVKLYGCCVEGSHKILVYNYLENNSLAQTLLGSQQHNSIQFNWRTRVNICIGVAQGLAYLHDGVRPHVVHRDIKASNILLDQDLTPKISDFGLAKLLPSDVSHISTRVAGTLGYLAPEYAIRGQVTRKSDVYSFGVLLIEIVSGRCNTDTKLPYEDQILLEKTWAYYDQGQLDEIIDSSLGDDLDVDEACRFLKVGLLCTKNVTKRRPDMSMVTRMLKGEEDVESHEITKPDVIRDFRDLKLRSKATSSSLLTSIVARSSPSSSSSTGNTTRTSITFTAISDRP

SEQ ID NO: 655 - protein, 366 aa, Triticum aestivum
MARRHHLLLLLPLLALAFSFVAAAPEGQGDAAAFIDGASHRYLRDQQGDQATSMSLDEVSAAVSVLLGFAPPAMLPAPSSAKLNELLLPKPFDRPRAVFLMQIDGSHDSVDSFVSDAGSIYKTKIDVAKNAATGLTDRDELIVIRSDESSGSDVLDNELTNLATWLEGSYQKADSKLIIPLKSGNSLTLLLNKEVDVEFASSLISLLKTIKRGIQVHEDFSGGIVSPAELLVCHFTGIKALEDEYGSAEIVKQGVEVVQTALTKAFDQLQGAYNGKIVGLVISTKEASTSLASIIDAPSSLHISRRLAEASKTNATASIAAIYLVRLSLAWITGIIFLVSTLIGICLLMNMPLTRDTLLYSNVKMD

SEQ ID NO: 656 - protein, 137 aa, Sorghum bicolor
MAASVMASLSLKPSPFLDRSRFTSVQPSARSSTFRVMAKKTKKIKTSQPFGPAGGLNLKDGVDASGRPAKGKGVYQFANKYGANVDGYSPIYNPEEWSPSGDVYVGGKTGLLLWAVTLAGILLGGALLIYNTSALAS

SEQ ID NO: 657 - protein, 139 aa, Hordeum vulgare
MATSTMAFMPLKPSPSTFSGHSQLQRIQPFTRSSSFRVMSKKAKKVQTSQPFGPGGGLELKDGVDASGRPAKGKGVYQFASKYGANVDGYSPIYNPEEWSPSGDYYAGGKTGLLLWVATLAGILLGGALLVYNTSALAS

SEQ ID NO: 658 - protein, 480 aa, Solanum lycopersicum
MAATHLVSHSPSLHKSLKYPSNASQKLSFFKPNFPLKPISRNLSIRASVSTSEPQTQKFQHCFKKCEDGFLYCEGVKVEDVMETVERRPFYLYSKPQITRNVEAYKAALEGLDSIIGYAIKANNNLKILEHLRSLGCGAVLVSGNELKLALGAGFDPTKCIFNGNGKLLEDLVLAAQAGVFVNIDSEFDLDNIVAAARLAGKKVNVLLRINPDVDPQVHPYVATGNKSSKFGIRNEKLQWFLDAVKAHPQELKLVGAHCHLGSTITKVDIFRDAAALMVNYIDEIRSQGFEIDYLNIGGGLGIDYYHAGAILPSPRDLINTVRELVLSRNLNLIIEPGRSLIANTCCLVNRVTGVKTNGTKNFIVIDGSMAELIRPSLYDAYQHIELVSPPPPEAAIAKFDVVGPVCESADFLGKDRELPAPSRGTGLVVHDAGAYCMSMASTYNLKMRPPEYWVEEDGSLSKIRHGETFEDHLRLFEGL

SEQ ID NO: 659 - protein, 466 aa, Sorghum bicolor
MGGCFSQEEHRLQSRPAEAAGPDGLRKSKSDSKVIASVLAPPKDVVDLQVEGYGNVNIFTYDELRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVDWARPLLVHNRKLFRIIDPRMEGQYSTKAAIEVASLAYRCLSQNPKGRPTMSQVVETFEAVQNMPECQDILLQNSITGAVTLYEVPKEPADRVELEKAKQEPAVKTTAMPPPVNGKPVPQSRRTRPGNGRSKSEPSLECKMYIPSPDSDGQQLGLEALASPNGSIKDPPDEDLYKI

SEQ ID NO: 660 - protein, 228 aa, Hordeum vulgare
MAPHHLALLLLAVLLRAAATADPDAVQDFCVPDAGPGRPVELNLIRSYPCRSPGNVTAGDFAFSGVRAAGNFSADTGFAGVSVTPAQFPGLHTLGMSFARADLSAAGGVNPPHYHPRATETALVLAGRVYAGFVDTAGRLFAKVLVEGEVMVFPRGMVHFQLNVGDQPATVYGTFNSENPGIVRIPATVFGSGIRGAVLERAFGLTAEELRRIEKRFGVPKKADELED

SEQ ID NO: 661 - protein, 107 aa, Oryza sativa
MSGVLAKFAIASAVMWTAPVAIVYGFYYQMIPGVSQLSSSTQTLASGFLAVISINLVIGFYICMAMKETPHQEPQPDPTFLANAKASIDQPTPSQVNDDSHGKGKVE

SEQ ID NO: 662 - protein, 1172 aa, Arabidopsis thaliana
MALQNKEEEKKKVKKLQKSYFDVLGICCTSEVPIIENILKSLDGVKEYSVIVPSRTVIVVHDSLLISPFQIAKALNEARLEANVRVNGETSFKNKWPSPFAVVSGLLLLLSFLKFVYSPLRWLAVAAVAAGIYPILAKAFASIKRPRIDINILVIITVIATLAMQDFMEAAAVVFLFTISDWLETRASYKATSVMQSLMSLAPQKAIIAETGEEVEVDEVKVDTVVAVKAGETIPIDGIVVDGNCEVDEKTLTGEAFPVPKQRDSTVWAGTINLNGYICVKTTSLAGDCVVAKMAKLVEEAQSSKTKSQRLIDKCSQYYTPAIILVSACVAIVPVIMKVHNLKHWFHLALVVLVSGCPCGLILSTPVATFCALTKAATSGLLIKSADYLDTLSKIKIVAFDKTGTITRGEFIVIDFKSLSRDINLRSLLYWVSSVESKSSHPMAATIVDYAKSVSVEPRPEEVEDYQNFPGEGIYGKIDGNDIFIGNKKIASRAGCSTVPEIEVDTKGGKTVGYVYVGERLAGFFNLSDACRSGVSQAMAELKSLGIKTAMLTGDNQAAAMHAQEQLGNVLDVVHGDLLPEDKSRIIQEFKKEGPTAMVGDGVNDAPALATADIGISMGISGSALATQTGNIILMSNDIRRIPQAVKLARRARRKVVENVCLSIILKAGILALAFAGHPLIWAAVLVDVGTCLLVIFNSMLLLREKKKIGNKKCYRASTSKLNGRKLEGDDDYVVDLEAGLLTKSGNGQCKSSCCGDKKNQENVVMMKPSSKTSSDHSHPGCCGDKKEEKVKPLVKDGCCSEKTRKSEGDMVSLSSCKKSSHVKHDLKMKGGSGCCASKNEKGKEVVAKSCCEKPKQQVESVGDCKSGHCEKKKQAEDIVVPVQIIGHALTHVEIELQTKETCKTSCCDSKEKVKETGLLLSSENTPYLEKGVLIKDEGNCKSGSENMGTVKQSCHEKGCSDEKQTGEITLASEEETDDQDCSSGCCVNEGTVKQSFDEKKHSVLVEKEGLDMETGFCCDAKLVCCGNTEGEVKEQCRLEIKKEEHCKSGCCGEEIQTGEITLVSEEETESTNCSTGCCVDKEEVTQTCHEKPASLVVSGLEVKKDEHCESSHRAVKVETCCKVKIPEACASKCRDRAKRHSGKSCCRSYAKELCSHRHHHHHHHHHHHVSA

SEQ ID NO: 663 - protein, 1302 aa, Solanum lycopersicum
MKESEKINNDINKLSKSYFDVLGICCTSEVVLVEKILKNLDGVREVSVIVTTKTVIVTHDALLISQQQIVKALNQARLEASIRVKGLQNYQKKWPSPFAIGSGILLALSFLKYFYQPLQWLALVAVAVGIPPIIFRGIAAIRNFTLDINILVLIAVAGSIVLHDYWEAATIVFLFTIAEWLESRASHKANAVMSSLVNIVPPTAVLAENGEVVNVDQVKLNSVLAVKAGETIPIDGIVVEGECDVDEKTLTGESFPVSKQKDSTVWAGTTNLNGYISVKTTALAEDCAVARMAKLVEDAQNKKSKAERYIDKCAKYYTPVIVVIAAGFAIVPTALRVHNLKEWYRLALVALVSACPCALVLSTPVAMCCALSKAATSGLLFKGAEYLETLAKIKIMAFDKTGTITRGEFAVTEFRSLIDGLSLNTLLYWVSSIESKSGHPMAAALVDYAQSNSVEPKPDRVEQFQNFTGEGIYGRIDGMEIYVGNRKISSRAGCTTVPEIEGGDSLQGKSVGYIFLGSSPAGLFRLSDVCRTGVKDAMRELKQMGIKTVMLTGDCYAAANHVQDQLHGALDEFQAELLPEDKATIIKGFQKEAPTAMIGDGLNDAPALATADIGISMGISGSALAKETGHVILMTNDIGRIPKAACLARRVRRKIIENMIIAIGTKGAIVALAIAGHPLVWAAVLADAGTCLLVILNSMLLLRGATRRHEKKICKSSTSSHAHHHKDKASCCKSEKTPQQCCSDIESQKECRKKSCSSEVCVQRCQPIPSGSTSCVNDQRSDSTQNNGHQSHSHPQCCSSKMSVTACQSAVSESKSCGSNNCSDSIRKSSCHSSTNSLISSSDLSAPQCHSATSSSKSCGGTKRSNLSDKSCCRSLEIPQTCSTKKAAHGCYSEVSGPKSCGNSKCSDSTDNNIHHSHSDRQTCTSKVCAPQSPSATSSSMTCGNTKCSDTTSKISCHSHANSEPCSSKKSGPTCQNANSGSRSCGNHKCQDSATEHGVHSLTDPLSEEVILKQKILVLESNHDLSHGCCEEEHDHHPNLDKAYDSCALQECHYSVQGDITDISKTGIQETSHCDSTNQTCQTVISGSMIFGDNKSLDSVDIHECHSHAHPPHKEEPHHSVGHGCSDKEHDHSHPEKAFDSCATQECCFSVQDHSIDISENGSQGTDHCDSIKQSMVIPCSCKHTPQEKVSHCGFHSTTIPTDEELAKLVRRCCDYRPCHNVRSGCRNHATECGPTTRSTINILRDNHHHHHLDCSGRKVCSPIEKRHIGGCCESFRKECCPKNINHFASSFGGGLSEIVLE

SEQ ID NO: 664 - protein, 267 aa, Hordeum vulgare
MAMARVPILVAVALMAASASCSAWDPTIRMVDDAVAPLIHALRPLLGSGGHGGVPCDSWRLGVEAYNVRDWKTVPANCEGYVGHYMLGNHFRRDFKVVIDQAIAYVDGLKLAGNGKDVWVFDIDETTLSNLPYYATHGFGARPYNATSFDAYVLEGSAPALPETKRLYYKLLKVGIKPVFITGRTEDKRAVTVGNLRSQGFSGWMNLTLKQHGFKGSAISYKSAERKKLQDAGYVIVGNIGDQWSDILGAPEGARTFKLPDPIYYIA

SEQ ID NO: 665 - protein, 1067 aa, Oryza sativa
MAAEGGRCQKSYFDVLGICCPSEVPLVEKLLQPLEGVQKVTVIVPSRTVIVVHDVDAISQSQIVKALNQARLEASVRAYGNGSEKITNKWPSPYVLLCGLLLVVSLFEHFWHPLKWFALVAAAAGLPPIVLRSIAAIRRLTLDVNILMLIAVAGAIALKDYSEAGFIVFLFTTAEWLETRASHKATAGMSALMSMAPQKAILAETGEVVAARDVKVNTVIAVKAGEVIPIDGVVVDGRSEVDESTLTGESFPVSKQPDSQVWAGTLNIDGYIAVRTTAMADNSAVAKMARLVEEAQNSRSSTQRLIDTCAKYYTPAVVVMAGSVAAIPAIAKAHNLKHWFQLALVLLVSACPCALVLSTPIATFCALLRAARTGLLIKGGDVLESLASIKVAAFDKTGTITRGEFSVEEFQPVGERVSLQQLLYWVSSVESRSSHPMASVLVDYAQSKSVEPKSENVSEFQIYPGEGIYGEIDGAGIYIGNKRILSRASCETVPDMKDMKGVTIGYVACNNELIGVFTLSDACRTGSAEAIKELRSLGIKSVMLTGDSSAAATYAQNQLGNILAEVHAELLPEDKVRIVGELKEKDGPTLMVGDGMNDAPALAKADVGVSMGVSGSAVAMETSHVALMSNDIRRIPKAVRLARRTHRTIIVNIIFSVITKLAIVGLAFAGHPLIWAAVLADVGTCLLVIMYSMLLLREKDSRKAKKCAASHHGSPKKCCSSSHHGSHAKKNHGVSHHCSDGPCKSMVSCKESSVAKNACHDHHHEHNHHEEPAHKHSSNQHGCHDHSHGHSNCKEPSNQLITNKHACHDGHNHCADTSNLHDTKKHDCHGHEHSTCKEELNALPPTNDHACHGHEHSHCEEPVALHSTGEHACHEHEHEHIHCDEPIGSHCADKHACHDHEQVHEHHCCDEQQTPHTADLHPCHDHDHDNLEVEEVKDCHAEPPHHHNHCCHEPHDQVKNDTHPVQEHSISIEESSDHHEHHHNEEHKAEDCGHHPKPKDCAPPPTDCISRNCCSNTSKGKDICSSLHRDHHTSQASRCCRSYVKCSRPSRSCCSHSIVKLPEIVVE

SEQ ID NO: 666 - protein, 607 aa, Oryza sativa
MSPPPPQRPSPSRAGRANLFSSPPPPLPNCYDPKHRRPAPPPLPSARRLPSNRRRRHDQPPNPTTGNGGNPAFRAPHLRTAYRKPVPPVAAAGEGEALLAADASDAADGRAVVVGPSGLSFRLPGAPFDFRFSYSECPRAPPVAIREPAFLPFAPPTMPRPWTGKAPLLTKEEKARRRGVRLHTPLGEEAPRTVSAHGIMMEVRGRRKLDLARVSPGDGRSREEVLGEPLTAAEVRDLVKPHISHNRQLNIGRDGLTHNMLEMIHCHWRRQEICKVRCRGVPTVDMKNLCYHLEEKSGGKVIHRVGGVVFLYRGRNYNPRTRPRYPLMLWKPATPVYPKLIQEAPEGLTKEEADEMRRRGKDLLPICKLAKNGIYIYLVRDVRDAFEGSDLVKIDCEGLNPSDYKKIGAKLRDLVPCVLLSFDNEQILMFRGKEWKSRYPKPLTLIPKIRKNNVPMSSDESSSDEATDDDDRLAVREVLRPKMFELWTNAIESSVALMLDDAEVDALTPDSLLTRVEDFSVTSQVVEHSFPAVLVANDESNPDVLNAEYTEDEPETGTLEPQQHEFTESSDVAEDDHFEDDMLKRLESSVPLGALPIDAVVKQLNDE

SEQ ID NO: 667 - protein, 490 aa, Oryza sativa
MAAKGSPEEEALLAGVGGDHQLVESDELAPAAAVVREEVKKQLWLAVPLVAGALLQNVIQMISVMFVGHLGELPLAGASMASSFASVTGLSLLLGMASALDTLCGQAFGSRQYHLLGVYKQRAMLLLTAVSVPLVVVWFYTGDILVAFGQDADIAAEAGAYARWMIPALFAYGPLQCHVRFLQTQNVVLPVMASAGAAALCHLVVCWALVYAAGMGSKGAALSNAVSYWINVAILAVYVRVSSSCKKTWTGFSMEAFHDPLSFFRLAIPSALMVCLEMWSFELIVLLSGILPNPKLETSVLSISLNTAAFVWMIPFGLGSAISTRVSNELGAGRPRAARLAVRVVVFMAVSEGLVIGLVLVGVRYIWGHAYSDEEEVVTYVAKMMLVIAVSNFFDGIQCVLSGVARGCGWQKIGACVNLGAYYIVGIPSAYLIAFVLHVGGMGLWLGIICGLLVQVLLLMAITLCTNWDKEAANAKDRVFSSSLPSDLAT

SEQ ID NO: 668 - protein, 466 aa, Oryza sativa
MAASPTGSSSSAPAAAAAAAAEATDGPTLSVVSKRLRALRKKHNRILQMEESLAGGRKLNKEQEGVLRSKPAVVALIDELERMRAPLAAALAEELSSRPAPSSSAAPPPPASSSAAGAADSSVVEDLLALIYFGTLFDLKPQTEFVATMVARAQERDCCITYDYVTEDAADLLHQSDLDKVSALAALAASRPAAAVGVSHRDALQSCAQHARLWLRRADEPIHPESSITYAAVRAKLDKIMASDYYTAQPEMPEMGAAVDLSAAVQESMVVSPEAPAVEESQAEGHKDEKEASEATEIYNDNQPNVADAQNVEDEAPVNPSEEFSAAEVEQEKFEADVEEQERNADQQFTSRRPYQNQRGGGGRGGGRRGYQNGGRGGRGGRGMGGGGYQNGRGGGGGGGYQNGRGGGEGGGYYYNEPGYYQQRGYSNRGRGGRSGGGNSYYNNQGGGSQGGGHAHPGRVELGANA

SEQ ID NO: 669 - protein, 341 aa, Arabidopsis thaliana
MAPTLQGQWIKVGQKGGTGPGPRSSHGIAAVGDKLYSFGGELTPNKHIDKDLYVFDFNTQTWSIAQPKGDAPTVSCLGVRMVAVGTKIYIFGGRDENRNFENFRSYDTVTSEWTFLTKLDEVGGPEARTFHSMASDENHVYVFGGVSKGGTMNTPTRFRTIEAYNIADGKWAQLPDPGDNFEKRGGAGFAVVQGKIWVVYGFATSIVPGGKDDYESNAVQFYDPASKKWTEVETTGAKPSARSVFAHAVVGKYIIIFAGEVWPDLNGHYGPGTLSNEGYALDTETLVWEKLGEEGAPAIPRGWTAYTAATVDGKNGLLMHGGKLPTNERTDDLYFYAVNSA

SEQ ID NO: 670 - protein, 307 aa, Glycine max
MRSIASCYNEHAIRVSDSYCSRPSNQAYLCPELNPSTRDSVTCMYKLSLIKTQKQLFITITWAKKLLGQGFTITISNSEHSLSPSNNKSNARQLRKNKGNETFQSQNFQVQVLWDLSDAKYEEGPEPVGGFYVDVLVDSELGLRLGDKNSSMEELLPNFDAKEATFSMVSRSETFSGTAVYATKAKFSQTGSSHDILIRCGAEAERGEPKGHVLSVCVDKKTMFQVKRLRWNFRGNQTIFVDGLVVDMMWDVHDWLFNSNSASSAVFMFRTRSGLDSRLWLEKSLHAHKEQDKIGFSLLICACKNND

SEQ ID NO: 671 - protein, 646 aa, Oryza sativa
MRPTAMLRWPAAAAALALVFLLLIAAAPPAAAFYLPGVAPNDFQKKDPLQVKVNKLSSTKTQLPYSYYSLPFCKPDTIVDSAENLGEVLRGDRIENSPYVFEMREPKMCQIVCKATISDKQAKELKEKIEDEYRVNMILDNLPLVVPITRPDRDDVVFQGGYHVGVKGQYAGSKDEKYFIHNHLIFLVKYHKDENSDLSRIVGFEVKPFSVKHQFEEKWNDANTRLSTCHPHANKIIINSDTPQEVEAGKDIIFTYDVGFEESDIKWASRWDTYLLMTDDQIHWFSIVNSLMIVLFLSGMVAMIMLRTLYRDISRYNQLETEEEAQEETGWKLVHGDVFRPPTNSDLLCVYVGTGVQFFGMLLVTMMFAVLGFLSPSNRGGLMTAMLLIWVLMGLFAGYASSRLYKMFKGSEWKSITLKTAFLFPGIAFGIFFVLNALIWGEKSSGAVPFSTMFALVLLWFGISVPLVFVGSYLGFKKPAIEAPVKTNKIPRQVPEQAWYMNPAFTILIGGILPFGAVFIELFFILTSIWLHQFYYIFGFLFLVFIILIITCAEIAIVLCYFQLCSEDYMWWWRSYLTSGSSAIYLFLYAGFYFFTKLQITKLVSGILFFGYMLLASFSFFVLTGTIGFCACLWFTRLIYSSVKID

SEQ ID NO: 672 - protein, 331 aa, Glycine max
MGKQSTPQFSALNCIDLSNPDINQSVNLLKEACLDSGFFYVVNHGISQEFMDEVFAQSKKFFSLPHNEKMKTLRNEQHRGYTPVLDELLDPENQVHGDYKEGYYIGVEKGEDDPQSKKPFYGPNNWPAPDVLPGWRETMEKFHQETLEVGKAVAKMIALALDLDANYFDRPEILGEPIAILRLLHYEGQVSDPSKGLYGAGAHTDFGLITLLATDDVPGLQICKDRDAKPQKWEDVAPLKGAFIVNLGDMLERWSNCIFKSTLHRVLGNGQERYSIAYFLEPSHDCLVECLPTCKSDSNPPKFPPILCQDYLTQRYEDTHADLKIYKKQQA

SEQ ID NO: 673 - protein, 508 aa, Zea mays
MGWLTKFFRGSTHNISEEQYHSRPAEDTAWNEPSSSPVVTDILSEFNNEDIDRAIALSLSEEEQRKEKAIDKDMHLEEDEQLARAIQESLNVESPPRRNGSANGGTMYHPPRETGNAYQPPRENGSANGGNAYHPLPFMFSSGFRACAGCHREIGHGRFLSCMGAVWHPECFRCHACSQPIYDYEFSMSGNHPYHKTCYKEQFHPKCDVCKQFIPTNMNGLIEYRAHPFWVQKYCPSHEMDGTPRCCSCERMEPRESKYVLLDDGRKLCLECLDSAVMDTNDCQPLYLEIQEFYEGLNMKVEQQVPLLLVERQALNEAMEGEKAGHHHLPETRGLCLSEEQTVSTILRPRMAGNKIMGMITEPYRLTRRCEVTAILILYGLPRLLTGSILAHEMMHAWLRLKGYRTLSPDVEEGICQVLAHMWIESEIMAGSGSSAASSSSGSSSSTSSKKGGRSQFEHRLGDFFKHQIETDTSMAYGDGFRTGNRAVLHYGLKRTLEHIRLTGTFPF

SEQ ID NO: 674 - protein, 380 aa, Zea mays
MAPAATSTASAPSSFHSTGRHRARVGARPSLVSLRVRAANPNVTADPAPAFQSVTTFAPATVANLGPGFDFLGCAVADASLSLGDTVTATLDPSLPPATVSIASVTSPSRPNLAERLSRDPLRNCAGVAAIAALRALGVRSHAVSIHLTKGLPLGSGLGSSAASAAAAAKAVDALFGSRLGRDDLVLAGLESEKAVSGFHADNIAPAILGGFVLVRSYDPFHLVPLSFPPALRLHFVLVTPDFEAPTSKMRAALPRQVDVQQHVRNSSQAAALVAAVLQGDAGLIGSAMSSDGIVEPTRAPLIPGMAAVKAAALQAGALGCTISGAGPTVVAVIQGEERGEEVARKMVDAFWSAGKLKATATVAQLDTLGARVIATSSLN

SEQ ID NO: 675 - protein, 381 aa, Sorghum bicolor
MSCFAHFFKRKRGPQQQDNPSNDYFKGSENITKYSYRELVRATSNFDQSNKIGEGGYGPVYKGTLKDGTAIAVKILSLHSRQGAKEFLNELLAISDVAHENLVKLYGCCIEGNHRILVYNYLEYNSLAHTLLGLGHSNIQFNWRTRVNICIGVAQGLAFLHDSVRPHIVHRDIKASNILLDKDLTPKISDFGLAKLLPPDVSHVSTRVAGTLGYLAPEYAIRGQVTRKADVYSYGVLLIEIVSGRCNTDTKLSYDDQILLEKTWRYYDRGDLEKIIDSSLGDDLDVDEACRFLKVGLLCTQDVTKRRPGMSTVVAMLKGEADVDTEMISKPDVIRDFGDLKQRSRATSSTLLTSIMARSSPLSSEETTRTSITFTEISERD

SEQ ID NO: 676 - protein, 651 aa, Zea mays
MQPIRRRHRGFALLCLSAALLAAATLLPGAAVAEGVTPSEARRLRDEVKDMFYHAFDGYMKYAFPLDELRPLSCQGEDSLGGYALTLIDSLDTLALLGDKEKFGAAVEWVGKNVHFDINKTVSVFETNIRILGGLLSAHLIASDYATGMRIQSYDDQLLHLAADLAQRLLPAFDTPTGIPFGSVNLLYGVDENESKITSTAGGGTLTLEFGILSRLTNNTVFERVTKKSVRGIWSRRSKLNLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGARCPCGYCHISDVETHKQDDHMESFFLAETVKYLWLLFDLAAGPDNIVENGPYKYIFSTEGHLLPVTPEIALEDEHCSYFGAFCNGGADHGYGASASSTKHRNGNYTQLDDIQTPSSHYSMSNVLFTPGYIKGVCPGLTHAQKFGISYSDEEDNFIEQTSESLDHHGESAIESSVQDQSSSIILISHPVASQQDEAFESESGSQDHANIVVTSDSDSDSTSRDNTVGSPGMNSEELMDDI

SEQ ID NO: 677 - protein, 508 aa, Zea mays
MEPTRLLLLLLVLGVSLQGCIAQGGGGAGGLTRGSFPKGFVFGTASSAYQYEGAVKEDGRGKTIWDKFAHTFGKVADLSNADVAVDQYHRFEEDIQLMADMGMDAYRFSIAWSRILPNGTGQVNQAGVDHYNRFIDALLSKGIEPYVTLYHWDLPQALEDRYNGWLDRQIVYDFAEYAETCFEAFGDRVRHWVTLNEPHTVAVQGYDAGLQAPGRCSLLLHLYCRSGDSATEPYVVAHNFILAHAKVSDVYRKKYKAAQNGELGIAFDVMWFEPMTNTTADIEAAKRGQEFQLGWFADPFFFGDYPASMRSRVGDRLPRFTAAEAALVKGALDFVGINHYTTYYTKHNSTDLVGRLLHNTLADTGTISLPFRNGKAIGDRANSIWLYIVPSGMRSLMNYVKERYNSPPIYVTENGMDDGNSPFTSIKDALKDSKRVKYHNDYLTNLAASIKDDACDVRGYFAWSLLDNWEWTAGYSSRFGLYFVDYKDNLKRYPKSSVQWFKNLLASS

SEQ ID NO: 678 - protein, 359 aa, Zea mays
MAPLSPTPASASAPVSSSPRSLVPDASAAPMRPASPPQELPAAGGEIQAALAPANASTAGARGGGGSFTALLGLPTSQAMELLLPRTTPPALATAPAPTFPSDPHLVDRAARLSTFAPPSPSPSSTSPARPLPAAANAGKRKADPVDRASKGKAAKKGKTAEEKLAGGDGDDEKPAYVHVRARRGQATDSHSLAERARREKINARMELLKELVPGCSKVSGTALVLDEIINHVQSLQRQVEYLSMRLAAVNPRVDFGGLDSFLTTECGRIAGFNCKNGIDLEQVTWPEMGVHGARQLMQLQQQFWHGDLTHPHQVASQWEKRGDGHPPVFSNSSPSLFGYDLTSSGAQQTPASKLKTEL

SEQ ID NO: 679 - protein, 1480 aa, Oryza sativa
MASSAEAAAAMAAAPSASGRRSMSWGSSISQSFRQAEADDPFGRAASQQGHDDDEENLRWAALEKLPTYDRMRRGVIRTALLHHDGGGDGGGAAAAAKDGRMELVDIQKLAAGNLGRALLDRVFQDDSERFLRRLRDRIDMVGIELPTIEVRYEQLSIQAEVFVGSRALPTLTNAATNVLQGLIGRFGSSNKRTINILQDVSGIIKPSRMTLLLGPPSSGKSTLMRALTGKLDKNLKVSGDITYCGHTFSEFYPERTSAYVSQYDLHNAEMTVRETLDFSGRCLGIGARYDMLAELARRERNAGIKPDPEIDAFMKATAVQGHKTNITTDVTLKALGLDICADIIIGDEMIRGISGGQKKRVTTGEMLTGPARALFMDEISTGLDSSSTFEIVKYIGHLVHVMNETVMISLLQPPPETYNLFDDIILLSEGYIVYHGPRENILEFFENAGFRCPERKGIADFLQEVTSKKDQQQYWYHDQERYRYVSVPEFAQRFKSFHVGQKMQKEMQIPYDKSSTHPAALTTTKYGLSSWESLRAVMSREWLLMKRNSFIYIFKVTQLIILAFMSMTVFLRTKMPSGTISDGTKFLGALTFSLITILFNGFAELQLTIKKLPVFYKHRDFLFFPAWTFGVANILLKVPVSLVEAAVWVVLTYYVMGFAPSAGRFFRQFIAFFVTHQMAMAMFRFLGAILKTMVVANTFGMFVLLIVFIFGGFLISRNDIKPWWIWGYWASPMMYSQQAISINEFLASRWAIPNTDATIDEPTVGKAILKSKGLITSDGGFWISIGALIGFLVVFNILYILALTYLSPGGSSNTIVSDEDSEDKTDMKTRNEQQMSQIVHNNGASNTSATSSIPMSGSRSTNQQSRSQIVLPFQPLSLCFNHVNYYVDMPTEMKEQGFTESRLQLLSDISGVFRPGVLTALVGVSGAGKTTLMDVLAGRKTSGVIEGDITLSGYPKKQETFARISGYCEQTDIHSPNVTVYESILYSAWLRLSSDVDTNTRKMFVDEVMSLVELDVLRNALVGLPGVSGLSTEQRKRLTIAVELVANPSVIFMDEPTSGLDARAAAIVMRTVRNTVNTGRTVVCTIHQPSIDIFESFDELLLLKRGGQVIYAGELGRHSHKLVEYFEAVPGVPKITEGYNPATWMLEVTSPIAEARLNVNFAEIYANSELYRKNQELIKELSTPPPGYQDLSFPTKYSQNFYSQCIANFWKQYRSYWKNPPYNAMRYLMTLLNGLVFGTVFWQKGTKISSQQDLFNLLGATYAATFFLGAANCITVQPVVSIERTVFYRERAAGMYSSLSYAFAQACVEVIYNILQGILYTIIIYAMIGYDWKADKFFYFMFFIVASFNYFTLFGMMLVACTPSAMLANILISFVLPLWNLFAGFLVVRPLIPIWWRWYYWANPVSWTIYGVVASQFGKNGDVLSVPGGSPTVVKQFLEDNLGMRHSFLGYVVLTHFGYIIVFFFIFGYAIKYFNFQKR

SEQ ID NO: 680 - protein, 222 aa, Triticum aestivum
MKKSVVLYPGVGVGHLVPMVEVAKLFLKHGLAVTVVLIDPQVESTDFSSAVARARASNPSVAFHVLPTPPADSNSDTAPTNPVVQIFRLLKSMNAPLLDFLRSLPSVDALVLDMFCVDAQDVAAELKLPVYYFYASAAADLALFLNLPTMLAGSKVKELGDSIITSPGVPPLKASDLPEVTHNDEVLKTILGMFDRMPDSNGILIISFRVVENRGVLALRDG

SEQ ID NO: 681 - protein, 447 aa, Glycine max
RMLRSTPIPAPYNSVPVLSRARTCHSLAPARAVHSHSSFVSRLVFPQFRQYIVNVPGRVFVAAAAKKQRRGGAELAVTDDGFDDDEEYDDDDFYDEYDDDDDDEEEEFDDDEDDEGMLSLEKMNKWFEKKPRGFGEGKVYDTSVEDKLLEEMRQSRIAQAENLKKLMSNPVKHASNESVQKKKDAELVPIGGRVCLVNLPKKKNIHKDLKSALQGIPGIINIVPAVTGNKKTRDPICKGFAYVDFKREEDAVRFVELYTGQTITFGKIQKQIKCELLNVQSSSSLKLSKNLSAAPQLVAAAFEEDSNEDSNLDGSARSSWDETNSSDDLDDLDYQMNGEEQEDDEDNQESVTALGVDHDDNVEMRIDPENISLPSEQVDRNPAAVQKSSAKVKQENARKKKPISKEKTKKVLDVPGSSRRLKIREKAVLSEVFSKYGLKATLASKDN

SEQ ID NO: 682 - protein, 308 aa, Hordeum vulgare
DNTDVTCEPTGHQTRPRRSATRYSNLSERKKKGSTGRKKKERKKKGSTEDEMSELPIYLEPKDDGLPFADENQPEGGALWDIFRREDASKLHEYLTKHSEEFRHYNYESVKQVIHPIHDQCFYLTNEHKRKLKEEYGVEPWTFEQKLGDAVFIPAGCPHQVRNLKSCIKVALDFVSPENLQECIRLTEEFRLLPKGHRVSEDKLEVKKIAFHAIKKAIHYIKKKPEDKSSDDEVQDKPVPRKRKPGPKKGKLGRPKKGKTGPVEPAEPEEHEEQSAQEMSPVEDEGAEMEADQGQSALDMCEAKPGTS

SEQ ID NO: 683 - protein, 88 aa, Zea mays
MSLRPSEREQMRKGNYKQTVDAEESRRRREGQMMDMRKAKREESLQKKRCDGFPASAAGVPPMGHSTALQQKSPNRRGDQHRSGVAIH

SEQ ID NO: 684 - protein, 386 aa, Pennisetum glaucum
YKAVMHYLHHDPWYVEVNMNSGATVWPLFNSLQAFWPGLQVLAGDVDPAIRTHAAFFSVWKKYGFTPEGFNLATSSVQNGQRSYPLRPELIESTYWLFKATRDYRYLDVGRDILASLQYGARCPCGYCHISDVETHKQDDHMESFFLAETVKYLWLLFDLAAGPDNIVENGPYKYIFSTEGHLLPITPEIALVDEHCSYFGAFCNGSADHGYGTSASSMKHKKANYTHLDDIETASSHYSASNMFATRGYIKGVCPGLTHAQKLGISYSDEEGSDIEQTSDGHEHHDESTIESSAQAQSSNIILISHPVASQQDQALESRSGHGDHADIVVTADSDSDSVSDSMSHDNNDGSLGANTEQLIEDTKRTSKHSEDEDIAQNLKLEDIS

SEQ ID NO: 685 - protein, 947 aa, Sorghum bicolor
MAETALGMATTLVGSALRVASSAAKEEDEPAAWGARPHLRKMLAPTTSKRFISDELKMMQAFLRAADGARENIGVLKAYSELIRDLAYDIEDSLEEFMVFIKNKSLVKQLLSLRERHRIAVQIRTLKLRVQEVSQRNTRYNAIKLTPSTSTNVIGDTEFTRNFTALNVEEAQLVGLDEPKKKLMELIGILDEPKEHESSNTGPRVVSLVGMGGIGKTTLTKKVFDSNDLSDKFGTRAWITVSQSFEQKEIFKEMVKHLFGAELLHKLLEDHQGQQVTFQDSGKDDSCVVVTTRNQTLAKYCSPPSHIHQPDFLGKEEARTLFLKKTNRSLDELEKGDKTKGIVEKILNKCGGLPLAILTIGAVLANKDTEEWENIYMQLPWDLANNPSLDALRRVVSLSYNHLPSRLKPCFLHLSIFPEDFEIEKKHLVNRWVAEGLVADDTTTITLEEVAENYFYELISRSLIQPSKLDILGNVKTCRVHDIVHDIAVSISRQENYAFIHGEHTSNISTRVGIRHLSCVASRKLNTAMDLSCVRSLTAFSKPLELKSLVWSSKFKMLRILDLKHAGFTAIQQDIKYIGLLLHLKYLHFPKRINSSVYALPKSIGNLLGLQTLDLQRSSVSTLPIEITKLHNLRSLRCSKVPNYVYFNPAQPATEWFTDAIECLTSESGATADLHMALSSCWSNSSGIKLPKGVGRLKELQILEKVDIKRTSRKAIKELGELTQLRKIIVRGRGASKKNCKAFCEAAPKLCSLRSLNVSTMESKKAAEALDVVVSFTSPVPSLERLKLKGLLQKIPAWVGECENLVKVDLKYCQLKELVALAELRNLVQLRLKKDAFDAENLVFHEHGFPKLRILIIKDHYVMALKEVTFEQSSSPNIETIGIFHCHLEAGINGIKHLPKFKKICINNNDLGKQSSMLQEEVENHTNHPVLQIIPGSAFDPGQNLYS

SEQ ID NO: 686 - protein, 324 aa, Vitis vinifera
PDGQAVAVKQHKLASSQGDVEFCSEVEVLSCAQHRNVVMLIGYCIEDRRRLLVYEYICNGSLDSHLYGRHRDPLEWSARQKVAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIDELVDPRLGNCYSEQEVYCMLHAASLCIRRDPHARPRMSQVLRILEGDMVMDSNYMATPGYDVGSQSGRIWSDQHQHYSGPILNEAYEEFSGKLSLEALRSAFWEKDKGRRTSSEDKL

SEQ ID NO: 687 - protein, 523 aa, Triticum aestivum
MAGLRLLVGALWLLAVLRQGAAAEAGAVSVDGRRAIASTGEDFVCATLDWWPPDKCDYGTCSWGRASLLNLDLSNKILLNAIKAFSPLVLRLGGSLQDKVVYGTADRPGPCAPFNKSKSEMFGFTQGCLPMPRWDDLNAFFEKSGAKIVFGLNALNGRVPLQGGAMGGNWDTTNAASFIRYTAGKGYKIYGWELGNELSGTGVGTKVGVAQYVKDAIALKTTVDAIYRGSPEKPLVLAPGGFFDARWYGELIAKTKPDMLNVVTHHIYNLGAGVDRDTQLMDRILNPKTLDGMAGPFRDLQGLLKAAGTSAVAWVGESGGAYNSGHHLVTDAFVFSFWFLDQLGMSAKFDTKSYCRQSFIGGNYGLLNTTTFQPNPDYYSALLWHRLMGTKVLEAKFTGTNMVRAYAHCAKHAPGITLLLINLHVNATNHVSVAGRGAHAGRKHGGRFAQPPGAAREEYHLTPEGGNIQSQVMLLNGRALAAGADGSIPGMEPVKVDAARPIAVAPRSIVFVHMPDYHAPACA

SEQ ID NO: 688 - protein, 318 aa, Triticum aestivum
MAMAEQQQQIEHSHLAIRGLNLHVAQAGTGELGTVLFLHGFPEIWYSWRHQMLAVAAAGYRAIAPDWRGYGLSDQPPEPEAAVYRDLEEDLLAVLDALSVPKAYLVAKDFGAMPAYDFALRHPNRTCGVMCLGIPFLHGGSSFTAMPEGFYILRWREPGRAEADFGRYDVKRVVHTIYILFSRSEIPTAKEDQEITDLADLSTPLPEWFTEEDLAVYTSLYEKSGFVYPLQMPYRSLHKRQPIEDPKFEVPVFVVMGEKDYVIKFPGVEAVLKNGTMEKFAPDLKITYIPEGSHFVQEQFPDKVNELLLGFLKDHPVA

SEQ ID NO: 689 - protein, 543 aa, Triticum aestivum
MARCGVEVIASRGCSRLILPGMQPSSASAASSSVSASRSAAAARRPPDGPFAGLVVCVTGLSKEARSQVKEAAERLGGEYSGSLHPKCTHLVVQSFAGRKFEHALKHGPRMAFVVTLGWFVDCVRRNMRLDESLYSIKNIGENGLLLGESNRLVGLPVNEKSCLPPMIFQDKACSDTTHKRQLQAHREEPEDDVFVFTNDTIYIDPGISGEMKKKISDAATSEDAKLLDHWFIGCHATYVVCEDASVKRYVGHSDNIVTPFWILKTVKEKNLQRLVHLSSDLARHVAVVLENFHTSRENTKLGSVPSLNSSELPTQGEIDETHQERQKFVEAAKKDIRDRRVRRMQSCEVPIHPLTPVTLLDSICWTISEPVSSASIYMDSSWSEDADEQQSTTYFDADGDGKDRDQSADNLSRPLRESERSEVIFKNHFFTILFPLDRFGELGPSSRTFFSNGGFTREQVLDHIYNFYQENMSTDEINVALHTDSRHADRLRSLYASAECAERGFVVAFKRIDFLGSRRSFEALKRLSRENNSNVYELVIRA

SEQ ID NO: 690 - protein, 350 aa, Triticum aestivum
MGAQRALLASFLLAALVTQAFVSVSARTGPTDKASQDDVKKPDCVPSLDPHNFPGHGGTTVPLPSHGGSSGTPPYHGGSGTTPSHGGSGSTPSHSGSGSLPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSVTPTPLVPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAAAGGSDSAAAAQAAAFKKAHEGRKAPPPPLAIERALASWLPISVACLHACV

SEQ ID NO: 691 - protein, 166 aa, Triticum aestivum
TFIAVWFVGGLSVFHLYLMSTNQTTYENFRYRYDQRANPYNRGVVENIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 692 - protein, 352 aa, Triticum aestivum
PDAIVADTYLQWAVAAGARLGVPVCSLWTQPATFLLALCHLDLWRPAVEGFSEEELSRKSLEQYVPGLSSVRLSDVKIFLAWEGPIKISAEVFVKVRKAQCVLFTSFHELEPSSMSKIAELLPCPIYPIGPSILRAPDNEENARDEEHRRWLDAQPQNSVLYVSFGSFVAMPPKQFEEIAVGLRDSAVRFFWVARDRATDGLREMCGDRGLPVPWCDQQEVLRHPSVGGFLSHCGWNSVLEAVCAGVPVLGFPVAWDQLVNARMVADEWKAGIDLREQRGKDGIVSRAAVSAAARKLMDLDSGAGQEMRTRAAQLREASRGAVIEGGSSHRSLTGFLEDLGKGKLDVPESSA

SEQ ID NO: 693 - protein, 351 aa, Triticum aestivum
MKCLLFTSAVAVVLALFPVAAVGAGLKVGFYSKSCPSAENLVQQAVAAAFKNNTGVAAGLIRLHFHDCFVKGCDGSVLIDSTANNTAEKDAPPNKPSLRGFEVIDAAKKAIEAKCPKTVSCADILAFAARDSVALAGNVTYKVPAGRRDGRISTNASALSNLPSPLSTAAELVGNFTLKNLTAEDMVVLSGAHTIGVSRCSSFTNRLYAFSNTSQVDPTMSSAYAFLLKSICPANSSQFFPTTTTDMDIITPTVLDNKYYVGLTNNLGMFTSDQALLTNSTLKASVDEFVKSEKRWKSKFVKSMVKMGDIEVLTGTQGEIRLSCRVINKGSAGLEINNGPDYGEFAEIATS

SEQ ID NO: 694 - protein, 351 aa, Triticum aestivum
MKCMLFTSAVTVALALFPVATVGAGLKVGFYSKSCPSAENLVQQAVAAAFKNNTGVAAGLIRLHFHDCFVKGCDGSVLIDSTANNTAEKDAPPNKPSLRGFEVIDAAKKAIEAKCPKTVSCADILAFAARDSIALAGNVTYKVPAGRRDGRISTNASALSNLPSPLSTAAELVGNFTLKNLTAEDMVVLSGAHTIGVSRCSSFTNRLYAFSNTSQVDPTMSSAYAFLLKSICPANSSQFFPTTTTDMDIITPTLLDNKYYVGLTNNLGLFTSDQALLTNSTLKASVDAFVKSEKSWKSKFVKSMVKMGDIEVLTGTQGEIRLSCRVINKGSAGLEINDGPDSAEFAGIATS

SEQ ID NO: 695 - protein, 444 aa, Triticum aestivum
SNQTYKPPPIFGPYFFIADPYVPFLVAGGKKSKFSTAAVAGIAVAGGVLVIALILVGLFALRQKRRNKELKERSTDPFASWGAAQKDSGGAPQLKGARFFSFEELKSCTDNFADSHEIGAGGYGKVYKGTLVDGIRVAIKRAQSGSMQGAPEFKNEIELLSRVHHRNLVSLIGFCFQQGEQMLVYEFVAGGTLRENLVVRGTYLGWKKRLRIALGSARGLAYLHELADPPIIHRDIKSTNILLDENLKAKVADFGLSKLVADTEKGHVSTQVKGTLGYLDPEYYMTQQLSEKSDVYSFGVVMLELVSGRQPIEKGKYVVREVRQAIDPADRDYYGLRAIVDPAIRDAARTPGFRRFVQLAMQCVDESAAARPTMGTVVKEVEAMLLNEPDGEGSNSAGSSATEFDGAGRGAPSHPYSDVEITRSSYGGAGEASDYMPYFEVKPK

SEQ ID NO: 696 - protein, 752 aa, Sorghum bicolor
MVQCTQPPPQLKLPESKITELTDDENHDSPPKLEKRTRMHHIERHRSCVVTLSDIELNGLQPRRLLQTIEKSPGGGSQCSLHEETPTDTNASHRHAIADAAWEALKRSIVYFRGQPIGTVAAIDKSQGAALNYDQVFMRDFIPSALAFLMKGEHLIVKNFLVETARLQSREKMVDLFKLGQGVMPASFKVHHRNPTQKTESLLADFGETAIGRVAPVDSGLWWIILLRAYTKWTGDNSLAESPNCQRAMHLILRLCLSEGCDTSPALLCADGCSMIDRRMGIYGYPIEIQALFFMAMRCALSLLKQDSDADFVNHITKRIQALSYHLHSYYWLDFQRLNDIYRYKTEEYSQTALNKFNVIPESIPDWIFDFMPSRGGYFIGNVSPARMDFRWFCLGNFIAILSSLATGEQAEAILDLVEERWQELIGEMPLKICYPAMENQEWQIVTGCDPKNTRWSYHNGGSWPVLLWLLVAVSVKLGRPHLARRAVELMEQRLAKDDFPEYYDGKAGRYVGKQARKFQTWSPASLLPFPCRRAGRLVCATAAGEAPPVEVEQRDEAEPAPAAASNGAAVKAEAPAPKAVQAEAPPAPAPVPAFRDARWVNGTWDLTQFDKGGVVDWDAVIDAEARRRKWLEDYPEATSTDEAVVFDTSIIPWWAWMKRFHLPEAEKLNGRAAMVGFFMAYFVDSLTGVGLVDQMGNFFCKTLLFVAVAGVLLIRKNEDIESLKKLIDESTFYDKQWLATWQDDSTGGPKN

SEQ ID NO: 697 - protein, 244 aa, Hordeum vulgare
ARGRELVFFEGSSYNFDLEDLLRASAEVLGKGSFGTTYKAVLEDSTTVVVKRLKEMVVGKKDFEQQMEIVGRIGQHQNIVPLRAYYYSKDEKLLVYDYVPAGSLAAVLHGNKATGRAALDWETRVKISLGVARGLAHLHAEGSGKFIHGNLKSSNILLSQNLDGCVSEFGLAQLMTTLPAPARLIGYRAPEVLETKKPTQKSDVYSFGVLLLEMLTGKAPLRSPGVRIPSSTCRGGCSPLSGRS

SEQ ID NO: 698 - protein, 141 aa, Hordeum vulgare
MLQWVRDNMDFNSTRVFFTSMSPTHGKSQDWGDAQGGNCYNETAMIEDAEYWGTDARRSVMRVIREILDGDGADVPLTFLNVTQLSMYRKDAHTSIYKKQWNPLTPEQVADPRTYADCVHWCLPGLQDTWNELLYSKLFYP

SEQ ID NO: 699 - protein, 271 aa, Triticum aestivum
RLLIPSRVHRLLGIPSNTMTSVAAAVALLRLPLAHLSSHLRSLPSRPVPSARLRLSAPHRPLCSLLTSGHGLAVAAVSEAVVAADEEEFEATEEQQEEAPPSFVLPRLPRPKLDVKERKELASYAHGLGKKLKSQQVGKGGVTPNLVTAFTDNLESNELLKLKIHGNCPGELPDVIRQLEESTGSIAVDQIGRSVILYRPSSSKMKKREEVARNREEYARNNPRFGKSENAFEERPRNNSAGRRFVKSGSTFRTQQKRRPVASKGSSYSRG

SEQ ID NO: 700 - protein, 121 aa, Triticum aestivum
PRVRGDGRRMSGIVGTPYYVAPEVVAGREYGEKVDVWSAGVVLYMTLSGSVPFYGATAPEIFEAVLRGNVRFPPRAFAGVSPEAKDLMRRMLCKDVSRRFSAEQVLRHPWIASCGGDAVAG

SEQ ID NO: 701 - protein, 280 aa, Brassica juncea
MAPTLQGEWIKVQQKGGEGPGARSSHGIAVVGDKLYSFGGERTPNISIDKHLYVFDFNTHTWSIAPANGQAPNVQALGTRMVAVGTMLYLFGGRDEKKQFDDFYSYDTVKQEWKFITKLDEEGGPEARSFHSMASDAENVYLFGGVSKTVRLKTPFRFRTIEAYNIADGKWAQLPDPGEQFPRFERRGGAGFIVVEGKIWVVYGFATSPDPNGKNDYESDLVHYFDPATQKWTEVETKGEKPSPRSVFAHAAVGKYIIIFGGEVWPDPNGTFGVPEHLDQ

SEQ ID NO: 702 - protein, 364 aa, Triticum aestivum
RPRVRYHWDLPQALEDKYNGWLDRQIVDDFAEYAETCFAAFGDRVKHWITVNEPHTVAIQGYDAGLQAPGRCSVLLHLYCKSGNSGTEPYIVAHNFILAHAAVSQLYRTKYKAAQNGELGMAFDVMWYEPMSGAAIDVEATKRAQEFQLGWFADPFFFGDYPATMRKRVGERLPRFTAEEAALVKGALDFVGINHYTTYYTRHNDTDIIVRLLNDTLADTGTISLPFKNGRAIGDRANSIWLYIVPRGMRSLMNYVKNRYNSPPIYITENGMDDSNSPFIALKDALKDTKRIKYHNDYLTNLAASIKEDGCDVRGYFAWSLLDNWEWAAGYTSRFGLYFVDYNDKLKRYPKSSVQWFKSLLRSS

SEQ ID NO: 703 - protein, 857 aa, Sorghum bicolor
MGAAQLVILFLALGAAMRAASAAGARPSEVTVGALFTYDSTIGRAAQLAIELAVDDVNADGKVLPGTQLNLVPQDTNCSGFIGTIEALRLMEKSVVAVIGPQSSGIGHVISHVVNELHVPLLSFAATDPTLSASEYPYFIRTTISDYFQMNAVASIVDYYQWKRVTAIFVDDDYGRGGMEALGDALALKRAKISYKAAIPPNSNTDVINDVLFRANMMESRVMVVHVNPDTGMRIFSVAKNLQMMASGYVWIVTDWLAAVLDSSAYRDLKDMGHIQGLIVLRQHIPESEAKDKFISKWNDVARNRSITSGLNSYGFYAYDSVWAVARAVDKFLSSGQQINFSTDPRLQNLNDSTLHLSTLKIFDGGEQMLQQLLLSKFTGVTGPVQFDSDHNLVRPAYDILNIAGSGSRLIGYWSNYSGLSVAAPEILYQMPRNTSTSAQQLHDVVWPGDSTTKPQGWIFPNTGQPLRVGVPIKASFKELVSGRGDNMSGYCVEIFNAAIKLLPYPVPYQFITIGDGTKNPSYIDIIRMVAANSLDAAVGDFAIVRNGTQLAEYTQPYIESGLVIVAPVKHVTSSAWAFLEPFTLEMWCVTVALFILVGVVVWLLEHRTNEEFRGSPRRQVITMLWFSFSTMFFAHRENTVSTLGRFVLIIWLFVVLIITSSYTASLTSILTVQQLSTGITGIDSLVSSSLPIGYQNGKFTKRYLSENFNVPLSRLVPLNTIQEYADALNRGPKYGGVAAIVDEKPYIDIFLSNYCKFRIVGEEFTKEGWGFAFQRDSPLAADLSTAILQLSESGQLQRIHDEWFSRSSCSSDDSEVGATRLGLGSFWGLFLVCALICLFALLAPFELSSDLLLHDV

SEQ ID NO: 704 - protein, 191 aa, Solanum lycopersicum
TIHQPSIDIFDAFDELLLLKRGGEEIFVGPLGRHSSHLIKYFEGIDGVLKIRDGYNPATWMLEVTSLAQEAVLGIDFTELYKNSELYRRNKALIQELSVAAPGSKDLYFETEYSQSFFTQCMACLWKQHLSYWRNPPYTAVRLMFTFFVSLMLGTIFWGLGSKRGRQQDILNAIGSMYSAILFLGIINATS

SEQ ID NO: 705 - protein, 233 aa, Hordeum vulgare
GKLVWRHTPWLGSHAAKGPVRPLRRALQGLDPLTAASMFAGARCIGERKVNGEDCFILKLCTDPETLKARTEGLAEIIRHVMFGYFSQRTGLLVHIEDSHLTRIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGEKNKFGPPHGHRAKVAALEKTDGDELAWRGTRT

SEQ ID NO: 706 - protein, 63 aa, Hordeum vulgare
MIRRRMGALHVGEPRVIFHQQVGKNGGGHGAVVKEIHGLIRVYKDGHVERLPAIPDVPCTWGS

SEQ ID NO: 707 - protein, 61 aa, Glycine max
IAPFVIKTYNMVNDPTTDKLITWGPANNSFIVLDPLDFSHSLLPTFFKHNNFSSFVRQLNT

SEQ ID NO: 708 - protein, 88 aa, Hordeum vulgare
MLACHLLSPADYSPNAKFISVLSPADYSPAVTCRMVSCFISVLSPADYSPNAKFISALVADLLSLLLIYVHLRHALGHSAVSVILQIL

SEQ ID NO: 709 - protein, 126 aa, Hordeum vulgare
ILIDPIGSHVGRRPPAAAPRSIYTPERRRTPSPIIHCPGTPPHTRSVRPSIPARRPSATLPCNPASVVRRSSSLLPCGQLRLLPLHGVLRLWGELPLQPPSRSSCRGMWHASRANDELNNYQIYLI

SEQ ID NO: 710 - protein, 512 aa, Sorghum bicolor
MASVRIRGAAAAAPPASVEPERRAGGTLPLQLAHLDGRFYHQSTTLTLWFIEPGPSTLAKASQPTSQSRQGASVLCAAALSSRPPSTSTPSRTEKRSVSVSCPRIKRAPPAAACPPARPHRHGSRRPHAPLPASTDLHFCARTTRLDIPRRREREGPCLRTRRRPSLALHRGHLLLALPPRRLVLRRRRWLLQLRIPVLFRCCRCRRRCGGGGGPPGDEIALQLPELRRLLDALRASRGKGAEGADGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAGSAADPDTTLVVYMGLSTLPSLAPKLMKHGLPPDTPAVAVERGTTPQQRTVFSLLKDLVDEVKSADLVSPTLIIIGKVVSLSPFWVESSEHYALKIESSYTNETR

SEQ ID NO: 711 - protein, 220 aa, Solanum lycopersicum
KLCRLFQVDIFRDAAALMVNYIDEIRSQGFEIDYLNIGGGLGIDYYHAGAILPSPRDLINTVRELVLSRNLNLIIEPGRSLIANTCCLVNRVTGVKTNGTKNFIVIDGSMAELIRPSLYDAYQHIELVSPPPPEAAIAKFDVVGPVCESADFLGKDRELPAPSRGTGLVVHDAGAYCMSMASTYNLKMRPPEYWVEEDGSLSKIRHGETFEDHLRLFEGL

SEQ ID NO: 712 - protein, 1206 aa, Arabidopsis thaliana
YVPNTSLNLYLIAPNQFFRIGFFLLLLALLSSPKMALQNKEEEKKKVKKLQKSYFDVLGICCTSEVPIIENILKSLDGVKEYSVIVPSRTVIVVHDSLLISPFQIAKALNEARLEANVRVNGETSFKNKWPSPFAVVSGLLLLLSFLKFVYSPLRWLAVAAVAAGIYPILAKAFASIKRPRIDINILVIITVIATLAMQDFMEAAAVVFLFTISDWLETRASYKATSVMQSLMSLAPQKAIIAETGEEVEVDEVKVDTVVAVKAGETIPIDGIVVDGNCEVDEKTLTGEAFPVPKQRDSTVWAGTINLNGYICVKTTSLAGDCVVAKMAKLVEEAQSSKTKSQRLIDKCSQYYTPAIILVSACVAIVPVIMKVHNLKHWFHLALVVLVSGCPCGLILSTPVATFCALTKAATSGLLIKSADYLDTLSKIKIVAFDKTGTITRGEFIVIDFKSLSRDINLRSLLYWVSSVESKSSHPMAATIVDYAKSVSVEPRPEEVEDYQNFPGEGIYGKIDGNDIFIGNKKIASRAGCSTVPEIEVDTKGGKTVGYVYVGERLAGFFNLSDACRSGVSQAMAELKSLGIKTAMLTGDNQAAAMHAQEQLGNVLDVVHGDLLPEDKSRIIQEFKKEGPTAMVGDGVNDAPALATADIGISMGISGSALATQTGNIILMSNDIRRIPQAVKLARRARRKVVENVCLSIILKAGILALAFAGHPLIWAAVLVDVGTCLLVIFNSMLLLREKKKIGNKKCYRASTSKLNGRKLEGDDDYVVDLEAGLLTKSGNGQCKSSCCGDKKNQENVVMMKPSSKTSSDHSHPGCCGDKKEEKVKPLVKDGCCSEKTRKSEGDMVSLSSCKKSSHVKHDLKMKGGSGCCASKNEKGKEVVAKSCCEKPKQQVESVGDCKSGHCEKKKQAEDIVVPVQIIGHALTHVEIELQTKETCKTSCCDSKEKVKETGLLLSSENTPYLEKGVLIKDEGNCKSGSENMGTVKQSCHEKGCSDEKQTGEITLASEEETDDQDCSSGCCVNEGTVKQSFDEKKHSVLVEKEGLDMETGFCCDAKLVCCGNTEGEVKEQCRLEIKKEEHCKSGCCGEEIQTGEITLVSEEETESTNCSTGCCVDKEEVTQTCHEKPASLVVSGLEVKKDEHCESSHRAVKVETCCKVKIPEACASKCRDRAKRHSGKSCCRSYAKELCSHRHHHHHHHHHHHVSA

SEQ ID NO: 713 - protein, 1297 aa, Solanum lycopersicum
KINNDINKLSKSYFDVLGICCTSEVVLVEKILKNLDGVREVSVIVTTKTVIVTHDALLISQQQIVKALNQARLEASIRVKGLQNYQKKWPSPFAIGSGILLALSFLKYFYQPLQWLALVAVAVGIPPIIFRGIAAIRNFTLDINILVLIAVAGSIVLHDYWEAATIVFLFTIAEWLESRASHKANAVMSSLVNIVPPTAVLAENGEVVNVDQVKLNSVLAVKAGETIPIDGIVVEGECDVDEKTLTGESFPVSKQKDSTVWAGTTNLNGYISVKTTALAEDCAVARMAKLVEDAQNKKSKAERYIDKCAKYYTPVIVVIAAGFAIVPTALRVHNLKEWYRLALVALVSACPCALVLSTPVAMCCALSKAATSGLLFKGAEYLETLAKIKIMAFDKTGTITRGEFAVTEFRSLIDGLSLNTLLYWVSSIESKSGHPMAAALVDYAQSNSVEPKPDRVEQFQNFTGEGIYGRIDGMEIYVGNRKISSRAGCTTVPEIEGGDSLQGKSVGYIFLGSSPAGLFRLSDVCRTGVKDAMRELKQMGIKTVMLTGDCYAAANHVQDQLHGALDEFQAELLPEDKATIIKGFQKEAPTAMIGDGLNDAPALATADIGISMGISGSALAKETGHVILMTNDIGRIPKAACLARRVRRKIIENMIIAIGTKGAIVALAIAGHPLVWAAVLADAGTCLLVILNSMLLLRGATRRHEKKICKSSTSSHAHHHKDKASCCKSEKTPQQCCSDIESQKECRKKSCSSEVCVQRCQPIPSGSTSCVNDQRSDSTQNNGHQSHSHPQCCSSKMSVTACQSAVSESKSCGSNNCSDSIRKSSCHSSTNSLISSSDLSAPQCHSATSSSKSCGGTKRSNLSDKSCCRSLEIPQTCSTKKAAHGCYSEVSGPKSCGNSKCSDSTDNNIHHSHSDRQTCTSKVCAPQSPSATSSSMTCGNTKCSDTTSKISCHSHANSEPCSSKKSGPTCQNANSGSRSCGNHKCQDSATEHGVHSLTDPLSEEVILKQKILVLESNHDLSHGCCEEEHDHHPNLDKAYDSCALQECHYSVQGDITDISKTGIQETSHCDSTNQTCQTVISGSMIFGDNKSLDSVDIHECHSHAHPPHKEEPHHSVGHGCSDKEHDHSHPEKAFDSCATQECCFSVQDHSIDISENGSQGTDHCDSIKQSMVIPCSCKHTPQEKVSHCGFHSTTIPTDEELAKLVRRCCDYRPCHNVRSGCRNHATECGPTTRSTINILRDNHHHHHLDCSGRKVCSPIEKRHIGGCCESFRKECCPKNINHFASSFGGGLSEIVLE

SEQ ID NO: 714 - protein, 629 aa, Oryza sativa
SVLVDYAQSKSVEPKSENVSEFQIYPGEGIYGEIDGAGIYIGNKRILSRASCETVPDMKDMKGVTIGYVACNNELIGVFTLSDACRTGSAEAIKELRSLGIKSVMLTGDSSAAATYAQNQLGNILAEVHAELLPEDKVRIVGELKEKDGPTLMVGDGMNDAPALAKADVGVSMGVSGSAVAMETSHVALMSNDIRRIPKAVRLARRTHRTIIVNIIFSVITKLAIVGLAFAGHPLIWAAVLADVGTCLLVIMYSMLLLREKDSRKAKKCAASHHGSPKKCCSSSHHGSHAKKNHGVSHHCSDGPCKSMVSCKESSVAKNACHDHHHEHNHHEEPAHKHSSNQHGCHDHSHGHSNCKEPSNQLITNKHACHDGHNHCADTSNLHDTKKHDCHGHEHSTCKEELNALPPTNDHACHGHEHSHCEEPVALHSTGEHACHEHEHEHIHCDEPIGSHCADKHACHDHEQVHEHHCCDEQQTPHTADLHPCHDHDHDNLEVEEVKDCHAEPPHHHNHCCHEPHDQVKNDTHPVQEHSISIEESSDHHEHHHNEEHKAEDCGHHPKPKDCAPPPTDCISRNCCSNTSKGKDICSSLHRDHHTSQASRCCRSYVKCSRPSRSCCSHSIVKLPEIVVE

SEQ ID NO: 715 - protein, 315 aa, Zea mays
MQPIRRRHRGFALLCLSAALLAAATLLPGAAVAEGVTPSEARRLRDEVKDMFYHAFDGYMKYAFPLDELRPLSCQGEDSLGGYALTLIDSLDTLALLGDKEKFGAAVEWVGKNVHFDINKTVSVFETNIRILGGLLSAHLIASDYATGMRIQSYDDQLLHLAADLAQRLLPAFDTPTGIPFGSVNLLYGVDENESKITSTAGGGTLTLEFGILSRLTNNTVFERVTKKSVRGIWSRRSKLNLVGAHINVFTGEWTQKDAGIGTSIDSFYEYLLKARKATMHIYCLEMKNTCTFFRRLTKLPCTISIMILGTWRLI

SEQ ID NO: 716 - protein, 280 aa, Zea mays
MELLLPRTTPPALATAPAPTFPSDPHLVDRAARLSTFAPPSPSPSSTSPARPLPAAANAGKRKADPVDRASKGKAAKKGKTAEEKLAGGDGDDEKPAYVHVRARRGQATDSHSLAERARREKINARMELLKELVPGCSKVSGTALVLDEIINHVQSLQRQVEYLSMRLAAVNPRVDFGGLDSFLTTECGRIAGFNCKNGIDLEQVTWPEMGVHGARQLMQLQQQFWHGDLTHPHQVASQWEKRGDGHPPVFSNSSPSLFGYDLTSSGAQQTPASKLKTEL

SEQ ID NO: 717 - protein, 466 aa, Triticum aestivum
MKKSVVLYPGVGVGHLVPMVEVAKLFLKHGLAVTVVLIDPQVESTDFSSAVARARASNPSVAFHVLPTPPADSNSDTAPTNPVVQIFRLLKSMNAPLLDFLRSLPSVDALVLDMFCVDAQDVAAELKLPVYYFYASAAADLALFLNLPTMLAGSKVKELGDSIITSPGVPPLKASDLPEVTHNDEVLKTILGMFDRMPDSNGILINSFESLETRAVRALKDGLCVPGRATPPVYCIGPLVSGGGDQEHECLRWLDAQPDQSVVFLSFGSMGTFSVQQLQEIANGLDKSGERFLWVVRSPRNPDYKYGDSLPEPDLDALMPEGFLERTKDRGLVIKSWAPQVEVLRHRATGAFMTHCGWNSTLEGITAGLPLLCWPLYAEQKVNKVHIVEGMKLGVEMRGYNEEVVKAEEVEEKVRWVMASEGGKALRERVAAAKDAAAEALKEGGSSHLAFVQFLNDLDISIAPTV

SEQ ID NO: 718 - protein, 449 aa, Glycine max
MLRSTPIPAPYNSVPVLSRARTCHSLAPARAVHSHSSFVSRLVFPQFRQYIVNVPGRVFVAAAAKKQRRGGAELAVTDDGFDDDEEYDDDDFYDEYDDDDDDDDDEEEEFDDDEDDEGMLSLEKMNKWFEKKPRGFGEGKVYDTSVEDKLLEEMRQSRIAQAENLKKLMSNPVKHASNESVQKKKDAELVPIGGRVCLVNLPKKKNIHKDLKSALQGIPGIINIVPAVTGNKKTRDPICKGFAYVDFKREEDAVRFVELYTGQTITFGKIQKQIKCELLNVQSSSSLKLSKNLSAAPQLVAAAFEEDSNEDSNLDGSARSSWDETNSSDDLDDLDYQMNGEEQEDEEDNQESVTALGVDHDDNVEMRIDPENISLPSEQVDRNPAAVQKSSAKVKQENARKKKPISKEKTKKVLDVPGSSRRLKIREKAVLSEVFSKYGLKATLASKDN

SEQ ID NO: 719 - protein, 260 aa, Hordeum vulgare
MPLLQLQLPTACCAAAASAPFSFSRPPPSRLRSSHVIFAFPRLRKYGRRSREPVPTTLDDDEDEEADEDDDDGVEEAVDEDIFLKNRPKPAGFGVGKTYTTDVEEQLLREMGLGGAGRKSKSAPPKSVKTNGSATETSADVSDDGVHVRIWNLPKKKNIHKDLNLAFKGFPGLVTINPANSGTKKTRDPICKGFAFVKLESVDAATRFVELYSRKAVSFGKVEKPIKCCIVEGHASTDPSGPASSSQAPGSNPQRLVAVR

SEQ ID NO: 720 - protein, 994 aa, Zea mays
MPPPTRGRGRGRGRGRGRGRGRPSKDTVAEDSAHATEESGEENLQEKVQEGSKVNLTEKVQEGGEENLKEKLQEGGEENLTEKENEGLVEVSKPPQRRRKDPVADPSSLESSGFMRFRERRNASAVQEQGPKKRRITEDSNMCHQCQRNDSGRVVRCQGCAIRKRKYRYCVKCIKRWYPHLSEDDFVNNCPVCQNNCNCKACLRGDITRANSRKKKKLLQINSGGYSVSEQDKIKFSMRIVHFLLPWLKQFHQEQMQEKSAEAATKGIDADKLEVPLTICGKKERIYCNNCRTSIVDFHRTCNKCNYDLCLQCCQELRRGLVSGNDAKVDGGGKQDFLSGVSHDKIISKGPSDGQNDMLIDSVVPGENNTSSLRQWSVNKDGTIPCPPNAFGGCGSSLLELKCLFKEKFIAELLEKANSALNNEMEVKIEGSKCPCFTESGDMDDGISRKSSCRENSCDNYIYCPTAIDVQNGSLDHFQEHWLKGEPVIVRDTLALTSGLSWEPMVMWRALREKKEKVERLSVLALECLGWCEVDVNIHMFFAGYSSGLVGPDDLPLLLKLKDWPPHSSFEERLPRHGAEFMSALPFREYTDPKWGPLNLAVKLPDNVNKPDLGPKTYIAYGVSKELGIGDSVTKLHCDMSDAVNILTHTDEIKLKAKRIAAVEKKKRCLGMKILSTKEASGGLQRCADYVGMPTAPSESNKEPRPEECVNELGIKQPVQHVASEEQEGVQDDAKADANVMNVSFGKGKSEDSFGTINGTNSGDKIESPSGLAERTLTQPTTKGCSKQRGRSSNGRGNRTKKIEEGNASGLIAVAPESEDDDDAPFIDGNQAEGGALWDIFRREDVSKLHDYLMKHADEFRHCNFEPVKQVTHPIHDQCFYLTIEHKRKLKEEYGVEPWTFEQKLGEAVFIPAGCPHQVRNLKSCIKVALDFVSPENVRECIRLTEGFRLLPKWHKVNEDKLEVKKIALHAFNQAIKDITDESSNNNESKWIRR

SEQ ID NO: 721 - protein, 164 aa, Solanum lycopersicum
MAASARRSTGPVLRSLSPAGRFYSSSSRTSSSSASSIRFTLDRETSPSRSISVMNRQKTLASSQKKTCMCSPTNHPGSFRCSMHKKMDIRRSSSTSQTASNSIRLHMRRSAMTNSLVRIGTVEGELVKRALAALIRPSSHQQRRRSDFQRRPSRLSVISSSGDS

SEQ ID NO: 722 - protein, 128 aa, Solanum lycopersicum
MANSIHSIFSPFFIINIIFLSFSCYTLAGRDIAKINDKIKHPDTFFPYDGTVLIPGIGRVVVPPKGTHVNPFTYNPITGSNNGNGLVIPIPGSGTGIGIGSYIPGGDDTFIPNPGVEVPSGGTIPVPP

SEQ ID NO: 723 - protein, 351 aa, Sorghum bicolor
MSPAAATTTAFAAVSVAIPNPTAPSRGRVRLPLRGVPAAARRAVASMAVSAPRSGAAASFLERRESERALHFVKYQGLGNDFIMVDNRDSSVPKVTPEEAAKLCDRNFGIGADGVIFVMPGVNGADYTMRIFNSDGSEPEMCGNGVRCFARFIAEIENLQGTNSFTIHTGAGKIIPEIQSDGQVKVDMGEPILSGPDIPTKLLPTKNKAVVQAELAVEGLTWHATCVSMGNPHCVTFGAKELKVDDLKLSEIGPKFEHHEMFPARTNTEFVQVLSRSHLKMRVWERGAGATLACGTGACAVVVAAVLEGRAERKCVVDLPGGPLEIEWREDDNHVYMTGPAEAVFYGSVVP

SEQ ID NO: 724 - protein, 170 aa, Solanum lycopersicum
MDPTQAKSTSGSGHSSTHKPNSHPKPSKSELMSSAKLVADAAKAKLHHDPKQFEKSELAGAAADLLNAASQYGKLEETGIGKFVGKAETYLHKYETSHHSTTTATAAATAHTQSSGHTSGGKHEKSGSGYGEYIKMAEGLLKKNSDGSQSSESGKKGDYLKMAGDFLKKH

SEQ ID NO: 725 - protein, 935 aa, Solanum lycopersicum
MATPETAATPATPTENNEMVPKNEMIHEHGDEMVPQNEMIHEHGDEMVPQNEMIHEQSHEIVPENEMQNEMIHEIVPENEMQNEMIHEHSHDIVPENEMQNEHSHEIMPENEMIREHSHEIVRENEMIPEHNHEIVPENEMIHECSHETVPQNEMVHEHSHEMVPDNEMTHEHTHEMVPENEMTHDHNHEMVQENEMTHEHNHEMVPENEMMHEHGHEMVPEHEMMHEHSHEMMPEHEMMHEHHMVLGHEIVPSNEMVPDDEMIPLNEMVLAEPQPNYIETPPNNPETQPSKRRKKKSIVWEHFTIENVGGGTRRAQCKQCKQSFAYSTGSKVAGTSHLKRHIAKGTCPVVLRNQQNNQLSPYSTPPKMSGYGGSTDAPKRRYRTASSPYLAFDPDRCRQEISKMIIMHDYPLHMVEHPGFLAFVQNLQPRFDMVSFNTVQGDCVATYLREKQAIQKVIEGVPGRICLTLDMWSSCYTVGYVFITGQYIDSEWKIHRKILNIIMEPYPDSDTAFSHAVAACLSDWSMEGKLFSVTINQPLGDASVDNLRALLSVKNPLVLNGQLLVGSCLARTLSSIAQGAFNFLHETVKKVRDSVKYVKTSEFHEEKFIELKQQLQVPSTKTLALDDQTQWNTTYEMLLAASELKEVFSCLDTSDPDYKDALSMDDWKQVEVLCTYLKILFDTANLLTAPTIPTTNTFFHEAWKIQLELARAAASEDPSISGLTKTMQEEFDKYWKSCCLILAIAVVMDPRFKMKLVEFSFTKIYGEEAATFVKFVEEGIHELFLEYVALPLPLTPAYAEEVDDGALKQENGGGGLTDFDAYIMETTSQQSRSELDQYLDESLLPRVHEFDVVGWWKLNRMKYPTLSKMARDILSVPVSTVTADSVFSTVGKEIDRYRCSLRPETVEALICAKDWLQNASVNTLHAPIKMEVPI

SEQ ID NO: 726 - protein, 315 aa, Solanum lycopersicum
MEEIEHKYIEVNGLKLHIAEIGSGFSPVVVFLHGFPEIWYSWRYQMKAVAKAGYRAIAPDYRGYGLSDQPTQPEKTTFLDLVSDLLALLDALNISKVFLVGKDFGSFVISYFSILHKERVSGFIVMGVPFLPPKPLEFKKGLPEGFYISRFGIPGRAEADFGRLDAKTVVRNVYILFSRSELPIANEDQEIMDIVQPSTPLPPWFSEEDLAAYGALYEKSGFRTALQVPYRSLHEQVNITDPTVHVQALYIKGEKDYFLKFPGIEDYISSGVLKSLVPNLQIVNLPEGNHFVQEQLPDEVNQLVLEFLTKNSKVQ

SEQ ID NO: 727 - protein, 315 aa, Solanum lycopersicum
MCSTKQKQKQNLHNQRSVVPTSTSASGGDGGGGGDWREESITGGSLKHVDLDKGKNGWASPPGDLFNLRGPHYLTKKAKVPSGAWLLQPAGVDWLRSNSKLDHVLARHDNRVMNALKKSHSEGKSLKTFIVAVNLQVPGRDQHSAVFYFATNDDEPLEPGSLLYRFVNGDDAYRNSRFKIVNRIVKGPWIVKAAVGNYSACILGKALNCYYHRGPNYFEIDVDIGSSAIASAILHLALGSVTSVTIDMGFLVESQTEEELPEKLFGAVRICQMEMSSATFIDTTSSRKVLPTANLHNPCNSSKVQAEENGENKDD

SEQ ID NO: 728 - protein, 133 aa, Triticum aestivum
MAKLLPAGLAFLLALTAAAALAPSPASALKGAGGLGLGGAAAVVMRRGGRTCRGTVGECMEYFGVDGEGEGEVAAMAGKRRVLQDGSGYIGYDALRRDNVPCSQRGASYYNCQPGAEANPYSRGCSAITQCRG

SEQ ID NO: 729 - protein, 706 aa, Solanum lycopersicum
MNAVGRQRSGTSTAHHQRQYSDNFLETSSNGRWLQSAGLQHLQTSNNNVPQAPQGQEYGYYGGAQGSRMLRGAQRTYSGGSDLFAEPLTPPGNYRHSSQRRNGDEEVCPNEFSPGLLDLHSLDTELLPEMPVAGLYDAPSMHHFARAKSFDDSEQFLANNKQTGRVRGLPESNVSKSFAVDKDKASNVAKIKVVVRKRPLNKKELTKNEEDIVETRFNSLVVHETKLKVDLTQYVEKHEFVFDAVLNEEVSNDEVYHETVEPIVPIIFQRTKATCFAYGQTGSGKTYTMKPLPLRASRDLLRLIHHTYRNQGFQLFFSFFEIYGGKLYDLLNERKKLCMREDGKQQVCIVGLQEYRVSDVEMIKELIDRGNATRSTGTTGANEESSRSHAILQLSVKRSADGSESKPPRVIGKLSFIDLAGSERGADTTDNDKQTRIEGAEINKSLLALKECIRALDNDQNHIPFRGSKLTEVLRDSFVGNSRTVMISCISPNAGSCEHTLNTLRYADRVKSLSKGNNSKKDVSSSTLNLKESTTLSFSAVVPSTSTFEDDTGDSWPEQTDKDEYDEDFYEQEKPMSKKNEKLDGYSISNSEDKMKRANAQTKWKEPPRTEAKYSNSDDDLNALLKDEEDLVNAHRKQVEETMDIVREEMNLLVEADQPGNQLDNYISRLNAILSQKAAGILELQNQLAHFQRRLKEHNVLVSSGN

SEQ ID NO: 730 - protein, 747 aa, Vitis vinifera
MSKEQKRGKQEKSSEAAEKVVVAVKASKEIPKTALVWALTHVVQPGDCITLLVVVPAQSPGRKLWGFPRFAGDCASGHRKSHSGASSEQQCEITDSCSQMILQLHDVYDPNKINVKIKIVSGSPCGAVSGEAKRTEANWVVLDKQLKHEEKCCMEELQCNIVVIKRSQPKVLRLNLVGSPKMESETACQLPSEPGETAEKHSKTKNDSMKSIRGPVVTPSSSPELGTPFTATEVGTSSVSSSDPGTSPFFNSEVNGDLKKEESSHTKENLDLDESSSDTDNENLSPSSSVGFQPWMAGVLTSHHQSSQHIEQSSKKSRDKTQPPTSKALLDKFSKIDRDARIGMMNYRSELDFSGNVREAISLSRNAPPGPPPLCSICQHKAPVFGKPPRWFSYAELELATGGFSQANFLAEGGFGSVHRGVLPDGQAVAVKQHKLASSQGDVEFCSEVEVLSCAQHRNVVMLIGYCIEDRRRLLVYEYICNGSLDSHLYGRHRDPLEWSARQKVAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIDELVDPRLGNCYSEQEVYCMLHAASLCIRRDPHARPRMSQVLRILEGDMVMDSNYMATPGYDVGSQSGRIWSDQHQHYSGPILNEAYEEFSGKLSLEALRSAFWEKDKGRRTSSEDKL

SEQ ID NO: 731 - protein, 133 aa, Triticum aestivum
MAATSGLTATVTSPPAALRASPPPVLFLRPISRCSRLHSLKAKAAAKDQDEKKPEATKKKAYSLVCTACEGNGAIACTQCKGGGENLEDHFGGRFKAGGLCWLCRGKREILCGSCNGAGFLGGFMSTADDTSE

SEQ ID NO: 732 - protein, 316 aa, Triticum aestivum
MAMVEQRIEHSHLAIRGLNLHVAQAGTGELGTVLFLHGFPEIWYSWRHQMLAVAAAGYRAIAPDWRGYGLSDQPPEPEAAAYSDLTEDLLALLDALSVPKAYLVAKDFGAMLAYDFALRHPSRTCGVMCLGIPFLHGGSSFTAMPEGFYILRWREPGRAEADFGRYDVKRVVHTIYILFSRSEIPTAKEDQEITDLADLSTPLPEWFTEEDLAVYTSLYEKSGFVYPLQMPYRSLHKRQPIEDPKFEVPVFVVMGEKDYVIKFPGVEAVLKNGTMEKFAPDLKITYIPEGSHFVQEQFPDKVNELLLGFLKDHPVA

SEQ ID NO: 733 - protein, 218 aa, Zea mays
MAFTPATACCKASLALAPRASPRGPASCAQAALLCTPSTSVFRGLRAPASAAPAPRRRRSAASTGIVCGKVAKGSVPPNFTLKDQNGKPVSLNKFKGKPVVVYFYPADETPGCTKQACAFRDSYEKFKKAGAEVIGISGDDAASHKAFAQKYRLPFTLLSDEGNRVRKEWGVPSDLFGTLPGRQTYVLDKQGVVQYVYNNQFQPEKHIGETLKILQTL

SEQ ID NO: 734 - protein, 707 aa, Zea mays
MERSCYFPLRWESTGDQWWYASPIDWAAADGHYDIVRQLLHLDPNLLIKLTSLRRIRRLEALWDDDARFADAARNRASVARSLLLECECRNHRPAAPGAGENTLLRAGYGGWVLYAAASAGDAAFVRELLERDPLLVFGEGEYGVTDMFYAAARGGSADVFRLLLDHAMSPRCSTSCRNGEASARRSSVFRLEMMSRAVHAAARGGSVEMLRELLEESSVSTYLDIRGSTVLHAAAGRGQLQVVKYLVASFDIINSTDNHGNTALHVAAYRGHQPVVEALVAASPSTLSVVNNAGDTFLHSAVTGFRTPGFRRLDRQLELMRYLIRERTADIQKIINLRNDAGLTALHLAVVGCAHPDLVELLMATPSIDLNAEDANGMTALALLKQQLRSATSDRLIKQIVSAGGVLNSSILRTRSAIASQIKMQGGIASSPGTTFKVSDAEIFLFSGMGAAESLRPSSCSSNGKDDDPTHADADCAENRGSSEKRLSSASRAKDRLKMMLRWPRHKDKTPKKSEDSSPLGSISRLNEHGAETPAPLRQKFTKTTALNGKRTLAVKSSTPSSSSTKKKLNTKLIHGIMEAMPQLAPSTARSASPTDTFLRSSVSSTPQPLAKLKDICLDDEISMVTPPAGRLKDSDDAMEDPSCSNNSSMDDGCGAGTAESAARKHGCGNGRLINICFGAQGLTVEDSASGQQTSKMFKQQCLRVS

SEQ ID NO: 735 - protein, 323 aa, Triticum aestivum
MGAQRALLASFLLAALVTQAFVSVSARTGPTDKASQDDVKKPDCVPSLDPHNFPGHGGTTVPLPSHGGSSGTPPYHGGSGTTPSHGGSGSTPSHSGSGSLPDPSHGGYGTPPSHGGSGSLPDPSHSGGYGSTPDAPSHGEGAYGSSPTPSTGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAAAGGVDSAAAAQAASFKKANEGRKA

SEQ ID NO: 736 - protein, 345 aa, Zea mays
MASADAGTCPWDALPLHLQERILSLLPITELLPVAAVSRAFHLLLRSPTFHALLSPHRLDAFFLLSPRLAVHPLSRRVRTMPAFAALSPPSYPLVSSPSPSLLITCASLQFLPPIPDGAYLLSAIVPSRGSSTSCTLVAVITGAAARSYTLDTGDPSPQWASRGDLPLSLTLLENAAVSGDRSKLFVLGRGPEALLVFHLVTGTWEVLPVVMPQGLTTAHLFLFDASLFLVGGMESFGVVDRVVVWRLDDDKAEEVWWREVSVMPTEVFDELLAGRFGRFWHFQAADRLGIVCLYNAVDRRLVMFDAADGMWTVLPRLSALDACESFRWFGHVLEPGVEILMGLR

SEQ ID NO: 737 - protein, 466 aa, Triticum aestivum
MATSATAARHMVALPYPGRGHINPMLAVCRLLVAADGALTVTVVVTEEWHGLLASAGVTPTLPDRVRLATIPNVIPSEHGRGADHGGFIETVNCKMGEPVERLLDRLALELGRMPDAIVADTYLQWAVAAGARLGVPVCSLWTQPATFLLALCHLDLWRPAVEGFSEEELSRKSLEQYVPGLSSVRLSDVKIFLAWEGPIKISAEVFVKVRKAQCVLFTSFHELEPSSMSKIAELLPCPIYPIGPAILRAPDNGESARDEEHRRWLDAQPQNSVLYVSFGSFVAMPPKQFEEIAVGLCDSAVRFFWVAQDRATAGLREMCGDRGLAVPWCDQQEVLRHPSVGGFLSHCGWNSVLEAVCAGVPLIGFPVVWDQLVNARMVADEWKTGINLRQQRGKDGIVSRAAVSDAARKLMDLDSGAGQEMRRRAAQLREASRGAVLEGGSSQRSLSGFLEDLVEGKLEVAESSA

SEQ ID NO: 738 - protein, 356 aa, Triticum aestivum
MSSLSMKCMLFTSAVTVALALFPVATVGAGLKVGFYSKSCPSAENLVQQAVAAAFKNNTGVAAGLIRLHFHDCFVKGCDGSVLIDSTANNTAEKDAPPNKPSLRGFEVIDAAKKAIEAKCPKTVSCADILAFAARDSIALAGNVTYKVPAGRRDGRISTNASALSNLPSPLSTAAELVGNFTLKNLTAEDMVVLSGAHTIGVSRCSSFTNRLYAFSNTSQVDPTMSSAYAFLLKSICPANSSQFFPTTTTDMDIITPTLLDNKYYVGLTNNLGLFTSDQALLTNSTLKASVDAFVKSEKSWKSKFVKSMVKMGDIEVLTGTQGEIRLSCRVINKGSAGLEINDGPDSAEFAGIATS

SEQ ID NO: 739 - protein, 963 aa, Triticum aestivum
MDAATRRARLLLLLVAATVPAGLCQTNPDDAAALRSVMGAWTNYPSSWNSGDPCGAPWDGIMCSGNGRVTSLRLSSANMQGTLSDSIGQLGQLMFLDLSFNGGLSGTIPASIGNLGKLTTLILAGCSFSGDIPKELGNLLQMTFLALNSNKLTGTIPPQLGLLSKLFWLDLADNAITGSVPISTGTTPGLDLLTNTKHFHFNKNQLSGTLTGLFKSNMTLIHILFDSNQFTGPIPRELGSITSLQVLRLDRNQFAGAVPNITNLVNLNELNLATNKLTGSVPNLSSMNVLNVVDLSSNSFTASAIPAWFTNLTNISSISMSSASLTGEVPQELFNLPQLHEVLLSKNQLSGTLKMAAGISAQLQTVDLEQNSIVDIAGTSNYKKTLLLAQNPVCADTSIQFCSAQRQNVVPYSTSMAKCNTARGCQSGQDQNPANCGCAYSYNGKMVFRAPSFKDVSSTANFQQLEETLWRLLGLREGAVFLNRILFNEDNYLQVQVSLFPSTGTLFNVSEVSRIGFLLSNQTYKPPPIFGPYFFIADPYVPFIVAGGKKSKFSTAAVAGIAVAGGVLVIALILVGLFALRQKRRNKELKERSTDPFASWGAAQKDSGGAPQLKGARFFSFEELKSCTDNFADSHEIGAGGYGKVYKGTLVDGIRVAIKRAQSGSMQGAPEFKNEIELLSRVHHRNLVSLIGFCFQQGEQMLVYEFVAGGTLRENLVVRGTYLGWKKRLRIALGSARGLAYLHELADPPIIHRDIKSTNILLDENLKAKVADFGLSKLVADTEKGHVSTQVKGTLGYLDPEYYMTQQLSEKSDVYSFGVVMLELVSGRQPIEKGKYVVREVRQAIDPADRDYYGLRAIVDPAIRDAARTPGFRRFVQLAMQCVDESAAARPTMGTVVKEVEAMLLNEPDGEGSNSAGSSATEFDGAGRGAPSHPYSDVEITRSSYGGAGEASDYMPYFEVKPK

SEQ ID NO: 740 - protein, 876 aa, Arabidopsis thaliana
MNTYSPLQLIPTPIHLKSSRAASPSSLRVASPLIIRAASSDDSQSVENQTLEVLEWRALCNQLSPFASTTMGLSATKNAEIPVGNSPEESRNLLNETSAAIAAMEMMKSRGLGLSEIQDLSDIVERAVSGQLLTVRELCTVRSTLTAATSTFQKLRKAAISDNRVTPLVDILQGCDFKDTLQQKISFCIDCNMTMILDRASEDLEIIRSERRRNMENLDSLLKKISTKIFLAGGINKPLITQRRSRMCVAIRATHKSLLPGGVVLSVSSSRATCFIEPKEAVELNNMEVRHANSEKAEEMAILSILTSEVVMAQREILHLLDRILELDIAFARASHANWINGVYPNVTSEHTKTLGLAVDIDSAQHPLLLGSVLGSPNGGDIFPVPVDIKVESSAKVVVISGPNTGGKTALLKTLGLLSLMSKSGMYLPAKNCPRLPWFDLILADIGDPQSLEQSLSTFSGHISRIRQILDIASENSLVLLDEICSGTDPSEGVALATSILQYIKNRVNVAVVSTHYGDLSRLKDNEPRFQNAAMEFSMETLQPTFRVLWGSTGLSNALRVAKSIGFNKRILENAHKWTEKLNPEQDVERKGSLFQSLMEERNKLKLQATKTAAFHRDLMNLYHELEHESHDLEKRERALLKKETQKVQEDLNSAKSKMERLVAEFESQLEITQADQYNSLILKTEEAVAEIIEACCPMDPDSLEEEYSDYSPQAGEKVLVTGLGDKLGTVVEEPGDDDDTVLVQHGKIRVRIKKKDIKPLPRSTSSQTSNRSLRSKRQINMKELGSVLQMQSEPVRIQTSKNTLDLRGMRAEEAVHQLDMAISGRDSGSILFIIHGMGAGIIKELVLERLRKNTRVSRYEQANPMNHGCTVAYIK

SEQ ID NO: 741 - protein, 215 aa, Solanum lycopersicum
MAGGGASSKASNGGPTRVRKRVEVESAASAASLKRAKDGSAFARCEECSKDVPIALISFHNCSLDAKIKMNLEAQVVENQTEVKKPAAKSKEKSTEPKAKREKKPKNPNAPKRPPSAFFVFMNDFRQEFKAANPDCKSVSMVAKEGGEKWKSMTDEEKKPYQEKAAELKAAYEKALKSNTDADNSNDDDEEPEKEVKEEIAVDEEAKEEIEVDEE

SEQ ID NO: 742 - protein, 571 aa, Sorghum bicolor
MAAAMARRAAGLLPLLLLSSRSGARIALHRAVSQIPPPRSYRLLSQQANPSPSSSFSASASASNGTAAERTRELHLYNTKSRKKEQFRPRDPGGEVGMYVCGVTPYDDSHIGHARAYVAFDVLYRYLRYLDYEVRYVRNFTDIDDKIIARANQLGEDPFSLSKRFSDDFLSVMANLQCLPPSVEPRVSDHIHEIINMIKQILDNSCAYVVGGDVYFSVENFPEYGELSGRKLDDNRAGERVAVDERKRNPADFALWKAAKDGEPWWDSPWGPGRPGWHIECSAMSAHYLGHSFDIHGGGEDLIFPHHENEIAQSRAACCDSTINYWIHNGFVNVNSQKMSKSLGNFVTIRKVIEMYHPLALRMFLLGTHYRSPINYTIEQLNVASDRLYYTYQTLRDCEESCQQQGSNTGNSLPPNTLNYIQKLHDEFETSMSDDLHTSVALAAISEPLKVMNDLLHTRKGKKQDKRLEALSALDEKIRVVLSVLGLLPSSYHEALQQLRDKALRRASITEELVLQKIEERTAARKAKQYEKSDEIRKELAAVGIALMDGPNGTTWRPSLPLSEEAVVAKT

SEQ ID NO: 743 - protein, 494 aa, Solanum lycopersicum
MDYYTLVFVSILVLANIIAKICSKGSKKLPPGPSPWPIIGNLQLLGAKPHISLANLAKNYGPIMSLKLGQITTIVISSSTIAKQVLKTQDQAFSSRFAPNALQAHNHYKFSVAWLPVCPQWRTLRRILNTNLLSSNKLDANQHLRSQKVKQLIDYCDKCSQQGEALDIGQVVFKTSLNLLSNTLFSKDLADPFSDSKVELKEVIWGIMAEVGKPNLVDFFPILEKIDLQGIRRRAIIHFGKLFKLFDDLINERLEEKKRPGFMEKSDVLEIFLNITEKNPQEIDHNHIKSMFMDLFGAGTDTTTSTLEWAMAELLKQPEIIKKAQVELAEIIGKGKLIEEADVFRLPYLQCIIKETLRLHPPVPLLVPRKVDQDVELCDYIIPKGSQVLVNVWAIGRDFTFWKDPLEFKPERFLNLDLDMRGQDFELIPFGAGRRICPGLPLALRMIPLMLGSLLNSFNWKLDAGIEPQELDMEEKFGITLAKAHPLRAIPSPL

SEQ ID NO: 744 - protein, 270 aa, Sorghum bicolor
MPLLLLPPAACTTAATAPASLAFSRPRSSRARWSSLSFAFPRLRKYGRRQREPVAAPSLDDDEDEEETGAGEWESDEGEEEMEVDEEEFLATRPKPAGFGEGKTYSTDIEEQLLREMGFGGGSERRRGEAAPASRRAGDSSTKVMAADASDDGVQVRVWNLPKKKNIHKDLKQAFKGFRGLLSIEPAVSANKKTRDPICKGFAYLKLESAEAATRFVEIYSHQTVSFGKVQKPISCCIVDKGSSVKPSKASSSQATPQPMLKHQKLVAAS

SEQ ID NO: 745 - protein, 370 aa, Sorghum bicolor
MVMGRASAATVLVALAVLALAVMAQATCDDELPAQLAGNFSGLACAPVWNNFVLRYAQGKDNVLRVVLSTMYSTGWVGMGFSKNGLMVGSSAMVGWMGKTGVPHIKPFSLEGKTPSKVVADQGFLASSDHHKPTVLVQQAKIYLAFQLSFTEPLKSQNVLFAIGSAIPVNDHLSEHQDKTAIVFDFTTGSASSSSSFPDGLKRTHGALNLFAWGVLLPIGAIVARYCRRWDPLWFYLHAGIQFVGFILGLAGVVAGVSLYNKIQADVPAHRGLGIFVLVLGILQILAIFLRPNKDSKYRKFWNWYHHWVGRLALFFAAINIVLGIKVGGAGNSWKIGYGFNLAILLITIITLEVLLWTRWKNNSGSTGAY

SEQ ID NO: 746 - protein, 252 aa, Sorghum bicolor
MAMATSTFSPRPATLNKPLRPGAKPASLLPFPCRRAGRLVCATAAGEAPSVEVEQRDEAEPAPAAASNGSAIKAEAPAPKAVQAEAPPAAVPPAFRDARWVNGTWDLTQFDKGGVVDWDAVIDAEARRRKWLEDYPEATNTDEAVVFDTSIIPWWAWMKRFHLPEAEKLNGRAAMVGFFMAYFVDSLTGVGLVDQMGNFFCKTLLFVAVAGVLLIRKNEDIESLKKLIDESTFYDKQWLATWQDDSTGGPKN

SEQ ID NO: 747 - protein, 232 aa, Triticum aestivum
MEDFVLSYVVTGLAFWSTAFLVMRALMPKRSYEFCNRAVSTMHAVAAVCMACLSVQEWSCPVCPLNAPSSPRQMKSLAVTLSYMIYDAACCHLNGDVRLDNTVHHLVSIVGIGAGLAYQRCGTEMMACMFITEISSPLLHLREMLKELGVKDTDLNLLVDILFAATFSVGRMVGGPYLTYVTLTTDYPILIKAMAAGLQLVSAYWFLRILRMVRYKLGKKRPAAAAAKVNAK

SEQ ID NO: 748 - protein, 146 aa, Solanum lycopersicum
MGLKAFIILSLVLAIFAIVTSHVAARELAESFTTTMENTKENEVNDAKYPGGGYGGYPGGGRGGYGGYPGGDRGRGGYGGYPGGGRGRGGYGGYPGGGRGRGRGGYGGGYCSYGCCERNYYGNGCNRCCYSKSEAMNKVTQAKPHN

SEQ ID NO: 749 - protein, 632 aa, Hordeum vulgare
MQHLTLAASLSAAVLFACILYAESADLNSDKQALLAFAASLPHGRKLNWSSTTPVCTSWVGVTCTPDNSRVHTLRLPAVGLFGPIPSDTLGKLDALEVLSLRSNRLTVDLPPDVGSIPSLHSLYLQHNNLSGIIPTTLSSSLTFLDLSYNTFDGEIPLRVQNLTGLTAILLQNNSLSGPIPDLRLPKLRHLNMSNNNLSGPIPPSLQKFPASSFLGNAFLCGLPLEPCPGTAPSPSPTPSVPSKSKRSFWKRIRTGVLIAIAAAGGVLLLLLILVLLICIFKRKKHTEPTTASSSKGKAVAGGRTDTPKEDYSSSVQEAERNKLVFFEGSSYNFDLEDLLRASAEVLGKGSFGTTYKAVLEDSTTVVVKRLKEMVVGKKDFEQQMEIVGRIGQHQNIVPLRAYYYSKDEKLLVYDYVPAGSLAAVLHGNKATGRAALDWETRVKISLGVARGLAHLHAEGSGKFIHGNLKSSNILLSQNLDGCVSEFGLAQLMTTLPAPARLIGYRAPEVLETKKPTQKSDVYSFGVLLLEMLTGKAPLRSPGREDSIEHLPRWVQSVVREEWTAEVFDVDLLRHPNIEDEMVQLLQVAMACVAVAPDQRPRMDEVIRRIAEIRNSDSGPATPPEEAAAQAP

SEQ ID NO: 750 - protein, 457 aa, Hordeum vulgare
MVKAPLHSSSSAAAAAATFSLVAKKARLSPFILLSLLFMLLFSFLYGEELAALIGQRAGRRSADLDVDVNREHQQPAGVEDGWKRKKKRWQGRLAFAVNDEDEDEECDVFSGSWVRDEEAHPLYREEECPYIQPQLTCQAQGRPDRGYQSWRWQPHDCTLPAFNPTQMLETLRGKRMMFVGDSLNRGQFTSMVCLLQSAIPSPEAKSFEMSPDQQHTVFTAREYNATVEFYWAPFLLQSNADDAVVHKISDRMVRNGSIAHHGRHWEGVDVLVFNTYLWWCTGLRFRVMNGPIGDAREEDAVWVSTEEAYGMAFRDMLQWVRDNMDFNSTRVFFTSMSPTHGKSQDWGDAQGGNCYNETAMIEDAEYWGTDARRSVMRVIREILDGDGADVPLTFLNVTQLSMYRKDAHTSIYKKQWNPLTPEQVADPRTYADCVHWCLPGLQDTWNELLYSKLFYP

SEQ ID NO: 751 - protein, 216 aa, Gossypium hirsutum
MAGGSKSNPPKPRKRVDAASAPAPAPAPASSLVRAKDGSAFAKCDECNKTVPMALINMHSCSLEAKIKMNLESQVIEKPAEAKKNSAERKKPPATTESNPKKPKKLKKGKDPNAPKRPPTAFFLFMDDFRKSYKEANPDAKGVTGVAKEGGEKWKSMSEEEKKCYVDKAAELKAEYEKAMEEAKNADHQNEEEEGGSDKETPAAEKATEEEVLDDY

SEQ ID NO: 752 - protein, 261 aa, Solanum lycopersicum
MSSVMLSSSSSSMALHRLLRPAPILSFSFLKQSLSLLPHQTTSLHPIINNSLSSFPSLRTHTSIFLRSRTFSNLPISCTSQSLLESSEDVEDEEIVKQNEEVTAPRPSESERKILRAKLPNLTVKEKKELASYAHSLGKKLKSQQVGKSGVTDTVVMALEETLEANELLKLKIHGTCPGGELDDVVKHLEEATGSVVVGQIGRTVILYRPSLTKMKAEEKKKQAQILFLKKQKQYAERRSFQDKGPVPRSYARNRRGSSRV

SEQ ID NO: 753 - protein, 284 aa, Triticum aestivum
MVYGGEEALRRQYSIGDEIGHGRFGTVRRCHSNATGEALALKTTPKAPLRDPLDLALAEQEPKLHLLASSPPCSPHLVALHAAFDDADAVHLVVDLCAGGDLLSLLSARGGRLPEREAAGLAAQIASALAACHRRGVAHRDVKPDNLLFDAATGALKLADFGSAEWFGDGRRMSGIVGTPYYVAPEVVAGREYGEKVDVWSAGVVLYMMLSGSVPFYGAAAPEIFEAVLRGNVRFPPRAFAGVSPEAKDLMRRMLCKDVSRRFSAEQVLRHPWIASCGGDAVAG

SEQ ID NO: 754 - protein, 343 aa, Unknown
  Sequence found in Organisms: Brassica napus, Brassica juncea, Brassica rapa
MAPTLQGEWIKVQQKGGEGPGARSSHGIAVVGDKLYSFGGERTPNISIDKHLYVFDFNTHTWSIAPANGQAPNVQALGTRMVAVGTMLYLFGGRDEKKQFDDFYSYDTVKQEWKFITKLDEEGGPEARTYHSMASDENHVYVFGGVSKGGTNKTPFRFRTIEAYNIADGKWAQLPDPGEQFPRFERRGGAGFIVVEGKIWVVYGFATSPDPNGKNDYESDLVHYFDPATQKWTEVETKGEKPSPRSVFAHAAVGKYIIIFGGEVWPDPNGHLGPGTLTNEGYALNTETLVWEKFGGGAEPGELGWPAYTTATVYGKQGLLMHGGKRPTNKRTDEMYFYAVHSA

SEQ ID NO: 755 - protein, 374 aa, Solanum lycopersicum
MAHSAISQVSVAVPLQTDSSFRRSTFKATSLTFSDKSCISMPSIDLKATRSRSQYIVCMSVQHASKAKVSVSPLSLEDATEPPLNIYKPKEPYTATIVSVERIVGPKAPGETCHIVIDHDGNLPYWEGQSYGVVPPGENPKKPGSPHNVRLYSIASTRYGDSFDGKTASLCVRRAVYYDPETGKEDPSKNGVCSNFLCNAKPGDKVKITGPSGKIMLLPENNPNATHIMIGTGTGVAPFRGYLRRMFMESVPMKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAEERGESWEQKLSQLKKNKQWHVEVY

SEQ ID NO: 756 - protein, 431 aa, Sorghum bicolor
MDSTKGTAVARLCDDLMVDILSRLPVKDLRRSTCVSKPWRDLVTDPLHRKKLPQTLEGFFHGGAGERHSYGHFTSLSGRGESAPPVDPSFSFLTAKLPWVERMDLLDSCNGLLLFGCTTENKFGYIVCNPATEELVTIPASSGSCPPPSLTPLEDKTIAVCDGDIYAHTYLMFDPIVSSRFHLVQFWQDRSTCEVKKVHSYSSETRAWSDTSNKWEPGEERCGWGVLRGRGEAIIEFTRGRALVDGLLLYIEAVLLFMRGRALVNGLLHFVAYHFEEGENLIVAVDGEGTICRIICPPVKHVDANAFIGQSQGHLHCISTNLISQYFNYHFTQLSIWVLEDYDTQEWILKHNVSFPQLFGSPSCPIDNHDIVVIHPDHNSIILVQHWNQKLVSYDMDSKEHRVLCTLGEGYRSITPYVPYFMESPVLATKD

SEQ ID NO: 757 - protein, 303 aa, Sorghum bicolor
MAMAMATAKLVLLMVLVAGSSCGGSAWRGPLSLLRTLPTTTAAQSVEAAAERLKEDLSSAASSASAASSLIHALRPLMGSAGDLGLRAGVPCDSWRLAVEAYNKRDWTTVPGSCEGYVGHYMLGGHYRRDSRVVVDEAIAYAEGLKLAGNGKEVWVFDIDETSLSNLPYYATHGFGTKPYNATSFNEYVLEGSAPVLPESQRLFKKLISLGIKPVFLTGRTEDQRAITVTNLRRQGYSGWMDLLLKPVGLKATAIAYKSGERQKLQDAGYVIVGNIGDQWSDILGAPEGARTFKLPDPLYYIG

SEQ ID NO: 758 - protein, 246 aa, Solanum lycopersicum
MGVVHTLHFVFGIFGNATALFLFLAPIITFKRVIQNRSTEQFSGLPYVMTLLNCLLSAWYGLPFVSPNNLLVSTINGTGAVIETIYVLIFIAFAPTKEKKKISALFLLVLTVFAAVALVSMLGLHGSKRKLFCGIAATIFSIIMYGSPLSIIRLVIKTKSVEFMPFFLSLFVFLCGASWFAFGLLGKDPFVAIPNGFGFGLGTVQLILYAIYCEKKGFTRKSNLDESNGKSHQEEKQSSKSKLEQV

SEQ ID NO: 759 - protein, 224 aa, Gossypium hirsutum
MSLTIPTNLSKSILKPKLETQVIPKASSRSLIVCSSSNPSSDKSASPLQAFSAALALSSILLSAPLPAVADIAGLTPCKESKQFAKREKQQIKKLESSLKLYGPDSAPALAIKATIEKTKRRFDNYGKYGLLCGSDGLPHLIVSGDQRHWGEFITPGLLFLYIAGWIGWVGRSYLIAISDDKKPAMKEIIIDVPLATGLIFRGFIWPVAAYRELINGDLVVKDV

SEQ ID NO: 760 - protein, 123 aa, Hordeum vulgare
MGARQRGERGGMPTTTTRSRLADASSWCLALSALAALLLVCSLGETTEAVTVRGASLSARWRPCEEIYVVAEGETLHGISDRCGDPYILERNPHVHDPDDVFPGLVLRITPSSPRPSVPASPP

SEQ ID NO: 761 - protein, 277 aa, Hordeum vulgare
MATTTCLLAAWALVAAGLFGTGLARASFAPAAVGKEQREFDYFALALQWPGTICSSTRHCCAVNGCCRKEPLHTFTIHGLWPDYDDGTWPSCCRRTSFDMDKITPLKPTLDKYWPSLYCSSSSTCFSGRGPFWAHEWEKHGTCSAPAVREELQYFSTALDLYFKYNVTEMLATGDILVSNGKEYALSDVIDTIKHAFGGSPQIICKKGSVQELRLCFTKDLKPRDCLTTSAMYKNLSKSKHCPRKISLPTYDPIVLANSTLEIVPEASDNGLYFFTS

SEQ ID NO: 762 - protein, 276 aa, Gossypium hirsutum
MGKGPGLYSDIGKKARDLLYKDYQVDHKFTVTTYTSNGVAITSTGTKKGELLLADVNTQLKNKNITTDVKFDSRSNLFTTVTIDEPAPGLKTIFSFVVPDQKSGKVELQYRHEYAGISTGIGLTAKPLVSFSGVIGNDSVSVGTDLSFDTASGNFIKLNAGLNITHSDLIASMTLNDKGDTLTASYYHIVSPLTNTAVGAELTHSFSSNENTLTIGTQHALDPLTTVKARMNNYGRASALIQHEWRPKSLFTISGEVDTRAIEKSAKVGLALALKP

SEQ ID NO: 763 - protein, 359 aa, Gossypium hirsutum
MALETPNHTQTVAGWAAYDSSGKIAPYIFKRRENGVNDVTIQVMYCGICHTDLHHVKDDWGITMYPVVPGHEITGVITKVGSNVKNFKLGDRVGVGCLAASCLECEFCKNSQENYCDQIQFTYNGIFWDGTITYGGYSDMLVADHRYVVHVPDNLPMDAAAPLLCAGITVFSPMKDCQLLESPGKKVGIVGLGGLGHVAVKMAKAFGHQVTVISTSPSKENEAKQRLGADYFLVSTDAKQMQRGKRSLDVILDTVSAKHSLGPILELLKVNGTLVVVGAPDRPIELPSFPLIFGKRAVKGSMTGGMKETQEMMDVCGKHNITCDVELIKPDKINEALDRLARNDVRYRFVIDIAGTSKL

SEQ ID NO: 764 - protein, 591 aa, Solanum lycopersicum
MAGGGGGGRSLEQTPTWAVAVVCFVLVAISIVIEHIIHLIGKWLKSKNKSALYEALEKIKAELMLLGFISLLLTVGQSPISNICVSEKLGNSWHPCSKKEEDSSIISEDSLSEQHRRRLLMDAAGGGVRRILAGGGGDDKCAAKGKVPFVSADGIHQLHIFIFVLAVFHVLYCVTTLALGRAKMRSWKSWENETKTAEYEFSHDPERFRFTRETSFGRRHLSFWTKNPVLLWIVCFFRQFVRSVPKVDYLTLRHGFITAHLAPQSHQKFDFRKYIKRSLEEDFKVVVGISPPIWFLAVLFLLFNTHGWYSYLWLPFIPLIVILLVGTKLQVIITKMGLRIHERGEVVKGVPVVQPGDHLFWFNRPRLILYLINFVLFQNAFQLAFFAWTWYEFGLKSCYHDHTEDIVIRITMGVLIQILCSYVTLPLYALVTQMGSNMKSTIFNERVATALKNWHHTAKKHVKDQSKHSNPVTPMSSRPGTPSHHGMSPVHLLRGHYRSDMGSLQNSPRRSNYDFDHWDNEGSPSPSRFYQEAVDGSLHHIQLGQLDHELQQVIEPNSSQVVPLSQEGRDQHEITIAGSRDFSFEKRTTSI

SEQ ID NO: 765 - protein, 568 aa, Zea mays
MAAALRFPGVARESLSLDAPVAASKLGRERRPAPASANPGPQCWRRRRGLAVRCQTGSTAPPVLRTEEAPAAAAGARNAQAGFTVVMKFGGSSLASAERMREVAGLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEATYPAVAKRLHEDWMDDPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDCVATSEVSISLTLDPSKLWSRELIQQELDHVVEELKKFAVVHLLQRRSIISLIGNVQRSSLILEKAFNVLRRNGVNVQMISQGASKVNISLVVNDSEAKQCVQALHSAFFENGFLSEVEGADVPQNGASLNSNGPVYGN

SEQ ID NO: 766 - protein, 568 aa, Solanum lycopersicum
MATLSHFCGVKTPCPSIFKRSVHFPQLDFVATVPFVSAPSKSVKVSCCERVQRLVCKAQAADVNPKETKNESFGEAPDELTCVMKFGGSSVASADRMREVADLILSFPEERPVIVLSAMGKTTNNLLLAGEKAQSCGVSNVSDLQELAFIKELHLRTIDELGVESSTISKHLLELEQLLNGIALMKELTPRAKDYLVSFGECMSTRIFSAYLNKLGVKARQYDAFEMGIITTDDFTNADILEATYPAVAKRLTGDWMSNPAIPIVTGFLGKGWRTCAVTTLGRGGSDLTATTIGKALGLREIQVWKDVDGVLTCDPNIYPRAETVPYLTFDEAAELAYFGAQVLHPQSMRPAREGDIPVRVKNSYNPKAPGTLIVKTRDMSKAVLTSIVLKRNVTMLDIASTRMLGQFGFLAKVFSIFEDLGISVDVVATSEVSISLTLDPSKLWSRELIQQASELDNVVEELEKIAVVKLLQNRSIISLIGNVQRSSLILEKAFHVMRTNGVNVQMISQGASKVNISLIVNDSEAEQCVRALHHSFFESDLSELVWESQSGNGYATTTSTPLPTLSN

SEQ ID NO: 767 - protein, 279 aa, Vitis vinifera
MMEWEAQELQQQPQHHNQNQNGVVVGGGSGGLYVKVMTDEQMELLRRQISVYATICEQLVEMHKAITTQQDLAGMRLGNIYCDPLMASAGHKISSRQRWTPTPVQLQILERIFDQGNGTPSKQKIKEITTELTQHGQISETNVYNWFQNRRARSKRKQSVPLPNNADSEVETDVESPKEKKTKPDNIQSHENSALGTENIYFQSPEMGSEMHCLDTQPNKGEPMFPSDHSLRSSGSLGHSSLYEAGVPNPRMDQLIGKVEVPGSFSPYRQGGEGFDMVG

SEQ ID NO: 768 - protein, 260 aa, Sorghum bicolor
MGSECKDHLQLHAAGYGVGVASPQQQQEEEQAGAIAPFVAKTFHMVSDPATDAVVRWGGASNTFLVLDPATFSDYLLPSYFKHRNFASFVRQLNTYGFRKVDTDRWEFAHESFLRGQAHLLPLVVRKKKKKKAAGGCREQLCEEGEEVRGTIRAVQRLRDQQRGMEEELQAMDRRLRAAESRPGQMMAFLAKLADEPGVVLRAMLAKKEELALAGKGSTTPAPGKRRRIGAEAGVGDVADMAQSRGAVPFPFSVLGQVFY

SEQ ID NO: 769 - protein, 240 aa, Solanum lycopersicum
MRRSRAAAAARQVPATELPVPAPVAGEHNGSGGSKEIRFRGVRKRPWGRFAAEIRDPWKKTRVWLGTFDSAEDAARAYDAAARTLRGPKAKTNFPLPSSHHLPPYPHHHQFNQSINPNDPFVDSRLYSQDHPLVSQRPTSSSMSSTVESFSGPRQPPRQQTAASVPSRKYPRSPPVVPDDCHSDCDSSSSVVEDGECDNDNIASSSFRKPLPFDLNLPAPMDDFSADAYADDLHCTALCL

SEQ ID NO: 770 - protein, 352 aa, Hordeum vulgare
MIRRRMGALHVGEPRVSFQQQVGKNGGGHGAVVEEIHGLIRVYKDGHVERLPAIPDVPCTWGSTAAASGVLARDVAVDRATGVWARLYAPAAAAGKVPVVVYLHGGGFSVGSAAWSCYHEFLAQLPARAGCAVMSVDYRLAPENRLPAAFDDGLTALRWLRQQASRGAAASDEVSWWRSRCRFDRVFLMGDSAGAAIAFHVAARAPAPLAVKGAVLIQPFFGGEARTASEKSMPQPPGSALSLSTSDSYWRMALPAGAGRDHPWCNPLARGAPRLESLALPPMLVCISEADILRDRNLELCRALRKAGKSVEQATYGGVGHAFQVLHNCHLSRPRTQEMLAHIRAFVSARSS

SEQ ID NO: 771 - protein, 170 aa, Zea mays
MAAMVRGPAMASAAGPGATSSAAAAAAAAAEEMRWRQLDSGVSAVSFGFVATAILVSMFLAMAILEHFLRPPTTAHAPPRGRGVLRRLRLFLLGRSGGAPGGTDLEAARKLHGHAPLEMPVYPRGVSVLMPGQDVPTFIAHPAPAPCPPERIRWPSHQPPPFTGSSPNPS

SEQ ID NO: 772 - protein, 140 aa, Hordeum vulgare
MFSGDWTPPCGSCCTKKYATLVQIPWRVFCKKGCNADGDTWEECIGKCTEICYKDPVLEDRQWSAYIDRSPGEDSYSLECFNACISGCGYRFDIPAEKVGLIKPNRPSKPPPPLPPVVERAKPSSGPPAAAGEDVPGTSA

SEQ ID NO: 773 - protein, 319 aa, Glycine max
MMEHNIIVNNNVIAPFVIKTYNMVNDPTTDKLITWGPANNSFIILDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 774 - protein, 331 aa, Zea mays
MASTTTTFLAILLVVAASAAPARSCSPRDIHALLSVKQALGNPASLSTWTPASPNCCAWDHLRCNDAGRVNNVFIDGADDVRGQIPSAVGGLTELMSLTLFRLPGLTGAIPACLTALSNLQFLTVSHTNVSGAIPESLARLRGLDSVDLSSNRLTGGIPAAFADLPSLRSLDLRHNQLTGPIPAGLVQGQFRSLVLSYNQLTGPIPRDDARDEINTVDLSHNRLTGDPSHLFAAGRPIGKVDLSWNYLDFDLSRLVFPPELTYLDLSHNLIRGTVPLSLERLSTLQKLDLSYNRLCGPLPKGHGVIKHGCKPYAHNQCSKGTPLAGCQDLE

SEQ ID NO: 775 - protein, 281 aa, Gossypium hirsutum
MEEINWDTLLLEVDLPDFGNILDNEPVTEPPPQPCSTQNPDEEPAVSSWIGEIEKVLMEDDNFDPRVETQPVSDDDFLADLLVDSPPSSGGDVTGVDGADLHKQSQTHTDVDKDDPIAKKQRRQLRNRDAAVRSRERKKMYVKDLEMKSRYLEGECRRLSRVLQCFIAENQALRLTLHKGCAFDASSAKQESAVLLLESLLLGSLLWFLGIMCLFTLPILPKSVLEAVPMANEETQGPERVAPRGAGSNRVGPSFVKSRRCKASRGKMKEISCFMGILIPF

SEQ ID NO: 776 - protein, 812 aa, Oryza sativa
MMMLLLPSSSSSCCCRCPGGQFHGAPPRVMAPRRGVTRVYIEKRLGVGGGNASSLQDMHRKELQARTRDQLQTLELSTSLYDTAWVAMVPLRGSRQHPCFPQCVEWILQNQQDDGSWGTRGFGVAVTRDVLSSTLACVLALKRWNVGQEHIRRGLDFIGRNFSIAMDEQIAAPVGFNITFPGMLSLAMGMDLEFPVRQTDVDRLLHLREIELEREAGDHSYGRKAYMAYVTEGLGNLLEWDEIMMFQRKNGSFFNCPSTTAATLVNHYNDKALQYLNCLVSKFGSAVPTVYPLNIYCQLSWVDALEKMGISQYFVSEIKSILDTTYVSWLERDEEIMLDITTCAMAFRLLRMNGYHVSSVELSPVAEASSFRESLQGYLNDKKSLIELYKASKVSKSENESILDSIGSWSGSLLKESVCSNGVKKAPIFEEMKYALKFPFYTTLDRLDHKRNIERFDAKDSQMLKTEYLLPHANQDILALAVEDFSSSQSIYQDELNYLECWVKDEKLDQLPFARQKLTYCYLSAAATIFPRELSEARIAWAKNGVLTTVVDDFFDLGGSKEELENLIALVEKWDGHQEEFYSEQVRIVFSAIYTTVNQLGAKASALQGRDVTKHLTEIWLCLMRSMMTEAEWQRTKYVPTMEEYMANAVVSFALGPIVLPTLYFVGPKLQEDVVRDHEYNELFRLMSTCGRLLNDSQGFERESLEGKLNSVSLLVHHSGGSISIDEAKMKAQKSIDTSRRNLLRLVLGEQGAVPRPCKQLFWKMCKIVHMFYSRTDGFSSPKEMVSAVNAVVKEPLKLKVSDPYGSILSGN

SEQ ID NO: 777 - protein, 391 aa, Sorghum bicolor
MALAVRTPRFQPRRTSISAPAPPASTSLAAANARPRACAAAAVRASPFTEATSSSRYRRDAWSYAAADGSSSSASPSSSDAAAAAAAAAAAAGRRDDEIALQLPELRRLLDALRASRGKGAEGADGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAGSAADPDTTLVVYMGLSTLPSLAPKLMKHGLPPDTPAVAVERGTTPQQRTVFSLLKDLVDEVKSADLVSPTLIIIGKVVSLSPFWVESSEHDALKIESSYTNETR

SEQ ID NO: 778 - protein, 385 aa, Triticum aestivum
MSCFSRIFKRTSGGQQQTGPLNEDLPGVENITRFSYKELDRATARFDQSNKIGEGGYGPVYKGTLRDGTAVAVKVLSLQSRQGAREFLSELITISDISHENLVKLYGCCVEGSHKILVYNYLENNSLAQTLLGSQQHSSIQFNWSTRVNICIGVAQGLAYLHDGVRPHVVHRDIKASNILLDQDLTPKISDFGLAKLLPSDVSHISTRVAGTLGYLAPEYAIRGQVTRKSDVYSFGVLLIEIVSGRCNTDTKLPYEDQILLEKTWAYYDQGQLDEIIDSSLGDDLDVDEACRFLKVGLLCTKNVTKRRPDMSMVTRMLKGEEDVESHEITKPDVIRDFRDLKLRSKATSSSLLTSIVARSSPSSSSSTGNTTRTSITFTAISDRP

SEQ ID NO: 779 - protein, 139 aa, Hordeum vulgare
MATSTMAFMPLKPSPSTFSGHSQLQRIQPFTRSSSFRVMSKKAKKVQTSQPFGPGGGLELKDGVDASGRPAKGKGVYQFASKYGANVDGYSPIYNPEEWSPSGDYYAGGKTWLLLWVATLAGILLGGALLVYNTSALAS

SEQ ID NO: 780 - protein, 1172 aa, Arabidopsis thaliana
MALQNKEEEKKKVKKLQKSYFDVLGICCTSEVPIIENILKSLDGVKEYSVIVPSRTVIVVHDSLLISPFQIAKALNEARLEANVRVNGETSFKNKWPSPFAVVSGLLLLLSFLKFVYSPLRWLAVAAVAAGIYPILAKAFASIKRPRIDINILVIITVIATLAMQDFMEAAAVVFLFTISDWLETRASYKATSVMQSLMSLAPQKAIIAETGEEVEVDEVKVDTVVAVKAGETIPIDGIVVDGNCEVDEKTLTGEAFPVPKQRDSTVWAGTINLNGYICVKTTSLAGDCVVAKMAKLVEEAQSSKTKSQRLIDKCSQYYTPAIILVSACVAIVPVIMKVHNLKHWFHLALVVLVSGCPCGLILSTPVATFCALTKAATSGLLIKSADYLDTLSKIKIVAFDKTGTITRGEFIVIDFKSLSRDINLRSLLYWVSSVESKSSHPMAATIVDYAKSVSVEPRPEEVEDYQNFPGEGIYGKIDGNDIFIGNKKIASRAGCSTVPEIEVDTKGGKTVGYVYVGERLAGFFNLSDACRSGVSQAMAELKSLGIKTAMLTGDNQAAAMHAQEQLGNVLDVVHGDLLPEDKSRIIQEFKKEGPTAMVGDGVNDAPALATADIGISMGISGSALATQTGNIILMSNDIRRIPQAVKLARRARRKVVENVCLSIILKAGILALAFAGHPLIWAAVLVDVGTCLLVIFNSMLLLREKKKIGNKKCYRASTSKLNGRKLEGDDDYVVDLEAGLLTKSGNGQCKSSCCGDKKNQENVVMMKPSSKTSSDHSHPGCCGDKKEEKVKPLVKDGCCSEKTRKSEGDMVSLSSCKKSSHVKHDLKMKGGSGCCASKNEKGKEVVAKSCCEKPKQQVESVGDCKSGHCEKKKQAEDIVVPVQIIGHALTHVEIELQTKETCKTSCCDSKEKVKETGLLLSSENTPYLEKGVLIKDEGNCKSGSENMGTVKQSCHEKGCSDEKQTGEITLASEEETDDQDCSSGCCVNEGTVKQSFHEKKHSVLVEKEGLDMETGFCCDAKLVCCGNTEGEVKEQCRLEIKKEEHCKSGCCGEEKQTGEITLVSEEETESTNCSTGCCVDKEEVTQTCHEKPASLVVSGLEVKKDEHCESSHRAVKVETCCKVKIPEACASKCRDRAKRHSGKSCCRSYAKELCSHRHHHHHHHHHHHVSA

SEQ ID NO: 781 - protein, 271 aa, Hordeum vulgare
MAMARVPILVAVALMAASASCSAWDPTIRMVDDAVAPLIHALRPLLGSGGQLGSRGGVPCDSWRLGVEAYNVRDWKTVPANCEGYVGHYMLGNHFRRDFKVVIDQAIAYVDGLKLAGNGKDVWVFDIDETTLSNLPYYATHGFGARPYNATSFDAYVLEGSAPALPETKRLYYKLLKVGIKPVFITGRTEDKRAVTVGNLRSQGFSGWMNLTLKQHGFKGSAISYKSAERKKLQDAGYVIVGNIGDQWSDILGAPEGARTFKLPDPIYYIA

SEQ ID NO: 782 - protein, 307 aa, Glycine max
MRSIASCYNEHAIRVSDSYCSRPSNQAYLCPELNPSTRDSVTCMYKLSLIKTQKQLFITITWAKKLLGQGFTITISNSEHSLSPSNNKSNARQLRKNKGNETFQSQNFQVQVLWDLSDAKYEEGPEPVGGFYVDVLVDSELGLRLGDKNSSMEELLPNFDAKEATFSMVSRSETFSGTTVYATKAKFSQTGSSHDILIRCGAEAERGEPKGHVLSVCVDKKTMFQVKRLRWNFRGNQTIFVDGLVVDMMWDVHDWLFNSNSASSAVFMFRTRSGLDSRLWLEKSLHAHKEQDKIGFSLLICACKNND

SEQ ID NO: 783 - protein, 331 aa, Glycine max
MGKQSTPQFSALNCIDLSNPDINQSVNLLKEACLDSGFFYVVNHGISQEFMDEVFAQSKKFFSLPHNEKMKTLRNEQHRGYTPVLDELLDPENQVHGDYKEGYYIGVEKGEDDPQSKKPFYGPNNWPAPDVLPGWRETMEKFHQETLEVGKAVAKMIALALDLDANYFDRPEILGEPIAILRLLHYEGQVSDPSKGLYGAGAHTDFGLITLLATDDVPGLQICKDRDAKPQKWEDVAPLKGAFIVNLGDMLERWSNCVFKSTLHRVLGNGQGRYSIAYFLEPSLDCLVECLPTCKSDSNPPKYPPILCHDYMTQRYKDTHADLNIYKKQQA

SEQ ID NO: 784 - protein, 380 aa, Zea mays
MAPAATSTASAPSSFHSTGRHRARVGARPSLVSLRVRAANPNVTADPAPAFQSVTAFAPATVANLGPGFDFLGCAVADASLSLGDTVTATLDPSLPPATVSIASVTSPSRPNLAERLSRDPLRNCAGVAAIAALRALGVRSHAVSIHLTKGLPLGSGLGSSAASAAAAAKAVDALFGSRLGRDDLVLAGLESEKAVSGFHADNIAPAILGGFVLVRSYDPFHLVPLSFPPALRLHFVLVTPDFEAPTSKMRAALPRQVDVQQHVRNSSQAAALVAAVLQGDAGLIGSAMSSDGIVEPTRAPLIPGMAAVKAAALQAGALGCTISGAGPTVVAVIQGEERGEEVARRMVDAFWSAGKLKATATVAQLDTLGARVIATSSLN

SEQ ID NO: 785 - DNA, 1637 bp, Leymus cinereus x Leymus triticoides
  misc_feature (366)..(366): n is a, c, g, or t
  misc_feature (489)..(489): n is a, c, g, or t
  misc_feature (1501)..(1501): n is a, c, g, or t
  misc_feature (1504)..(1504): n is a, c, g, or t
ccgttgctgtcgagcatttcgtgctaggactaggagagtgaagcgatgaagaagaccgtagtcctgtaccctggcctcggcgtcggacacctggtgccgatggtcgagctggccaagctgttcctcaagcacggcctggccgtcaccgtggcgctcgtcgacccgcaggccgagtccaccgacttctccgccgcggtcgcccgcgcgagggcctccaacccctccgtcgccttccatgtcctgccgccgcccgcgtccgccgattccaactccgacagcgcgcccacgcacttcgtcgtgcagattttccgcttcctgaaagccatgaacgcccccctcctcgacttcctccgctcgctgccctcngtccaggcgctcgtcctcgacatgttctgcgtcgacgcccaagatgtcgcggccgagctcaagcttccggtctactacttctacgcgtcggccgccgccgacctcgcgctcttcctccacctncccagcaagctcgccggcagtgaggcagagataaaggagctcggcgactctatcatcactttcccgggtgttcctcccttcaaagcttcggacttacccgaagttacacacaacggtgaagcactcacggctatcttaggaatgttcgaccgaatgccagatgccgatgggattctcattaattccttcgagtcgctggagacgcgcgcggtgcgcgctctcaaggacgggctctgcgtccctggtcgtgcgacgccgccggtctactgcatcgggccgttggtctcgggaggcggagacaaggagcacgactgcctccggtggctggacgcgcagccggaccagagcgtggtgttcctctccttcggcagcctgggcacgttctccggcaagcagctccaggagattgcaattggattggaaaagtcaggggagagattcatgtgggtcgtgcggagcccgcgcagtcccgactacaagtacggcgattcgctgacggagcccgatctcgacgcgctcatgccggaagggttcttggagaggaccaaggacagagggctcgtggtcaagtcttgggcgccgcaggtggaggtcctgcgccatagggcgaccggcgcattcatgacgcactgcggctggaactcgacgctcgagggcatcacggcagggttgccgctgctgtgctggccgctgtacgcggagcagaaggtgaacaaggtgcacatagtggagggaatgaagctcggggtggagatgagaggctacaacgaagaggtggttaaggccgaggaggtggaggagaaggtcaggtgggttatggtgtccgagggcggcagggcgctcagggagcgggtggcagcggcgaaggatgcagcggccgaggcgctcaaggaagggggctcatctcacttggcgtttgtccaattcctcaacgacctgggcacttccatagccgcaaccgtgcagaattgatgtgaaacttgtaaactttaatgttcgatttgtcgcggcntangtacattttgatattatatgcgaactaggtttatttctggaccctttctaagctagtgttgatttgttcgcaaaaaaaaaaaacattgcactctccttcttgtgagtactgaactgttgtctctatttatgga

SEQ ID NO: 786 - DNA, 1627 bp, Triticum aestivum
tttcgtactagaagagtgaagcgaagcgatgaagaagaccgtggtcctgtaccctggcctcggcgtcggccacctggtgccgatggtggaggtcgccaagctgttcctcaagcacggcctcgccgtcaccatggcgctcgtcgagccgcaggtcaagtccactgacttctccgccgcggtcgcccgcgcgagggcctccaacccctccgtcgccttccgcgtcctgccgtcgccgcccgcagattccaaccccgacggcgcgcccaggcaccacgtcgtgaaggttatccaatcgctcgccgccatgaatgcgctcctccgcgacttcctccgctcgctgccctccgtccacgcgctcgtcctcgacatgttctgcgtcgacgcccaggacgtggcagccgagctcaagctgccggtcttctactcattcgcctccgctgccagcgaccttgccatcttcctcaacctgccgagcaagttcgccagcaatacggccaagataaaagagctcggcgactccatcatcaccttcccgggcgttcctcctttcaaggcttcggagctgccctccgaagttatcggcgacgatgaagcactcgtgtacgtcttacgcatgtttgagcgaatggcagaggcgaaaggaattcttatcaattccttcgactcgctggaaaagcccgcactgagcgctctcagcgaaggactttgcgtccctggtcgtgcgacgccgccggtctactgcatcgggccgttggtctccggaggcggagacaaggagcacgagtgcctccgctggctggacgcgcagccggaccagagcgtagtgttcctctccttcggcagcctgggcacattcaccagtaagcagctcgaggaaattgcagttggtctggagaagtcaggggagaggttcctgtgggttgtgcggagcccgcgcagtcccgacgagaagcacggcgatccgctgccggagcctgacctcgacgcgctcatgccggaagggttcttggagaggaccaaggacagagggctcgtggtcaagtcttgggcgccgcaggtggaggtcctgcgtcacagggcaaccggcgcattcatgacgcactgcggctggaactcgacgctggagggcatcacggcagggttgccgctgctgtgctggccgctgtacgcggagcagaaggtgaacaaggtgcacatagtggagggaatgaagctcggggtggagatgagaggctacaatgaaaaggttgttaaggccgaggaggtggaggagaaggtcagatgggttatggcgtccgagggaggaggcagggcactcagggtgcgggtagcggcagcgaaggatgcagcggctgaggcgctccaggaagggggctcgtccaacttggcgtttgcccaattcctaaaggacatggacatttccaaggtcgcaaccatgcacgattgatgtgaagcttgtaaaccctacttagtgttggattttctttttagaaacacaccgaagaaactcacgcaaacttattcctataagaacgcacgagcgcatcctacctctatatgaacacttccggaaagctgagccggaagatcatgagattaatgaagtcacatcaatcattttgtaaaa

SEQ ID NO: 787 - DNA, 1564 bp, Hordeum vulgare
ctttaacaagagtgaagtgaagcgaagcgatgaagaagaccgtcgtcctgtaccctggcctcggcgtcggccacctggtgccgatggtcgaggtcgccaagctgttcctcaagcacggcctggccgtcaccatggcgctcgtcgagccgcaggtcaagtccaccgacttctccgctgctgtcgcccgcgcgagggcctccaacccctccgtcgccttccacgtcctgccgacgccgacgccgccaccgcctgccgatgccaacaccgacggggcgcccaggcaccacgtcgtcaaggttatccaatcgctcgcggccatgaacgcgcccctccgcgacttcctccgctcgctgccctccgtccacgcgctcgtgctcgacatgttctgcgtcgacgccctggacgtggcagccgagctcaagctgccggtctactactcgttcgcctccggcgccggcgacctcgccatcttcctcaacctgccaagcaagttcgccagcaacacggccaaggtaaaagagctcggcgactccatcgtcaccttcccgggtgttcctccgttcaaagcttcggagttgccctccgaagttattggagacggcgaagcattcatgtacctcttacgcatgtttgagcggatgacagaggcgaacgggattcttatcaattccttggaatcgctggaaaagccggcagtgaccgctctcaacgacgggctctgcgtcaccggtcgtgcgacgccgccggtctactgcatcgggccgttggtctcgggaggcggagacaaggagcacgactgcctccggtggctggacgcgcagccggaccagagcgtagtgttcctctccttcggcagcctgggcacattctccagtaagcagctcgaggagatcgcacttggtttggacaagtcgggggagaggttcctgtgggtcgtgcggagcccgcgcagtcccgaccagaaacacggcgatccgctgccggagcctgacctcgacgcgctcatgccggaagggttcttggagaggaccaaggacagagggctcgtggtcaagtcttgggcgccgcaggtggacgtcctgcgccacagggcgaccggcgcattcatgacgcactgcggctggaactcgacgctggagggcatcacggcagggttgccgctgctgtgctggcctctgtacgcggagcagagggtgaacaaggtgcacatagtggacggaatgaagctcggggtggagatgagaggatacaatgaagaggtggttaaggccgaggaggtggaagagaaggtcagatgggttatggcgtctgagggcggcaaggcactcagggagcgggtgacggcggcgaaggatgcagctgccgacgcgctcaaggaaggaggctcgtcgtacttggcgtttgaccaattcctcaacgacatgggcacttccatggtcgcaaccgttcagaattaatgtgaaacttattgaccttgatatttgatttgtcgcggcctaggtacatttcgacattatatgcggactaggtttatttctgagttaattatattattttacataaa

SEQ ID NO: 788 - DNA, 1774 bp, Avena sativa
gagacgcaaacccaaagctcatcgatcgagcaaggaagtttgacacgaaatctaacatcgatttgttccggagagcgccgttatatatattcgcgcagctgctgggtttgtggcaagatcagaacatgaaccttagcatttcagccacaaacgcgcgcgcgaaaacactagaggaagaggtgcaagcgatgaagaaaaccgttgttctgtaccctggcctcggcgtcggccacctggtgccgatggtcgagctcgccaaggtgttcctcaagcacggcgtggccgtcatcgtggcgctcatcgacccgggggccaagtccactgacttctccgccgcggtcgcccgcgccaagacctccaacccctccgtcgacttccacgtcctgccgccgccgccgcccgcgcccgtggactccaactcccagcaggtcgccgcgtccacgcaccacgtcaccaagatatttaagctcctcaccgccatgaacgcgcccctccgcgacttcctccgctcgctgccctccgtcgacgcgctcatcctcgacatgttctgcgccgacgcccaggacgtcgcggccgagctcgagctgccggtctactacttctacgcgtcgggcgccgccgacctcgccatcttcctcaacctgccgagcagggtcgccggcaacacttccaagatgaaggagctcggcgactccgtgatcactttcccgggcgttcctccgttcaaagcttcggacctacccaacgaagtcatcggcgacggcgaggcgctcccggccatcgtaggcatgttcgaccgaatgtcccgtgccgacgggattcttgtcaattcgttcgattcgctggagacgcgcgcggtgcaagctctgagagacgacgggctctgcgtccctggccgtgccacgccgccggtctactgcgtcgggccgttggtctcgggaggaggaggcggagagaaggagcacgagtgcttgcgctggctggacgcgcagccggacaggagcgtggtgttcctttctttcggcagcatgggcacgttctccggtaagcagcttctggagatcgcggtcgggcttgagaaatcaggggagagatttctgtgggtcgtgcggaccccgcgcagtcccgatttcagctatggcgacccgctgccggagcccgacctcgacgcgctcatgccggaagggttcttggagaggaccaaggacagagggctcgtggtcaagtcctgggcgccccaggtggaggtgctccgccacagggcgaccggcgcattcgtcacgcactgcggctggaactcgacgctggagggcatcaccgcagggctgccgctgctctgctggccgctgtacgcggagcagagggtgaacaaggtgcacatagtggaagaaatgaagcttggggtggagatgagaggctacaaccaggaggtggttaaggccgaggaggtggaggagaaagtcaggtgggttatggcgtccgagggcggcgaggcgctcagggagcgggtggcggcagccaaggagggagcagccgaggcgctcaaagaagggggctcgtctcacttggcgtttgttcaattcctcaaggacctggatactgcaaccgtgcaggattgatgtgaacctctgacctctgatgttggatttgtggagcgcccacgtacacttttgatattatatgtacggagtatctatgtttacttctgcgccttctaaatttggaccatctccaagcgaactgtatccatttcgaataccaattgtgttcattt

SEQ ID NO: 789 - DNA, 1290 bp, Zea mays
agggtctattatgtcgttttaccttacaattttgctagatacaaagcataaaaataaataatatatatacaaaaaatccagatgttgatgaaattccattttttgtgttactccattttttgtgttactttagtagattttactctgtttatcctttagtttaattctgtttgaatttcgctgtattctgtaatgtaaatagaacgaaatttattgtgtaaaatgaaatttcaataaaataaaaaaggagtcttcatgtcccgttatcgagggcctcgtttaaaaaaaatacgccgtctgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctcttaattcgtattttcccgttcacctagcagaaatagattaaccctaggatacttttttcttttttgttatttcctcgatgtgtattttacataccacagtaatttgctatagagaatttctattaattaaaggtattattgttggaataaattgttatttaatttgatacattgtgatcgctaacattgatgaattaagagaaacggaaagagagggattcgaaccctcggtaaacaaaagtctacatagcagttccaatgctacgccttgaaccgctcggccatctctcctacataatcttattatggaaaataaactgagtgaatagcgagttttcgtattcctgcagtac

SEQ ID NO: 790 - DNA, 606 bp, Saccharum officinarum
atgtcccgttatcgagggcctcgtttaaaaaaaatacgccgtctgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagacttga

SEQ ID NO: 791 - DNA, 1342 bp, Zea mays
tcttcatgtcccgttatcgagggcctcgtttaaaaaaaatacgccgtctgggagctttaccaggactcactataaaaacgcctaaatacggaagtaatcagaaaaagaaattccattctgggaaaaaagagcaatatcgtattcgtcttcaagaaaaacagaaattgcgtgttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctcttaattcgtattttcccgttcacctagcagaaatagattaaccctaggatacttttttcttttttgttatttcctcgatgtgtattttacataccacagtaatttgctatagagaatttctattaattaaaggtattattgttggaataaatttgttatttaatttgatacattgtgatcgctaacattgatgaattaagagaaacggaaagagagggattcgaaccctcggtaaacaaaagtctacatagcagttccaatgctacgccttgaaccgctcggccatctctcctacataatcttattatggaaaataaactgagtgaatagcgagttttcgtattcctgcagtacaggtacagccacaacggctcgggaattccatggctctattggattggatggaaaaattccttttcatctaagtggaaggatcctgtatttttttactaggaattctgctccctcgaaaagtttttttttggggaaaaccaaaataaaaagagaatggaagaattcttcttattccataagaaaataaaggaaccctagaattccatttgcataaggtacattacgccatacaatctaaatataaaaggggtatggggcaattaatgacttcgaaaacgcgaaatagctgatgagggaagtt

SEQ ID NO: 792 - DNA, 603 bp, Zea mays
atgtcccgttatcgagggcctcgtttaaaaaaaatacgccgtctgggagctttaccaggactcactataaaaacgcctaaatacggaagtaatcagaaaaagaaattccattctgggaaaaaagagcaatatcgtattcgtcttcaagaaaaacagaaattgcgtgttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagact

SEQ ID NO: 793 - DNA, 755 bp, Zea mays
gttactttagtagattttactctgtttatcctttagtttaattctgtttgaatttcgctgtattctgtaatgtaaatagaacaaaatttattgtgtaaaatgaaatttcaataaaataaaaaaggagtcttcatgtcccgttatcgagggcctcgtttaaaaaaaatacgccgtttgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcactggaaaagcaaaaagatccacatgtcaggttttactacaattacttgaaatgtgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaacaaattctagataggaagtgggtcggtctcaaaataaatgagttgttagttgtagaatattattctcgccagacttgaacttaacgaaaaaagga

SEQ ID NO: 794 - DNA, 640 bp, Zea mays
gtgtaaaatgaaatttcataaataaaaaggagtcttcatgtcccgttatcgagggcctcgtttaaaaaaaatacgccgtttgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcactggaaaagcaaaaagatccacatgtcaggttttactacaattacttgaaatgtgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaacaaattctagataggaagtgggtcggtctcaaaataaatgagttgttagttgtagaatattattctcgccagact

SEQ ID NO: 795 - DNA, 6896 bp, Oryza sativa
gtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggcaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagttttgccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaattcatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcagataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatag

SEQ ID NO: 796 - DNA, 1402 bp, Oryza sativa
ataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcggtctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaatttttcttcccttcccctttc

SEQ ID NO: 797 - DNA, 7214 bp, Triticum aestivum
tgaagtctcatagtcaactcttgcagtggaacgatagagactccatttcacttaggttgatttaatttagaccggaggcagacctaagtcaaggtaatcctcctttgaaacactttggtattgctcctagatagatcataatacaaaaaaatcaatcagagcacagggagccatctcattatctttccgtaaagaaaaagtatggtggactaactgatctttaaatcagtttatgaaagagcccaatgcaaaaaaatgcatgttgggtctttgaaacagttcaaatcatttcgataataatccgtttgatctgttttaccgagaaggtctacggttcgaatccgtatagccctaatatgcccttttttagattttaggatctctatcctatgttttctttagtttagtatagttttcattttctcattagtatttgtttatagactggataagcgcctgcgacatagaatagagataaaagcattacaaaaggctcattcatcgaaaatcaaaatcatacagacaggaaaagaaaaacgaatttctatcaaatcaatagaagaaaggatcctttccctgatttgaatcccgtcctccttcaaataggatatctctagacttccctataataactgcaatgattttatccattttgcgaattcctactttgttttaagtatatttattactttgtttatagatacattatgtaaattgatcaactttaaatagaaaaataaagtaaagagtaaataagaaaacagaatattctgtctcatagttctgaaatagagttctttatttttattttatagtattacttctcattaattatactgcatagattagtcctactatcttaattaggttctaatttagtagtattctcatttttatttaatagtctcttattattttattattaaatattaaataaaggatagagctattcttttttctagagattctagagaaagcgagacaaagtgaaacgagaaagttttctttatataagaattagatctacatacaccatatctaaatagaatggaaatccaaaagaaagggagttgggattccattggatgaatctttaaagaagatgcagcacagaggaaacaaaggctaaactaagcgcttttgtttgaacaaaaaagattcttgtttcaccgaggaaaagagagaagttctggataaattgacaatgctgaattgaattgactaatttaagttccgcctattccacattaatgggagtacattatgtttctgctttacgaatatgatattttttggacatttctaataatagcaagccttattcctattttggcattttcgatttcaggacttttagccccggttagtgaaggaccagagaagctttctagttatgaatcgggtatagaacccatgggaggggcttgggtacaattccgaatacgctattatatgtttgcgctcgtttttgttgtttttgatgtggaaaccgtctttctatacccttgggcaatgagtttcgacgtattgggtgtatccgtttttatcgaagctttgattttcgtgcttatcttagttgttggtttagtttatgcatggcgaaaaggagccttggaatggtcttaactgaatatttagacaaaaaaaagaaggaaaagattctattgagacagttatgaatttgattgagtttcccttacttgaccaaacaagttccaattctgttatttcaactacactaaatgatctttcgaattggtcaagactctctagtttatggccccttctatacggtaccagttgttgtttcattgaatttgcttcattaataggctcaagattcgactttgatcgttatggattggtaccaagatcaagtcctaggcaagcagacctaattttaacagccggtacggtaacaatgaaaatggctccctctttagtgagattatacgagcaaatgcctgaaccaaaatacgtcattgctatgggagcctgtactattacagggggaatgttcagtacggattcctatagtactgttcggggagttgataagttaattcctgtggatgtctacttgccgggctgcccacctaaaccggaggcagttatagatgccctaacaaaacttcgtaagaagatatcgcgagaaatagttgaggatcgaactctatctcaaaataaaaatagatgttttactaccagtcacaagctttatgttaggcgcagtactcatacaggaacttatgagcaagaattgctctatcaatcaccatctacattagatatatcttctgaaacttttttcaaatccaaaagttcagtaccttcctacaaattagtgaattaggaggggggctcttttgtgtagaaaaataaaaagcagggcaatctttcaaacttgcatccgaaatgtgaaatatttatacaaagagggagagatgaagacaatgcagcagggttggttatctaattggctagtcaaacatgaggtggttcatagatctttgggctttgatcaccgaggaatagagactttacaaataaaagcaggggattgggattccattgctgtcattttatatgtatatggttacaattatttacgctcccaatgtgcttatgatgtagcacccggtggatctttagctagcgtgtatcatcttacgagaatacaatatggtatagataatccagaagaagtctgcataaaagtctttgcccaaaaggataatcctagaattccgtctgtcttctggatttggagaagtgccgattttcaagaacgcgaatcttatgatatggtgggaatctcttatgataatcatccgcgccttaaacgtatcctaatgcctgaaagttggataggctggcccttacgtaaggattatataacccccaatttttatgaaatacaagatgctcattgaatgataagaaattcatgctcacttatacaacacaactccagattttattcaagtcaaggaatatttttaggttcttttcctagatgaaacggaatacctatttataattaattcctaattatacaaaagcattccagatagactgagcaaaaaaagggtttcatttggattcccctattttgaaaatcgcatattaatttccttcatatgaacagaaaaataggatgactcaaagaagttctctaccaggaactttgtaccgcgcacattacttagcacaactaggaaaataagataagataaagataagcaagactaaaaaatattcgtcggaatagcggaatacaaattagatgaataaatattattaatgaatatgtatcacaatccatctcgaggtatttggatcaatacctattcggtggatctttttttttttttttctctgccaggaaccagatttgaactggtgacacgaggattttcagtcctctgctctaccaactgagctatcctgaccttttcttgtgcatcatcctagtagagtatttgtatctatgtcaattaaaaggactaaaaattaattaaagtatttcaaatttaaaatttgaaaatgggggggtagtcctatgcattgtgcatggtttacttaaataaaacttaaaaatagagtgaataaccaagatttcttgccgatactctaataaaaaagaaatctattcaatgaataggataagatccattgagttctcttcgcattcctttgtgaaagagtagaatgagaaagctaatgaatcttaaacccattgataaaaagaaaaaaaagaggataaataataataatatagtatagttagggaataaaagaggatttggggatagagggacttgaaccctcacaacttataaagtcgacggattttccttttactagaaatttcattgttgtcagtattgacatgtagaatgggactctctctttgtcctcgtccgattaatccacttttttaaagatctcgaaaactttgaatttgaattgaagaatttgattattcaatattcgattggagtggattcacaataatgaaaaaaaattatgatatgagtttttatgagttttttatttcataatcattatcatttctaatttcatttttaaaaaagataaagaacctatattataattataatataatatgagttctgtgattaatcgtttgctatgtcagtatctatacgtgtttattaaatgtataaggtataaaacccctctttctctaatttagaattagaaggaattccactaacaacacaacgtaattaactcgattcgttagaacagcttccattgagtctctgcacctatccttttcctttgtattctagttcgagaaccccttgttttctcaaaacacggatttggctcaggattgcccttttttaattccagggtttctctgaatttggaagttaccacttagcaggtttccataccaaggctcaatacaatcaagtccgtagcgtctaccgatttcgccatatccccatttccctcttctttgagaccaggattccttgtgtaatttcatccatctcttagttttttttgaatcattgagttcatcactcaacgtagtctagcagttcagttcgactctatttgagagacctcgcttgcttattgcaattcagaattgaattgattctatccttgatgtatttgcaattcaatccgaatcaatatatccaaaagtttttatctcccccacctcccgtcttacttttttatagtattccaaattatactataacgcttgatatttattctttttttctaatcagaattagcaattttatttactctgactctatgttccccttagtgaaatattaatcctcaaattattaacaaataataaagtctataatgatcgaatgaaaataccaataaattctataattttattttttaatatcctatagttaagcatatcaagctaactttatctttaagaagttttagtatttttttatttttataagtataacttcaaatttagaactagttaatagctaagattaataactaatatctgagattttacggatttcctatactatacctatttctatttgttacactatttccgttatgtaagcccacttagctcagaggttagagcatcgcatttgtaatgcgagggtcatcggttcaaatccgatagtcggcttttttttctctatcgatgttctacgaacaagaatctctttttttccgaattaaatggagaatccaggatcttttatgttttttaccttacaattttgctagatacaaaacaataaaataaataatatatatacaaaaaataaagattttgatgaaattccatttttttgggtactttagttgattttactctgtttatcctgtagtttaattcagttttaatttcgatgtattctgtaatgtaaatacaatgaaattaattgtgtaaaatgaaatttcaataaaataaaaaaaggagtcttcatgtcccgttatcgaggacctcgtttaaaaaaaatacgccgtctgggagctttaccaggactcactagaaaaacacctaaatccggaagtaatcttaaaaaaaaattcaattctgggaaaaaggagcaatatcgtattcgtcttcaagaaaaacagaaattgcgttttcattatggtctgacagaacgacaattacttagatatgtacatatcgctggaaaagcaaaaaggtcaacaggccaggttttactacaattacttgaaatgcgtttggataatatcctttttcgattgggtatggcttcaaccattcctggggcccgccaattagtcaaccatagacatattttagttaatggtcgtatagtcaatataccaagttttcgttgcaaaccccgagatattattactacgaaagataaccaaagatcaaaaggtctggttcaaaattatattgcttcatcggacccggggaaattgccaaagcatttggcgattgacacgttggaatataaaggactagtaaataaaatcctagataggaagtgggtcggtctcaaaataaatgagttgttagttgtagaatattactctcgtcagacttgaacttaacgaaaaaaggaaaggttcatagaattttcttccccttcccctttccccgaactaaatcgccctaagaccattaccattaatttgtattttcccatcaactagctaaaattgattaaccctaggattaggatccttttttcttttttcctctatgtgtattttacataccacagtaatttgctatagagaatttctaatttctattaaatcaaaataagataatataagatattatattattgctggaaaaaattgttatttgatttgatacattgtgatccttaacgttgatgaattaagaaaaacggaaagagagggattcgaaccctcggtaaacaaaagtctacatagcagttccaatgctacgccttgaaccgctcggccatctctcctacataacttattatggaaaataaactgagtgaatagcgagttttcttattcctgcagtacaggtacaaccgcaaccactcgggggttccatagttctattggaaaaattccttttgatctaagtggaaggatacaggattttttactagaaattgcgctcgctataaaataaaagttttaatttgggttttcccgcaactaaagaaaaagaaaatggaagaattcttcttattgcataataaaataaagaaaccttagaattccgtttgcataagatacgctacaccatactatcgaaatcaaaaatagggtatgagacaattaataactttgaaaacacgaaatagttgataacataagttgttgttcagaaataggaaagtggaatgaaatccagtcttagtcaaatatttcatatctcttcgtgtccaagcagaaggaaaaggatacaatttgagctgagcggaaaatccatatctctcttatccatttaaagcatatggatttagagtagagcatatggatcaatctatttataattataagaatcgaatgtgtttgtttttatgttattttgtgaaggaatgaaaacaattctatatagaatgggttgggaattatgcctagatcccgtgtaaatggaaatttcattgataagaccttctcaattgtagccaatattttattgcgaataattccgacaacctcaggagaaaaaaaggcatttacttattatagagatg

SEQ ID NO: 798 - DNA, 732 bp, Hordeum vulgare
ctttagttgattttactctgtttatcctgtagtttaattcagttttaatttcgatgtattctgtaatgtaaatacaatgaaattaattgtgtaaaatgaaatttcaataaaaaaaaggagtcttcatgtcccgttatcgaggacctcgtttaaaaaaaatacgccgtttgggagctttaccaggactcactagaaaaacacctaaatccggaagtaatcttaaaaaaaaattcaattctgggaaaaaggagcaatatcgtattcgtcttcaagaaaaacagaaattgcgttttcattatggtctgacagaacgacaattacttagatatgtacatatcgctggaaaagcaaaaaggtcaacaggccaggttttactacaattacttgaaatgcgtttggataatatcctttttcgattgggtatggcttcaaccattcctggggcccgccaattagtcaaccatagacatattttagttaatggccgtatagtcaatataccaagttttcgttgcaaaccccgagatattattactacgaaagataaccaaagatcaaaaggtcctggttcaaaattttattgcttcatcggacccggggaaattgccaagccatttgacgattgacacattggaatataaaggactagtaaataaaatcctagataggaagtgggtcggtctcaaaataaatgagttgttagttgtagaatattactctcgtcagacttga

SEQ ID NO: 799 - DNA, 737 bp, Hordeum vulgare
gtggtactttagttgattttactctgtttatcctgtagtttaattcagttttaatttcgatgtattctgtaatgtaaatacaatgaaattaattgtgtaaaatgaaatttcaataaaaaaaaggagtcttcatgtcccgttatcgaggacctcgtttaaaaaaaatacgccgtttgggagctttaccaggactcactagaaaaacacctaaatccggaagtaatcttaaaaaaaaattcaattctgggaaaaaggagcaatatcgtattcgtcttcaagaaaaacagaaattgcgttttcattatggtctgacagaacgacaattacttagatatgtacatatcgctggaaaagcaaaaaggtcaacaggccaggttttactacaattacttgaaatgcgtttggataatatcctttttcgattgggtatggcttcaaccattcctggggcccgccaattagtcaaccatagacatattttagttaatggccgtatagtcaatataccaagttttcgttgcaaaccccgagatattattactacgaaagataaccaaagatcaaaaggtctggttcaaaattttattgcttcatcggacccggggaaattgccaagccatttgacgattgacacattggaatataaaggactagtaaataaaatcctagataggaagtgggtcggtctcaaaataaatgagttgttagttgtagaatattactctcgtcagacttga

SEQ ID NO: 800 - DNA, 2261 bp, Brachypodium distachyon
cagttcgattctatttgagagaccacgcttgtttattgcaattcagaattgcattgattctatcgttgctgtatttgcaattcaatccgaatcaatatatcccaaaatttttctctcccccaccgctcatcttacttttttagagtattaaaaatcatactataacgcttgatattcattttttttctactcaaaattggcaattttatttgctatgactttatgttctccttagagaaataggaatcctcaaattattaacaaataaaaaaagatagaaataaaaagaaagttcaataaattctatacttttatttaaggatatcctctagttaagcatatcaagctaactttatctttaaaaagttctagtatttttttaagtagaacttcaaattgagaactagttaatagctaagattaataactaagatctcagattttacggatttctatactatacctatttctatttgttacactatttctgctatctaagcccacttagctcagaggttagagcatcgcatttgtaatgcgagggtcatcggttcaaatccgatagtcggcttttttttcgtatcgatgttctacgaacaagaatctcttttttttttcggattaaatggggaatccaggatcttttttgttttctaccttacaattttgctagatacaaaagaataaaataaatatatatatacaaaaaatccagatgttgatgaaattctattttttatggtactttagttgattttactctgtttatcctttagtttaattcagttttaatttcgatgtattccgtaatgtaaatacaatgaaattaattgtgtaaaatgaaatttcaataaaataaaaaaggagtcttcatgtcccgttatcgaggacctcgtttaaaaaaaatacgccgtctgggagctttaccaggactcactagaaaaacacctaaatccggaagtaatctgaaaaagaaattccattctgggaaaaaggagcaatatcgtattcgtcttcaagaaaaacagaaattgcgttttcattatggtctgacagaacgacaattacttagatatgtacatatcgctggaaaagcaaaaaggtccacaggtcaggttttactacaattacttgaaatgcgtttggataatatcctttttcgattgggtatggcggcaaccattcctggggcccgccaattagtcaaccatagacatattttggttaatggtcgtatagttaatataccaagttttcgttgcaaacctcgagatattattactacgaaagataaccaaagatcacaaagtctggttcaaaattctattgcttcatccgacccgggaaaattgccaaagcatttgacgattgacacattggaatataaaggactagtaaataaaatcctagataggaagtgggtaggtctcaaaataaatgagttgttagttgtagaatattactctcgtcagacttgaacttaacgaaaaaaggaaaggttcatagaattttcttccccttttcccgaactaaatcgacctaaggccctaattcgtattttcctactcaactagcaaaaatggattaacccgaggatcttcttttctctatgtgtatttttacataccacagtaatttgctatagagaatttctattaaataagggtaagggtattattgctggaataaattgttatttgatttgatacactgtgctccttaacgttgatgaattaagaaaaacggaaagagagggattcgaaccctcggtaaacaaaagtctacatagcagttccaatgctacgccttgaaccgctcggccatctctcccacataactcattatggcaaataaactgagtaaatagcgagttttcctattcctgcagtacaagtacaaccgctcaggggttccatagttctattggaaaaattccttttgatgatttttttactaggaattgcttcccctataaaagttttagtttggattttcctaaaaccaaagaaaaagagaatggaagaattcttcttattgcataataaaataaagaaaccttagaattctgtttgcataaggtacgctacaccagactatcgaaatcgaaaataaggtatgagacaattaataactttgaaaacacgaaatagctgatgagcgaagttgttgttgagaaataggaaagtagaatcaaacccagtcttagtcaaatatttaatatatcttcttgtccaaacagaaagaaaaggaaaaaattaaag

SEQ ID NO: 801 - DNA, 626 bp, Brachypodium distachyon
tcttcatgtcccgttatcgaggacctcgtttaaaaaaaatacgccgtctgggagctttaccaggactcactagaaaaacacctaaatccggaagtaatctgaaaaagaaattccattctgggaaaaaggagcaatatcgtattcgtcttcaagaaaaacagaaattgcgttttcattatggtctgacagaacgacaattactagatatgtacatatcgctggaaagcaaaaaggtccacaggtcaggttttactacaattacttgaaatgcgtttggataatatcctttttcgattgggtatggcggcaaccattcctggggcccgccaattagtcaaccatagacatattttggttaatggtcgtatagttaatataccaagttttcgttgcaaacctcgagatattattactacgaaagataaccaaagatcacaaagtctggttcaaaattctattgcttcatccgacccgggaaaattgccaaagcatttgacgattgacacattggaatataaaggactagtaaataaaatcctagataggaagtgggtaggtctcaaaataaatgagttgttagttgtagaatattactctcgtcagacttgaacttaacgaaaaaagga

SEQ ID NO: 802 - DNA, 910 bp, Lolium multiflorum
atgtcccgttatcgaggacctcgtttaaaaaaaatacgccgtttgggagctttaccaggactcactagaaaaacacctaaatccggaagtaatctgaattccattctgggaaaaaggagcaatatcgtattcgtcttcaagaaaaacagaaattacgttttcattatggtctgacagaacgacaattacttagatatgtacatatcgctggaaaagcaaaaaggtcaacaggccaggttttattacaattacttgaaatgcgtttggataatatcctttttcgattgggtatggcctcaaccattcctggggctcgtcaattagtaaaccatagacatattttagttaatggtcgtatagtcaatataccaagttttcgttgcaaaccccgagatattattactacgaaagataaccaaagatcaaaaggtctggttcaaactttgatggcttcatccgacccagggaaattgccaaagcatttgacgattgacacattagaatataaaggactagtaaataaaatcctagataggaagtgggtcggtctcaaaataaatgagttgttagttgtagaatattactctcgtcagacttgagcttaacgaaaaaaggaaaggttcatagaattttcttccccttaccgtttccccgaactaaatcgacctaagaccactaatttgtattttcccactcaactagcaaaaatggattaagcctaggatctttttttcctctatgtgtattttacatcccacagtaatttgctatagataatttctattaaataagatattattgctagaataaattgttatttgatttgatacattgtgatccttaaggttgatgaattaagaaaaatggcaaagagagggattcgaaccctcggtaaacaaaagtctacata

SEQ ID NO: 803 - DNA, 554 bp, Zea mays
ctcactagaaaaacgcctaaatccggaagtaatcagaaaaagaaattccattctgggaaaaaagagcaatatcgtattcgtcttcaagaaaaacagaaattgcgttttcattatggtctgacagaacgtcaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagacttgaacttaacg

SEQ ID NO: 804 - DNA, 543 bp, Zea mays
ctcactagaaaaacgcctaaatccggaagtaatcagaaaaagaaattccattctgggaaaaaagagcaatatcgtattcgtcttcaagaaaaacagaaattgcgttttcattatggtctgacagaacgtcaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagact

SEQ ID NO: 805 - DNA, 742 bp, Zea mays
gattttactctgtttatcctttagtttaattctgtttgaatttcgttgtattctgtaatgtaaatagaacgaaatttattgtgtaaaatgaaatttcaataaaataaaaaaggagtcttcatgtcctgttatcgagggcctcgtttaaaaaaaattcgccgtctgggagctttaccaggactcactagaaaaacgcctaaatccagaagtaatcagaaaaagaaattccattcttggaaaaaagagcaatatcgtattcgtcttcaagaaaaacagaaattgtgttttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatatgccaagctttcgttgcaaaccccgagatattattactacgaaggataagcaacgatcaaaacgtttggttcaaaattatattgcttcatccgatccgggcaaattaccaaagcatttgacggttgacacattgcaatataaaggactagtaaaaaaattctagataggaagtgggtcggtctcgaaataaatgagttgttagttgtagaatattattctcgccagacttgaacttaacgaaaaaagga

SEQ ID NO: 806 - DNA, 602 bp, Zea mays
atgtcctgttatcgagggcctcgtttaaaaaaaattcgccgtctgggagctttaccaggactcactagaaaaacgcctaaatccagaagtaatcagaaaaagaaattccattcttggaaaaaagagcaatatcgtattcgtcttcaagaaaaacagaaattgtgttttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatatgccaagctttcgttgcaaaccccgagatattattactacgaaggataagcaacgatcaaaacgtttggttcaaaattatattgcttcatccgatccgggcaaattaccaaagcatttgacggttgacacattgcaatataaaggactagtaaaaaaattctagataggaagtgggtcggtctcgaaataaatgagttgttagttgtagaatattattctcgccagact

SEQ ID NO: 807 - DNA, 603 bp, Musa acuminata
atgtctcgttaccgaggacctcgtttcaaaaaaatacgccgtctgggggctttaccaggactaactagtaaaagacctagatccggaagtgatcttaaaaaccaattgcgttctgggaaaagatcgcagtatcgtattcgtctagaagaaaaacagaaattgcgttttcattatggtctgacagagcgacaattacttagatatgtgcatatcgctggaaaagctaaagggtcaacaggtcaggttttactacaattacttgagatgcgtttggataacatccttttccgattgggtatggcttcgaccattcctggagccaggcaattagttaaccatagacatattttagttaatggtcgtatagtggatataccaagttatcgttgtaaacccagagatattattactacgaaggataaacaaagatcgaaagctctgattcaaaattatattgccttatccccccccgaggaattgccaaaacatttgacttttgactcattccaatataaaggagtagtaaatcaaataatagatagtaaatggatcgatttgaaaataaatgagttgttagtcgtagaatattattcccgtcagact

SEQ ID NO: 808 - DNA, 11106 bp, Papaver somniferum
tattcttttcctttttttaaaaacagaacttaaagaaaaagggtaggattttctctctttagaaattccgacgaaagcatgtatgtatgctgatttcaaatcgaatttgtatgaatatttattattaaccacaggttaataatggatgctcaatggcaggaacttaacagtagatactcaatctcaggagaccagatttgaactggtgacacgaggattttcagtcctctgctctaccaactgagctatcccaacccttcttgaggcaccatccccatcctactagaggatttgggtatatgtcaattcaagagaataaaaaagcattacaaaatcttacccaggccctggaatttccggaatcttcaaaaaagaaaacttttagagttgaaaataatgatgtgaactgtgaatgattcaaacagggattccttgatcatagagtttccgttgtacatatataccacaagacttgtgatacgagagaggcttttctgctccgatccttttgtgaaataatatagtgaatgagaaatatagctaattttcgggcgctgcggaaaagaaaaaagagtagaagtataaagaaacagttagggagtaaaacgggcctttttgtggggatagagggacttgaaccctcacgatttataaagtcgacggattttcctcttactataaatttcattgttgtctgtattgatattgacatgtagaacgggactctatctttattctcgtccgattaatcagttcgtcaaaagatatatcagactatggagtgaatggtttgattactgaatattcgattcttccttcaacttggaatagattcacaaaaattattccttttttttatgtaaaaaaattttagggcgacattaatagaatctttgatatttcagtacgtatacttacgtatcgtaggtttatccctcattctttatggagtttaaattcaaattgaatagaaggagtcctctaccaacgcagtcaactccattcattagaacagcttccattgagtctctgcacctatcctttttttattctcgctttcagaaataccttaatttttttctgaaaacaggatttggctcaggattgcccatttttaattccagggtttctctgaatttgaaagttatcacttagtaggtttccataccaaggctcaattcaatcaagtccgtagcgtctaccgatttcgccatatcccctttttagtttgagccgaagatctcgctgggatgccatccccttctttctttcgtttatgctggaaccgttaaccgttgaattcattagatacagcttatctatctaaaaagtttatctctttactcctcctttgatttcttttatttctttcttatttacccctttttctatattgaaggacctacatttggtttaatcagaaatgattctatcattgatgtatccgcaattcaatatggatggatatataccacatatatattcctctcttcctcgcacttttcctacccgattttaaatacttgaacgttcgattctttttttagaattccatattttttcttaatttctaataatttagaatgaagatattgataatcatattcatataaattataaatataaaagagaatcatggaaaagaaaaatgtagaatttcttcccattgaaaattttgatatcatatatcactctatttatcgttatattaattcttatgttatattatattgttatagaataacattctattcagtattcattttttctctattcatattcattatctattttgaatagctaagagctaagtagttgactgaattcctatgcacaacacaatttctgttatgtgagcccgcttagctcagaggttagagcatcgcatttgtaatgcgatggtcatcggttcgattccgatagccggcttttctctctttgttctattttatactttattacatgattaataatgtctccttgaactcaaggaatattgaaaagacttctttccttttctcaaaaatagcggatctattatgtcgtaagaacttccaactatgaataaaaaacagattcgagcggttggttagatctctacagaacaaattaagacaaagtctccttaccttgctatatatacaaaagagtctgaatattgatacaattcatctcattcttctttgtagtacagtacttaacttcagtatatttttttcgtttatcgtttagttcagtcttaatttaggtttattctgtaaataaaaaaaggagtttttatgtctcgttaccgagggcctcgtttcaaaaaaatacgccgtctgggggctttaccgggactaactagtaaaaggcctaaagccggaaatgatcttagaaatcaatcgcgttctgtgaaaaagtctcaatatcgtattcgtctagaagaaaaacaaaaattgcggtttcattatggtctgacagagcgacaattacttaaatatgttcgtatcgccggaaaagccaaagggtcaactggtcaagttttactacaattacttgaaatgcgtttggataacatactttttcgattgggtatggcttcgaccattcctggagctcggcaattagttaaccatagacatattttagttaatggccatatagtagatataccaagttatcgctgcaaaccccgagatattattacgacgagggatgaacaaaaatccaaagctctgattcaaaattatcttgattcatcctcccatgaagaattgccaaaacatttgactcttcattcatcccaatataaagggttagtcaatcaaataatagatagtaagtgggtcggcttgaaaataaacgaattgctggtcgtagaatattattcccgtcagacttgaacctaactcaaatagcaaggcaaggattcggagaattttgcccccttttcgccgaagtaaattgaccgaagctaagctaaggggtgtgatccggatatttttcccatttcatgtatcataaatggatccgcggggatatttttatgtcttggctaccctttatcaatatttttcgtaccaccccaattaggaatagagaattcatttcaaagaaaggtctacctcttggaataatcctattccttgtttgtttgttatttgatccattgtggtcaataacgctcttgaattaggcaaaggtaaggaaagagagggattcgaaccctcggtaaacaaaagcctacatagcagttccaatgctacgccttcaaccactcggccatctctcctacaaaattttatgattatgacccagaaatcgggtcaatagcgagccattcatatttatttttgcagtataggtacgaccaaccgattctaacaattcgaaatatgaaaacggatggggtggtattttgatcatagaacgattattctattctttttccttctttgaatcataatccaataaaaaacttctcgagttatcataatctgtaggaaatattaatttcatgtttagaacgagtcttttttttatgttatttcgtcctgtacaattcctttgtttgtgggaatcttttcccatgcgaggtaatgagaagaattatagaatggattgcgaactatgcctagatcacggataaatggaaattttattgataagacctcttcaattgtggccaatatcttattacgcataattccgacaacttccggagaaaaagaggcatttacctattatagagatggtgtgatttgattctatttagtgttctctgtcttacgagtaaaggcacgcagggttggattcggtataaaacgaaacgcgtttattgaaataaaccttaaaaaaatctacgcttcttgaaggtgaagtttggaaatagaacaattccttctattgtgtatccccgattgatgcagcctcagatgcttcaattttctaatctagtattgaacgaaaggttacacctataggttctttctgtattagaggtcaatcctactccatcagtaccaaccaataggcggcataggggaagaagcactacacctaggaatcaacaaaaaaaactttgttataaattatccctttccttatcgggatcggaactaacaagaatggttgggacaacaaacatccatctcgtttgtactttggatacctatataaccatcaaagactgttgaagtgactaattcctggaaatagggggcgttgaggacaaagaaattgttggagtaaccttttctatctagcaacaacacgattagtgttaagaaaagacctcttgcaggaaggctgactagatatttcttgtaaaaacactagtccctgtcagttcataatgagaatatttcgatattcttttggttccatggattattatcgttcattatgcacagaagggaggagccgtatgagatgaaaatctcacgtacggttctgaaacggggattctttgaatagaatgaacgaccgcaacggatgtcagctcaatccgaaggaaattatgcggaagctttacagaattattatgaagctatgagactagaaattgatccctatgatcgaagttatatactgtataacataggccttatccacacaagtaacggagaacatacaaaagctttggaatattatttccgggcattagaacgaaatccattcttaccacaagcttttaataatatggccgtgatctgtcattacgtgcgactatctccactatagaaagagggaaagaaagataaaatacgctagtaaatactagcggataggctttctacatatgtatcgtacaaagcaacgatttttattagctgtagcaaagaaagagacttcataaaagcaaaaaaatgaagaaatggatatgcctataatactatattctatggatagataaaagatctaattgatagaggaagcgccgtaaagatcaattagtgaaatttttggccgatacaataagaaaaaactgcttacttatgtcatgatatgagatataatttaggaatcaacttatgtaatagagttgatccactaaggtattgagcagcggtgtagcatcagatcccaaagatagtaagtcctttctttcttagagaggaaagtctttttcaaagattctatatgaaaatgaaactgagatagttacctttcagaaaaagataggatagtgggtttcgtttttctgaaggtaggagaaaagataaaacttattttgaataaaaatgcaagtttaaaacttatgtaaatataattaaccccttctggttaacccgagaaacaaaaatgggatagatttatgaaaaatcttatttagttagtatagggtcgattaagatgggacaccaaaataattgattgctgagccgtatgaggtaggaaactctcaagtacggttctaagggaaggaatcgacccacctattccgaccgaggagaacaggctattcggcagggagattctgaaattgcggaagcttggtccgatcaagcggctgagtattggaaacaagctatagcgcttactccaggtaattatattgaagcgcataattggttgaagatcacgcggcggtttgaataagaacactctttttatccgtcagtaaaataaaatagatctttcctctgggaagagctaatcaaggaatttcattgtatcccttctaagattgttctgttctatttcgtctagtacctcgtaggcataaacgatacccgactacagtacatcatacatccctttttgctattcaaactaaaaaagcctttgaatgtggatactggggtcttattcatgactgccccaatgaagtgatttggaatcgagcaatagtcatagttccatgtaagatacgaagtagctccatctaagcacctgtaatttgcatatgaataaaaaaaaaaaagagtttttgtgtcaagtcgaagccgggaaaggattttcaaatattataaaggtccgttgagcgcctcatggctatgtcataatagatccgaacacttgccccggatcgacttccagatcataattgctctagtaaataactaaacaaaataaataactgggagataggaaggaaaggaactaattataaatagatttcagaagttcactaattacttgactgttggcaggtctctttgtatgtgttgtccggaaagaggaggactcaatgattattcgttcgccggaaccagaagttaaaattttggtggatcgggatcccgtaaaaacttctttcgaggaatgggccagaccaggtcatttctcaagaacaatagctaaaggccctgatactaccacttggatctggaacctacatgccgatgctcacgatttcgatagccataccagtgatttggaggagatctcccgaaaagtatttagtgcccatttcggtcaactctccatcatatttctttggctgagtggcatgtatttccacggtgcccgtttttccaattatgaagcatggctaagcgatcctactcacattagacccagcgctcaggtggtttggccgatcgtgggccaagaaatattgaatggtgatgtgggtggtggtttccgaggaatacaaataacctctgggttttttcagatttggagagcgtctggaataactagtgaattacaactctattgtactgcaattggtgcattggtctttgcggcgttaatgctttttgctggttggttccattatcacaaagctgctccaaagttggcttggttccaagatgtagaatccatgttgaatcaccatttagcggggttactaggacttggatctctttcttgggcgggacaccaaatacatgtctctttaccaattaaccaatttctagacgctggagtagatcctaaggagatcccacttccccatgaatttatcttgaaccgggatcttttggctcaactttatccaagttttgccgagggagcaaccccgtttttcaccttgaattggtcaaaatatgccgaatttcttacttttcgtggaggattagatccagtaacagggggtctatggctgaccgatattgcacaccatcatttagctattgcaattcttttcctgatagccggtcacatgtataggactaactgggggattggtcatggcctgaaagatattttagaggctcataaaggtccatttacaggccagggccataaagggctatatgaaatcctaacaacgtcatggcatgctcaattatctctaaatttagctatgttaggctctttaaccattgttgtagctcaccatatgtatgccatgcctccttatccatatctcgctactgactatggtacagtactttcgttgttcacacatcacatgtggatcggtggatttctcatagttggtgctgctgcacatgcagccatttttatggtaagagattatgatccaactactcgatacaacgatctattagatcgtgtccttaggcaccgcgatgcaatcatatcgcatctcaactgggcatgtatatttctaggctttcacagttttggtttgtatattcataatgataccatgagcgctttagggcgtccgcaagatatgttttcagataccgcaattcaattacaacccgtctttgctcaatgggtacaaaacactcacgctttagcacctggtgcaacagctcctggtgcaacaacaagcaccagcttgacttgggggggtagtggtttagtagcagtaggtggtaaagtagctttgttacctattccattaggaaccgcagattttttggtacatcacattcatgcatttacgatccatgtaacggtattaatactactgaaaggtgttctatttgctcgtagttcccgtttgatacctgataaagcaaatctgggttttcgtttccctcgggacggagtggaaggtcaaccagcggtagacgtctcttgcaagaagaaattcaaagagcggcgaagaaatccgtctgtattgaccggccgattgtaacgaatgtacggtacgcgcggaacaagagaaggcagtggcgaagaacgagcgcttccccctttctagatctctccttttatgcgtggggcaaccgatgctccgagaactgactaacggaatcacgtgaacagtcaaacgagaaagcctttgatcggttgcgcgcggaatgatattagatgactatggaacttagggctagtttgtaagcccctctttcgtgtgctagccgaccgataactagtccagtgattcaagctagcgagaagcaaccccgcttttgtttgctctgtccagtcagtctttattacgtctagctgctccatgctctcggcttcggtaactctatccccttccccttcatttgtagaatatacagccgagttcccaggtcaagattgaagcatagtttgtgctcttcgaatgaaaattcttagtcagatcagtgctttcaagaacttcttcttcgagcatctacagcggctggatatgcgcattccaaactagcaaaaaggcttcaccgaccgccagctataaatgaactgtaagcctataaagtgggctccatgtgatagttagccagcccttggtctgatcgcgcgagatagtacttcttggtttatgcctagataagaggagcagagctgttcttccaacaaggtgaggcggtggcttcagttgatgggtttacaaaaaaagctgttaccagggatctttccacaaagtctgctccgctcttcctaagtaggaagatcttatggcagggctctcaagataagctgttggtaggactcctctttcaagataggggcctttaaaagaccttgccagcacaccaaatacacactttctcaaatggatgcgcagtgtgatcgactagtggcggcctggatccacgatcaagatttcctcttttttttgagtcagttttagtaaaaaagaaaacttcttctccgcgggagagccctgaggcatacttctcctttagatactcctttttttatcaacctactttgtccccacgatacggagaaaagttccgtgcccctaaatctataggttgtctttcttccagtcccgcaactcctaaccgtaaagagagatgcgatttatagccatttctttctgaactaagtcagctaagccggctaggaaactaatgaataagcaatagcgatcaccgagatcttttcgaggaattaggaggctgctaaaggcagttagataagctagtcggtcagaacaagtgcaaatgctttacgagattcgggaggaatttccagtattcaactggaaagggggaggaaggcttggcgggtacttaatactaaacaagaatgcggaaaaggtggattccaggagcattgaactgtaggtttcacagaccaactcttccaccatagagttaagacagggttttcacagaaaggactggcgctgggattaaccttttattagcacgtaatagttagagtcattcccatacatagtaccaaaaacttccatgaactctattgatgttgtaggcgctacttgtatctagagaaaaatttacaaccaatggaacaaattttcctacattcattgggccaggagtgagccaatacctctctttctaaatacgaactctcgcttgttatccttccattgactattctctttttgcgcagcagctcgtcccacctttcagtctttttcttttttggaggttcatagctttcgttgcaacctactttatcatatcccatccgaaagtcaaaatctgattacagaaagcaatccaccatagattaagattgtggcccataccttcctctggctggatctggttaaagaccagagcttgtatcagagattccccttcccatttgtcatagattcaacagttgttgcttccaaaaaaatgaaaggattcgacttcgagctaggctcaaactgcagtttcacaattattagttgtcggcatcgatctggttagacgccctttcctatgcgcaaaaagagaatctctcctgctcgaatctagaccggattctaagagttcctgcaagcgcaattaagtcaccgtgaaagacatgagttaaatgacttctgtatcaaagattcattcctaaaggcgtatacataaggggtagaccgcacaaccgcgcgggagatatcgtcctttttcagtcctatttcgtaggtaaaaaatatttttttgtaccagtcacagctactaaactatgagtttttgatagttcgttcttaaatagcacgcggtcagagttctgctttgggacagggcttctctttttcccagtaacatatgagacaatgaaacttctgaccattgtggaaatttgcatatactggaccctttgtatagtaattttccttagttcagcaatggagcgcacacctgccttttgcacccttaccctgtcttattacatcacccaccaggttgtatggatcgtgtgtatgtgacatccctttttaagcgagggaagaagcaagagaaatctcctccggaaccggtttggcatagcgccccttccgtgggggacacgggacactcgcgggtatagaagtgcaatgacggctcataactaagaatactagccttaccaattctatatcaattgttttttatctccagaccttcgtggagaaatcctatttcttacttatcgagatagtaagtccctttctttgctttgccaaacctacggttgctacgtgtttcttacttagacttgaattaggttccttcagagaatatagtaaagtgcttttaagaaaaacaatggtgaagcgacctccctgctccactggataccataaaaatttaatgttgatcaatagagagttactacttgacttagcagtggccttagaaagtagcctttcattaattattctctgactcaaacaagctttcttaatcgaatacaagacagctatataacgggagtggggactaagaattcagccaggtcgtttgacatcaggaaagcctttgaaacaattgactggcattttttattatcaaatcttactgcctttggtttctgtcaacagtttgtggattgcattcgggtcattctgcaatctggctaggtgtgtctcaatttatt

SEQ ID NO: 809 - DNA, 646 bp, Arabidopsis lyrata
aataaaaaaaaggagtctttatgtcacgttaccgagggcctcgtcttaaaaaaatacgccgtctgggggctttaccgggactaactagtaaaaggcctaaggcaggaagcgatcttagaaaccaatcacgctccgtaaaaaaatctcaatatcgtattcgtttagaagaaaaacaaaaattgcgttttcattatggtcttacagaacgccaattacttaaatatgtgcgtatcgccggaaaagccaaggggtcaacaggtcaagttttactacaattacttgaaatgcgtttggataacatcctttttcgattgggtatggctttgactattcctcaagcgcgccaattagttaatcatggacatattttagttaatggtcgtatagttgatataccaagttatcgctgcaaaccccgagatattattacagtgaaggatgaacaaaactctagaactttggttcaaaatcttcttgattcatctgcccctgaggaattgccaaaccatctgactcttcacacattccaatatgaagggttagtcaatcaaataatagataggaaatgcgtcggtttgaaaataaatgaattgcttgtcgtagaatattactctcgacagacttaataaacctaacttaagtaaaa

SEQ ID NO: 810 - DNA, 1387 bp, Zea mays
tcacacggacccgttgcgtgagcgcacccctcgtactcccatagtcccatcccatggaggccaccccgatctccatgaagccaccgtctccggcgccggcggcgccacccccagccactctggagcccggggacttgccaacgcatgccttcggagggaccgagctggagccgtccagtatgaaccagctcgcaatagctccggaccccaaacggccgagggtggaggaggctgcggacggcaacgggtgcaagcattgcgcctgcaaaaagtccagatgcttgaagctctattgcccatgtttttctggaggtggttattgctctgataagtgtggctgccaaccatgtttcaacaaagaagcttttgcagaaacagttcatactactcgcaaggtgttactttcgagacagaagcgtatgtcaatgaaaatcaataggagacctgaggcgaataccgaaccaatggaagatgctcaccattcttcttcttcaactccaccaaagagaggttgcaactgcaagaagtcaagttgcctaaagaaatactgtgattgctaccaggatgggactggatgttccttgttttgccgctgtgacgattgccagaacccttttgggaaaaatgaaggcataatggctgacgacagtaagcggtatttatacactggtgctgatttggatcacagcgagggcgaacatgacttcgttgtggagcgctcgcctcgtctgcaatcacctatctcgaaggagtcttccttcccaccaaaccccacctcatctcagggcgtcaagcagagacgcgcacgttttcccacacgcgatatcccagtggcaggcgctgccccgctcgtggcactgttccaacaagaggaacagcagcgaccgagccatggacgactccgcgaactacaagaactcgaaccatgactactggcaggtacccaagcacgaggacagctacagcatatcgaaatgcgtccagatcctgaacggcatggcggagctgtcgcaggtggagaaatcggttgcccccgacgtcttcctgcagccgggcaaccgggaaattttcgtctccctcagcggcgacgtgcgcgccatgtggctgaagcgcaagattcagcacctggcttaaattttccttgtgctgtgccgttcttccgagtggagtacaatcttttagattgtgcatgttcttctggtcgtggggtgggcgtgcacaggattctaggttcttttttcgccctgtatactgaggtgtatttctggattacggttatgtattgtctttgtagagagagccgttttcgagcctggtatcggctataataaaatgagattatacattgtttcccggctatggttgccagactgtcatgtacatttcc

SEQ ID NO: 811 - DNA, 1386 bp, Zea mays
tcacacggacccgttgcgtgagcgcacccctcgtactcccatagtcccatcccatggaggccaccccgatctccatgaagccaccgtctccggcgccggcggcgccacccccagccactctggagcccggggacttgccaacgcatgccttcggagggaccgagctggagccgtccagtatgaaccagctcgcaatagctccggaccccaaacggccgagggtggaggaggctgcggacggcaacgggtgcaagcattgcgcctgcaaaaagtccagatgcttgaagctctattgcccatgtttttctggaggtggttattgctctgataagtgtggctgccaaccatgtttcaacaaagaagcttttgcagaaacagttcatactactcgcaaggtgttactttcgagacagaagcgtatgtcaatgaaaatcaataggagacctgaggcgaataccgaaccaatggaagatgctcaccattcttcttcttcaactccaccaaagagaggttgcaactgcaagaagtcaagttgcctaaagaaatactgtgattgctaccaggatgggactggatgttccttgttttgccgctgtgacgattgccagaacccttttgggaaaaatgaaggcataatggctgacgacagtaagcggtatttatacactggtgctgatttggatcacagcgagggcgaacatgacttcgttgtggagcgctcgcctcgtctgcaatcacctatctcgaaggagtcttccttccaccaaaccccacctcatctcagggcgtcaagcagagacgcgcacgttttcccacacgcgatatcccagtggcaggcgctgccccgctcgtggcactgttccaacaagaggaacagcagcgaccgagccatggacgactccgcgaactacaagaactcgaaccatgactactggcaggtacccaagcacgaggacagctacagcatatcgaaatgcgtccagatcctgaacggcatggcggagctgtcgcaggtggagaaatcggttgcccccgacgtcttcctgcagccgggcaaccgggaaattttcgtctccctcagcggcgacgtgcgcgccatgtggctgaagcgcaagattcagcacctggcttaaattttccttgtgctgtgccgttcttccgagtggagtacaatcttttagattgtgcatgttcttctggtcgtggggtgggcgtgcacaggattctaggttcttttttcgccctgtatactgaggtgtatttctggattacggttatgtattgtctttgtagagagagccgttttcgagcctggtatcggctataataaaatgagattatacattgtttcccggctatggttgccagactgtcatgtacatttcc

SEQ ID NO: 812 - DNA, 1376 bp, Zea mays
atacgggcccgtgtctcagcgcacacctcttcgtgctcgctcccatggaggccaccccgatctccatgaagccaccggcgccacccccggtcactctggagcccatagaattgtcaacgcatgccgtcggactgaccgagctggagcgatccagcatgaaccagctcgcaatagcgccggaccccaagcggcagagggtggaggaggctgcggatggcaacgggtgcaagcattgcgcctgcaagaagtccagatgcttgaagctctattgcccatgttttgctggaggtggttattgttccgataagtgtggctgccaaccatgtttcaacaaagaagccttttcagaaacagttcagactactcgcaaggtgttactttcaagacagaagcgcatgtcgatgaaaattaataggagacctgaggcaaatgctgaaccaatggaagatgctcaccattcttcttcttcaactccaccaaggagaggttgcaactgcaagaaatcaagttgcctgaagaaatactgcgattgctaccaggatgggaccggatgttccttgttttgccgttgcgacgattgccagaaccctttcgggaaaaatgacggcataattgctgatgacagtaagcgctatctgtacactggtgctgatttggatcacagcgagggcgaacatgacttcgttgtggagcgctcgcctcgtctgcagtcacccatgtcgaaggagtcttctttccaccagaccccaccccatctcagggcctcgagcagagacgcgcacgtgttcccgcaggcggtatcccagtggcaggcgctgccccgctcgtggcactgttccaacaagaggaacggcaacgacagggcgatggacgactcctccgccaacggcaactacaagagctcgagccatgactggcagatgtccaagctcgaggacggctacagcatatcgagatgcgtccagatcctgaacggcatggtggagctgtcgcaggtggagaagtcagttgcccccgacgtcttcctgctgccgggcaaccgggaaattttcgtctccctcggcggcgatgtgcgcgccatgtggctgaagcgcaagattcagcacctggcttaggggagggtgtgtttcattgcgccatgtgccgtcctctcgagtgaggagattggaggggaaattgagttttcttttagatcctgcatgttctgctgctggtcgtgggcgtgcacaggattctaggctcttttttcctgtttactgaggtgtatttatggattgacattacgtattgtctttgtagagatagcggtttcgagcctggtatcggatataataaaaaaatgagattatacacctactacatgttgtttcgcggct

SEQ ID NO: 813 - DNA, 1327 bp, Pennisetum glaucum
tctccgtgaagccgccgtcgccgtcgccgtcgccggcgccgccaccccaggcggctctggagaccagggacttgccgacgcatgccgtcgtggcgaccgaggtggagccgagcagcatgaaccagctcgccgtcgcagtcactccggaccccaagcggcagaaggtggaggacaccgcggatgggaaggggtgcaagcattgcgcctgtaagaagtccagatgcttgaagctctattgcccatgttttgctggaggtggctattgttctgagaagtgtggatgccaaccatgtttcaacaaagatgcatatgcagaaacagttcagaatacgcgcaaggtgttactttcaagacagaagcgcatgtcactgaaaattaataggagatctgaggcaaatgctgaagctatggaagatgctcaccattcttcttcttcaactccaccgaggcgaggttgcaactgcaagaaatcaagttgcctaaagaaatactgtgattgctatcaggatgggactgggtgctccttgttttgccgctgtggcgattgccagaacccttttgggaaaaatgaaggcataatgactgaagatagtaagcgctatctatacactggtgcagatttggatcacagtgagggggaacatgagtttgttgtggagcgttcaccccatctacaatcacctatgtcaaaggagtcttctttcctccaaaccccgcctcatctgagagcctcaagcagagacacacatgtgttcccacaggctgtgttgcagtggcaggcaccgccccggtcatggcattgttccaacaagaggaacaacaacgaccgggcgatggacgactctgcaaactacaagaactcgcacaatgactggcagctaccaaagcctgaagacagctacagcatatcgaaatgcgtcaagatcctcaacggcatggtggagctgtcgcaggtggagaagtcggtcgcccccgacgtcttcctgctgccgggcaaccgggagatattcatctcgctcggtggcgacgtgcgggccctgtggctgaagcgcaagatccagcacctgacttgagggtatggttcaccatcgttctgagaagagattggagggagcattgagttatcgtttagattacgcatgccctgctggccgtgggcgtgcccaggattctaggctttttcccccttcccgccttgtatactgagtgtatttcccgatttgcattatgtatcgcctttgtagagatagctgcttcgtacctcgtaaaccgttataataaaaaatgagattatgcgccaacagggcgtaggccatatgctcaaaaa

SEQ ID NO: 814 - DNA, 1060 bp, Solanum phureja
ttcatcaccacttcactacgacgtcgttttagttgccaatctctttactattaatggagttttccacggttttgaataattttgtcagctaagcgttgacagttgagaagcagattcagtagttcatctgctcaccaacactgattaatttctcataaatacacttctttcttcaaatacccaattgggttttttgatttttttccccaaagttttaagctttttggagtctgtcaatggctggagttttatcagttctaagacgcatttacctcacactttacaattggattgtcttttttggatggtttcaagttttttatcttgctgtgaaaactctgaaagagtctgggcatgaacatgtctatgatgctgtagagaagcctttgcttttagctcaaaccgccgccattttagagatatttcatggtttagtgggtttggtaagatcgccagtatcagcaactcttccacaaataagttcaagattatatgtaacgtggggtattctatggagtttccctgagcttcggtctcatattcttgttagttctctagtgattagctggtctataacagagatcattcgatattcattttttgggacaaaagaggcatttgcttctgcaccttcgtggctcttgtggctaaggtatagtaccttcttgttgctgtatcctagtggcatcacaagtgaagttggtttgatatatagcgctctgccatacatcaagggatcggatatgtattctcttaggatgccaaacaaatggaacttctctttcgattactactatgcaggacttgttgccctcggtatctatttcccaggcagtcctcacatgtatggttacatgctcggacagagaaagaaagctctctccaaatcgaaaaaggagtagactcaattgaaatgtagctgttggtgattacaattttaatcttaatcaatgtatttcaactgttcaattttttcttactaatttagacaatagaacaatttgcatttctctgatgaaagtcaagtggttgaatgaaaatttacttggcagtttactga

SEQ ID NO: 815 - DNA, 947 bp, Solanum melongena
agttgagagggtagagaatatgagactcttagtattcagtagttcatctgcccacctacactgattaatttctcataaatagccttcttccttcaatacccaattgggtctttttgttttttgtaattttctccaaagttttaagctttttggagtccttcaatggatggagttttatcagttcttagacgcatttacctcacactttacaattgggttgtcttttttggatggtttcaagttttttatcttgctgtgaaaactctgaaagagtctggacatgaacatgtctatgatgctgtagagaagcctttgcttttagctcaaaccgccgccattttagagatacttcatggtttagtgggtttggtaagatcgccgatatcagcaactcttccacagataagttcaagattatatgtaacctggggtattctgtggagtttccctgagcttcggtctcatattcttgttagttctctggtgattagctggtctataacagagattattcgatattcattttttgggacaaaagaggcatttggttctgcaccttcgtggctcttgtggctaaggtacagtaccttcttgttgctgtatcctagtggcatcacaagtgaagttggtttgatatatagcgctctcccctacatgaaggcatcgaagaagtattgtcttaggatgccaaacaaatggaacttctctttcgattactactatgcaggacttgttaccctcgctatctatgtcccaggcagtcctcacatgtacggttacatgctcggacagagaaagaaagctctctttaaatcgaaaaaggagtagactcgatcgaaatgtagctgttggagattgcatatgtgcaagcaattttaattttaatcaatgtatttcaaactgttcaattttttcttattaattttgacaatagaacaatttgcatt

SEQ ID NO: 816 - DNA, 936 bp, Petunia hybrida
ataatgtgacatgttgtagcagatctagtagtttatcagctcacctacatcaattaataacattaataattaatacttgtcttcttatataccctatattgtgttttattccttctcatactttgttaccattttcttgaaatcattcaatggctggatttttatcagcacttagacgtatataccttaccctttacaattggactgtcttttttggatggtttcaagtgttttatctagctgtgaaaactttgaaagaatcaggtcatcaacatgtctatgatgctgtggaaaaacctcttcttttagctcaaactgctgccattttagagatacttcatggtttagtgggtttggtaagatctccagtatcagcaactcttccacagataagttcaagattatatgtaacctggggcattttatggagtttccctgagctccggtctcatgtacttgttagttctctagtgattagctggtctataactgagattatccgatattcattttttgggacaaaagaggcatttggttctgcaccttcctggctcttgtggttaaggtatagtacttttatgttgctgtatcctactggcatcacaagtgaagttggtttaatatatagcgccctgccttacatcaaggaatctgagaagtattctattaggatgccaaacaaatggaacttctctttcgattactactatgcaggacttgttgcccttggtatctatgtcccagggagccctcacatgtatggttacatgcttggacagagaaagaaagccctctccaaatcgaaaaaggagtaggcttggactcgatcattatgtagctgttggggattgtatttgtgcaattctttattcttgttcactgtattgcaaactgttcacatttttcttattaattcaaacaatagaacaattttgc

SEQ ID NO: 817 - DNA, 837 bp, Nicotiana benthamiana
acggccggggaagttttttttaagagttttaaagctttttggagtccttcaatggctggagttttatcagctcttagacgtgtataccttaccctttacaattggaccgtcttttttggatggtttcaagtgctttatcttgctgtgaaaacactgaaagagtcagggcatgaacatgtttatgatgctgtagaaaagcctctgcttttagctcaaaccgctgccattttagagattcttcatggtttagtgggtctggtaagatctccagtatcagctactcttccacagataagttcaagattatatgtaacctggggtattttatggagtttccccgagctccgatctcatatacttgtcagttctctagtgattagctggtctataacggagatcatccgatattctttcttcgggacaaaagaggcattcggttctgcaccttcctggctcttgtggctaaggtatagtaccttcatgttgctgtatcctactggcatcacaagtgaagttggtttaatatacagcgcactgccttacatcaagggatctgagaagtattctattaggatgccaaacaaatggaacttctctttcgattgctattatgcaggacttgttgtcctcggtttctatgtcccaggcagtcctcatatgtatggttacatgctcggacagagaaagaaagctctctccaaatcgaaaaaggagtagacttgatcaagatgtagctgttagggattttatttttgcaagtgatttattctgaatcaatagaacaatttgcatttctcttctgaatgacctagtggtttaatgaaaaatcacttacag

SEQ ID NO: 818 - DNA, 1601 bp, Capsicum annuum
gcacgaggatggctggaatattatcacttgttagacgcatttatctctccttttacaattggattgtcttttttggatggtttcaagttttttatcttgctgtgaaaactctgaaagaatcaggacatgaacatgtctatgatgctgtagagaagcctttgcttttagctcaaaccgccgcgattttagagatacttcatggtctagtgggtttggtaagatcgccagtatcagcaactcttccacaaataagttcaagattatacgtaatgtggggtattctatggagtttccctgagctccggtctcatattcttgttagctctctagtgattagctggtctgtaacggagatcatccgatattcattttttgggacaaaagaggcgtttggttctgctccttcatggctcttgtggctaagatatagtaccttcttgttgctgtatcctagtggcatcacaagtgaagttggcttgatatatagcgctttgccttacatcacggaatcggggaagtattctcttaggatgccaaacaaatggaacttctctttcgattactattatgcaggacttgttgccctcggtatctatgtcccaggcagtcctcacatgtacggttacatgctcggacagagaaagaaagctctctccaaatcgaaaaaggagtagactaaatcgaaatatagctgttggagattgcaatttttatgtgaatgaatgtatttcaaactgttcaattctttcttattgatttaaaacaatagaacaatttgcatttgtctgctggaaaatctagtggttgaatgaaaattcacttatagtttgctgagttttttttttttttttttttccagtataaaattatagtcccactttcacatttaacttccggctacataggataggataaaatagacaagaaagaaacggtggtagtaaaatagtaaaaataaaaaacacatattcgaaaattattaattcccaaaataccccttcaccttcactccttccccccttcacttcttctcttcttccttctcttcctcctcctcaaaagcagaaacaggaaaagacctagaaattccagtaggggtaccaaaggtaattttcttaccctccgggtcagttatcgagatatccgtaagcgcaacccagataagtatctccttactcttgacaccagttaccttcttcatccttcgatcctccacaaacgccgtcacttcagtgtcgtaccatacaagcttcccaatcttcttaaacttgtgctctttcgccttcttctgcttcagccaaacgaacccggtttccacgttccggccaacttcaaagatgtcttctagagggagaaggccattcggcatgttgatttcctttaaaagttggagggttttttgcttgcagactactggatctgtgtacacttccgcattttcacggtggctttcgatgagttgctgagacattttcggatttttctcaggaaaatggaagagaattcaattctcaaagaggagagagtacttgaggattgtatttgtgggtacttgcttgggatttgggggtatatttatataatcagggtgtgcctcgtgc

SEQ ID NO: 819 - DNA, 1229 bp, Aquilegia formosa
ctccccatgacttctctggttcagtcacctctaagcattaagttgcgccgttaatgcgtagtacaaagtttcatctactgtatatccaaactacatttcaaatctaaagagatggcttgcagtctgatggtcagaggtggaagtgtatctaatggatgtcgttattcagatgaaaagggagcatgataaactccattgctacggacacaccagattattacaccatctcccatcccatctacccagatgaacaagtaataatgtttcagttagaagtcgttgtgacatgaaagccaacatgacatgaacgaaagagatttatttatttgaagagatgttagttcatcttctcacctaattcaaataaatgctctttcttcttcttcttcttcttcttcttcttataaaaccctagatctcaaaaccttatcagttatcatacaatggctggatttctttcagttcttaaacgaatttatctcactctttacaattggactgtttttactggatgggcacaagtgttatattttgctgtgaagacattgaaagaatctggacatgaacatgtttatagtgcagttgaaagaccacttcaacttgctcaaacagcagctgttatggaaattcttcatggattgataggtttggtgagatccccagtttcggcaacattgccacagattggttcacggttgtatgtaacatggggaatcttatggagctttcctgagactcagacacatgtgcttgttagctctctggtcattagctggtctattactgagattattcgctactcgtttttcggcctgaaggaagcctttggttctgctccttcatggctcttgtggctcaggtacagcacctttctgttattatatcctagtggcatcaccagtgaagttggtttaatttatactgccttgccattcatcaagaattctgagaaatattgtataaggatgccaaacaaatggaatttctccttcgattacttctacgctgcaattattgctcttggaatctatgtgccaggtagtccacacatgtaccagtatatgcttggacagcggaaaaaagctctctccaagtccaagaaagagtaaaacccgaccctgtagtggtggttttattgttgtattattttgttgaaaatttgatgtcattaatctgtaggcttattattctcgtttggatattattgtcaattaggctcatgcaatcaa

SEQ ID NO: 820 - DNA, 1219 bp, Aquilegia formosa
tccccatgacttctctggttcagtcacctctaagcattaagttgcgccgttaatgcgtagtacaaagtttcatctactgtatatccaaactacatttcaaatctaaagagatggcttgcagtctgatggtcagaggtggaagtgtatctaatggatgtcgttattcagatgaatagggagcatgataaactccattgctacggacacaccagattattacaccatctcccatcccatctacccagatgaacaagtaataatgtttcagttagaagtcgttgtgacatgaaagccaacatgacatgaacgaaagagatttatttatttgaagagatgttagttcatcttctcacctaattcaaataaatgctctttcttcttcttcttcttcttataaaaccctagatctcaaaaccttatcagttatcatacaatggctggatttctttcagttcttaaacgaatttatctcactctttacaattggactgtttttactggatgggcacaagtgttatattttgctgtgaagacattgaaagaatctggacatgaacatgtttatagtgcagttgaaagaccacttcaacttgctcaaacagcagctgttatggaaattcttcatggattgataggtttggtgagatccccagtttcggcaacattgccacagattggttcacggttgtatgtaacatggggaatcttatggagctttcctgagactcagacacatgtgcttgttagctctctggtcattagctggtcaattactgagattattcgctactcgtttttcggcctgaaggaagcctttggttctgctccttcatggctcttgtggctcaggtacagcacctttctgttattatatcctagtggcatcaccagtgaagttggtttaatttatactgccttgccattcatcaagaattctgagaaatattgtataaggatgccaaacaaatggaatttctccttcgattacttctacgctgcaattattgctcttggaatctatgtgccaggtagtccacacatgtaccagtatatgcttggacagcggaaaaaagctctctccaagtccaagaaagagtaaaacccgaccctgtagtggtggttttattgttgtattattttgttgaaaatttgatgtcattaatctgtaggcttattattcacgtttggatattattgtcaattaggctcatgcaatcaa

SEQ ID NO: 821 - DNA, 1104 bp, Coffea canephora
cggccgggggagttggcagttgaagcttacgactacgaagcaaggaggctgcagcagatcccagccctcaactgtctctatatgttcagttggcagttgaactactcaccaattctgtgtattcaccccccgccccaaccggcagtcctccattactattgctatttattactagtagaattcttcatttctctacctcgagaagttgataaggttccctcagtttctccgccgtcctacactggaatctccgaacttcttctgtatctatagctctctagattgagggggaggaggaggaagcaggctgtatattgtccgatggcaggggttttatcaggtctgaaacgcctatacctcaccatttacaattggaccgtcttcgtcggatggctgcaggtgttttttctagctgtgaagaccctcaaggagtcggggcaccaacacgtctacgatgccgttgagaagcctctgcttctagctcaatctgctgccatcttagagataattcatggtctagttggcttggttagatctccagtttctgcgacgctgccacagattggttcaaggttatatgtagcttggggaattttgtggagctttcctgaggttaggactcatgtacttgttagcagtttggtcattagctggtctatcactgagattatccgatattcattttttgggacaaaggaagcctttggctctgcaccttcatggcttttgtggcttaggtatagcaccttcctcttgctgtacccaacgggcatcacgagtgaggtcggtttaatatacaatgccttacccttaatcaaggaatccgcaaaatattctgtagtgatacccaacaagtggaacttctcatttgattactattatgctgcatttgttgttcttggtgtttatgtgccgggcagtcctcacatatatacctatatgctcgggcaaaggaagaaagctctctccaaatcgaaaaaggagtagattcctggaactgatatatgctttaaattatgattttacaagaattatctatgttttttttttttgacatctattcaacttactgaatgtagttttcctattcaattgtcacgcgga

SEQ ID NO: 822 - DNA, 669 bp, Allium cepa
ggtttcttctcagttctccggagaatctatctcaccatttacaactggacagtctttttcggctgggcacaagttttgtactttgcggttaaaactttgagggaatccagccatcaagaggtttatgatgctgtcgagaaacctcttcagcttgcccagactgcagcagttttggagattctacatgggctaattggtttggtgagatctccggtttcagcaacattaccacagatttcttccagattgtatgtaacatgggggattctgtggagtttcccagaggtcagatcgcattttcttgtcagctccttggttattagctggtcaattaccgagataattagatactcattctttggcatgaaagaggcgcttggatttgcaccttcttggctattatggctaaggtacagcacttttttattactgtacccttgtggcatcactagtgaagttggactaatttatttagctttgccttacattaaggcctctgaaaaatactgcataaggatgccaaacaagtggaacttctcttttgattactactatgctgcaattcttgctcttgggatatatgtgccaggtagcccgcatatgtatacctacatgctcggacagaggaaagaagcactttcccagtcgaagaaggcataaatacaatca

SEQ ID NO: 823 - DNA, 1139 bp, Actinidia deliciosa
  misc_feature (46)..(46): n is a, c, g, or t
  misc_feature (52)..(52): n is a, c, g, or t
  misc_feature (148)..(148): n is a, c, g, or t
  misc_feature (468)..(468): n is a, c, g, or t
  misc_feature (472)..(472): n is a, c, g, or t
  misc_feature (479)..(479): n is a, c, g, or t
  misc_feature (522)..(522): n is a, c, g, or t
  misc_feature (550)..(550): n is a, c, g, or t
  misc_feature (621)..(621): n is a, c, g, or t
gagagagaagcgagaagcgaggagagggagagagagagagagaganaagagngttggagaggaccaagcaagcagatccaagtgtttgatctgctcacctacatcgatttcttcttcttccgtcaaatccccaatccttcaccctctntttctctcccctacattcagatctctaatggcgggttctttatcagttctgaggcgtgtatatctcaccctctacaattggaccgtcttcgtcggatggtttcaagtgctgtatcttgctttgaagacgctgaaggagtcgggccacgagcacgtctacgacgccgttgaaaagcctcttctactcgcccaatccgccgccgttttggagatacttcacggtctagtaggtttggtaagatctccaatcatagcaacactaccacagataggttcaaggttgtatgtagcttggggtatcttgtggagctttcctgagantcgnagtcacntacttgtcagctctttggtcataagctggtctattacagagantattcgatattctttctttggcacaaangaggctcttggctctgctccttccttcctcatgtggctcaggtatagcacctttttgttgctatatcctantggcatttcaagcgaagttggtctaatttatgttggccttccttacatcaaggaatctgaaaagtactgtatacggatgccaaacaaatggaatttctctttcgattacttctattttgcaattcttgtgctcggattctacgtcccaggcagccctcacatgtacacgtacatgcttgggcaaaggaagaaagctctcgcaaaatcgaaggaggagtaaatcagcagcacaagatttacacactatcggtgtaaaatctctggttcttgtgtttatgtattttagttaacaagtgtttgttctgagcttctttgtgggtgtatcctgaatattcaaggtagttttcatcagaattaagttattagtgtttatctgcctcctttctttaatttgattcattgtctgtgggactactttgttcctgtagtgtcatcagaagtctgggaagcctataatttaaacagtgtaaatggactgcaagggttcaaaatcttaggcccagaaacaaaaaaaaaaa

SEQ ID NO: 824 - DNA, 1131 bp, Carica papaya
gggcagctcaccgatctcaacaatggctctttaattgctctctctctctctctctctcgttctctctctaggtagctcctgttctgtatcaaaatctgtataaattcatctcgttgcctacggagtagcttatcttcacctctttatctctattcaatggcgggatttttgtcggttatcaggcgtctatacctcactatctacaactggaccgtcttcgttggatgggctcaggtattgttccttgctttgaagaccttaaaggaatcaggttacgagcatgtctacgatgcggtcgagaaacctcttcagttcgctcaaaccgcggccgttctggagattcttcacggtttggtaggtttggttagatctcccgttatggcgacactgccacagataagttcgaggttgtatttgacttggggcattctgtggagtttccccgaggttaggtctcatatgattgttagctcactcgttattagctggtccgttactgagataattaggtattctttctttggcatgaaagagggtttgggttctgctccttcatggctcctgtggctcaggtatagcacctttctattgttatatccaaccggaatatccagtgaagttggactaatataccttgccttaccatacattaagagatccgataagtactgtataaggatgcccaacaaatggaacttttcttttgattacttctacgctgcaatacttgcccttggaatttatgtcccaggttctcctcacatgtacacttacatgcttgggcagaggaagagggctctctccaaatccaagagagagtaatatgacaacaaaatttctttgtctggttggtgatgtcaaaaaccccaaatatttaattagaaatgttaccctttttttatttgattagagctacatttgtattacttcatttagtccttgtgttgaataggaatgagagagagcttttcatttggttttctggcatcgatgaattagggctggcaaaatttgaaatgtgcctctaattaatattagggatggcatagacagattatctagacatgaaattaatccaatgtaaaaaattagtgaaataatagagagaaaaaaaaaaagatctttggagaa

SEQ ID NO: 825 - DNA, 1315 bp, Citrus sinensis
  misc_feature (1234)..(1234): n is a, c, g, or t
ttactgatgagtatgatatccgatcggcacatggaaatgggaatggctactactgaccaagtagtaaataaattagatcgaaagtggttgagcagcttacctgtctcttctcacttcgcacccatccccatctccattaattgctgtcattttaaatggtctaaattttctctgttaattgcttcccagtttacaatctttcaattttcaatacaaaacagatggcgggttgtttgtcgcttctcagacgcctgtacctcactgcctacaactggaccgtctttgccggatgggcccaggttttgtaccttgctttgaagactttaaacgagtccggccacgaaaatgtctacaaagccgtcgaaaggcctctccagctcgcccaaaccgccgccgttttggagattcttcatggtcttctaggcttggtgagatctccaataacagctacactgccacaaattagctctagattgtatgttacatggggcattttatggagttttcctcagactcagaatcatatacttgttagttcattggtgatcagctggtccttaactgagattattcgctactctttctttggcatgaaggaggcacttggttttgcaccttcatggctcttgtggctgaggtatagcacatttttgctgttgtatccatctggcattacgagtgaagttggtcttatttacactgcccttccatacataaaagaatccgagaagtattgtcttagaatgccaaacaaatggaatttctcttttgactacttctacgctgcaattcttgtgcttggattctatgtgccaggtagtcctcatatgtatacatatatgcttgggcagaggaagaaagccctttcgaaatcaaaaaaagagtaaaatggttgtaatcatttttaactgcaatgtctatcagtgtatcctatcaaagatcttgatagaacttttgtttgtttataataattaccacacctttcccaaaaaaaaaaaaaaaaaaaaaataaagagggtgcactagtgatcaaaatttatagaggtggggcgctaaatactaaaaggaccataataaccgcgggcacattttaatgcggtaggggaacgcgaggacataataaaatagtaaactcaccctctcccagagtaataaaaaaccagaaactcacaaactgaccaaggggaaaggaggtttgttgttaataatgggtttatctagttttatttaatantagatactattttataagctctatggagatttttaataaaaatgtgatgatattatttgagtaaaatatgggtagtatgca

SEQ ID NO: 826 - DNA, 874 bp, Malus domestica
attggttgaggcgttgagctactcacctacatgccttttactcctcatttattattcttcttccccatctctctctctcgctctctataattgctgtctaggctcgtagatctgcctttagacatcggtcatcaatggcggtaccattatccgctctcaggcgcctatacctttccctctacaactggacagtcttcctaggatggtttcaggtactgtatcttgctctcaagactctcaaagaatccggccaccaacatgtctacagtgccgtcgaacgccctctgcttctcgcccaatccgctgcctttttggagattcttcatgggctagtgggtttggtgagatctccaataacagcaacactgccgcaaatcggttcgagattgtatctgacatggggaatcctgtggagttttcctgagactcggagtcatatgcttgttagctctttggtcatcagctggtctatcaccgagattattcgatactctttctttggtatgaaggaggcacttggttttgcacctacatggctcttgtggctcaggtatagcaccttcatcttgttgtatccaactggcatcacaagtgaagttggtctaatatatattgccctgccacacattaagaactctgagaagtattgtataaggatgccaaacaagtggaacttctctttcgattacttgtatgctgcaattgttgcactaggaatctatgtcccagggagtcctcacatgtacgggtatatgcttggacagaggaagaaagctcttgcaaaagccaaaggggagtagacggcaacaaagtttcaatgtatttctcatgatgattaatcatacggttttgtgtgtaagatggaattttattc

SEQ ID NO: 827 - DNA, 1229 bp, Quercus alba
atggggggaggttgcgacttgcaacaacacaacacaaatgcaattcaaaaacacacaaaacaacccaagaagatagaaaagaaagacacgtttttcaattttcagtttatagatgagatccaatccaagtagttgagctactcacctatacctctttaattctatgatttttttaaaagcctcttcaattcttgttttttaggggttaagtactaaatactaaataaacaaacttcttcaattcccttctcttctctctctttctaacactaccaataataaataccacttcttcaatttccttaaattttcagacttcaaacaacccatctctctcttctctctatctctctaatggcgggttttttatctctcctccggcgcatttacctctctgtctacaattggaccgtcttcgttggatggtttcaagtattgtaccttgctgtgaagacagtgagagagtcagggcatcaacacgtctactctgccgttgaaagaccccttcagcttgctcaaaccgccgccatcttggagatttttcatagtctagtaggtctggtgagatctccagtatcagcaacattgccacagatagcttcaaggttgtatttgacttggttcatcttgtggagtttccctcagactcagactcacatacttgtgacctccctagtcatcagctggtccatcacggagattattcggtattctttctttgggctgaaggaggcgcttggttttgcaccttcatggctcttgtggctcaggtatagcacctttttgttgttgtatccaactggcatcactagtgaagtcggtcttatatatgttgccctgccattcatcaaggaatctgaaaagtattgtataaggatgccaaacaaatggaacttctcttttgatttcttctatgctgcaattcttgtactcggaatctatgtaccaggcagtcctcacttgtatgggtatatgcttggacaaaggaagaaagctctctcaaagtccaagaaggagtagaatggcagaaagttcttttaatgtccttgtgggtgtgaaatggaattctatttataaaaatgctgtttttagctagaataatttttggtttagtgctctcaaattaaagaaaagaagaaaatttccttgtgttgattcagaatctgttatcaaattgatgattttctaaattgggttccatgagtaccgcaaatctcaacatgaatttg

SEQ ID NO: 828 - DNA, 858 bp, Cleome spinosa
ttcaacgaagggttacagttatctctctctgcacttcccatggcgggatttttctctctcctccggcgcgtgtaccttactctctacaactggaccgtcttcttcggatgggcgcaagttttgtacctttccttgaagacattgaatgaatcgggacacgaacatgtctacgacgctgtcgagaagcctctccagcttgctcagaccgccgccgttctcgagattcttcatggattggtaggtttggttagatctccagtctctgctacgctgccgcagataggttcaagactatatgttacatggggcatcttgtacagtttccctgaggttcgatctcatttccttgtctcgtcgctagtcatcagttggtccgttactgagactatacggtactctttctttggactcaaggaaggtctgggctctgctccttcatggctcttgtggctcagatacagcagctttttggtgttatatccaaccggtatcaccagtgaagtaggacttatctaccttgccttgcctcataacaagaaaacggagaagtacagtgttaggatgccaaacaagtggaacttctcgttcgacaacttctacgcggcaatactcgttcttggaatatacgttccaggaagtcctcacatgtacaggtacatgcttggacagaggaagagagctctctccaaatccaagagggagtaagggcatttctccatcaaccagattataaattcatcagattatgaaatatcagtttcgcatttatgaactacgacgatttttactactccttgtttccttgtttcaatatgaatgtcgttttagagattattttttgtttctaaacagttgtaa

SEQ ID NO: 829 - DNA, 945 bp, Ipomoea nil
tcttccgtgcagttgatcgaaagatggagtgacagatggcgagttggtgatccgttcacctacaaattaaatactccgatattatttaattagaaattgcaaacacccaattcatatttcttcgtttcttccgctcatctcaactgagctgaggtttcaatttcaagcacgccttcttcgatggcgggtggagttttttcaggcttgaggcgcttctacctcgccctttacaattgggttgtgtttgtaggatgggttcaggtgttttatcttgctgtgaagactctaatggagtctgggcacgaaaatgtctaccaagccgtcgaaaagcctctgcttttagctcaatccgccgccgtattggagatacttcatggtctagtaggacttgtgagatctcctatttcagcaacactgccacagataggatcgagattatatgttacttgggggattttgtatagctttcctgagattcggacccatgtatttgttagttctctagtcattagttggtctatcacagagattatccggtattcattctttggcacaaaggaggcatttggccgtggaccttcagggctcttgtggcttaggtatagctccttcatcttgctatatcctaccggcattacaagtgaagttggtttaatatacaaggctcttccttacctcatggaatcgggaaagtattcattttggatgcccaacaaatggaacttttctttcgactactactacatggcatttgttgtgttggccatctatgttccaggcagccctcacatgtatggctacatgcttggacaaaggaagaaagctctccgcaaggccaagcaggcatagaccactggctttataacttatgtgtttgtatttggaattttggatggattcttgtttttttaaatcatttcatcttcatctttggttgaactatgc

SEQ ID NO: 830 - DNA, 1091 bp, Arachis hypogaea
aacacaccacaatatttaacattggatctttcatcctctcaactcctctccccctacacttgcatgttcctcagatctcacattcaatggcgggtttcttctctcttctcaggcgcctctacctctccatttacaactggaccgtcttctttggatggtctcaggttctgtatcatgtcctgataacgttgaaggagtcgggtcatgaaaacgtttacaacgcagccgaaaaacctttgctttttgctcaaaccgccgctgtgttagagattctgcatggtttggtagggcttgtccggtctccagtttcagcaaccttgccacagataggttctaggttgtacctgacttggggcatcttatggagtttccctgagacccggaatcatgtgcttgttacctccctactaatcagctggtccatcactgagataattcgctattctttctttggcttcaaggaggctttcggttttgccccgtcatggcttttgtggctaagatatagcactttcttactgctgtatccaacaggcattagcagtgaagttggtctgatatacattgcactgccattcatcaaggcatctgagaagtattgcataagaatgccaaacaaatggaacttctcgttcgactacttctatgctgctattgttgtacttggaatctatgtcccaggaagccctcacatgtatacatacatgcttgcacagaggaagaaagcgctctcaaaatcaaagagggaatgattagcatctgttgtagtttatcattggattttggccaaacataggatataggcatgtctttgtcttggtttggattcacatatgtatccaactaactgttgcctttcttgcaagtgtatgcttaagagtgaagaaattaaagtattttgttgttagtttatttgttgcaagttcctttagctaataatgcctttcaatgtacatgaacctaataatatgcgaaattccaaataacgaatgtgtggtgaggaaacaatttgtgaggctttttgggtgtcaaactgaagctactcacccttcctcgacttcaattatataaaacaaaaagcttcggttagc

SEQ ID NO: 831 - DNA, 1121 bp, Persea americana
gtcttcttcttctcccactaaaccaatgaataccatcatcttcttcttataagaagaagaagaagaagaagaagaagccctagcccaagctgcatatctgattcaactgcttcgcgtttcagctctcactctctctagcaaatggcggggtttttttccactgtcaaacgcatctacctctcaatctacaactgggctgtcttctgcggatggattcaggttctgtatcttgctctcaagaccctgaacgaatcaggccatgaaaaggtttacgacgccgtcgaaaggcctctgcagctcgctcagaccgccgccgtcatggagattcttcacggactcgttggtttggttagatctccagtttctgcaacactaccacaaatcggttcgagaatttatgtaacatggggcatcttgtggagctttcctgagactcggacacattggcttgttagttctctggttatcagctggtctatcacagagaccgttcgatactccttttttggaatgaaggaggcgcttggctttgcaccttcctggctcttgtggctcaggtatagcacctttctgatattgtacccaactggcattaccagtgaggttggtctaatctacattgccctcccatacatcaagaggtctgacaagtactgcctaaggatgcccaatacatggaacttctcttttgattacttctatgcttcaattcttgctcttggaatttatgtcccaggcagcccacacatgtaccagtatatgattgggcaaaggaagaaggccctctccaagtctaagagggagtagcaagttgagtatgtgcactgaatcgcttatttttgggttgatctttgtactggtgcagttcttaaatgtattcagtataactgaagtgtttcgttcaaaggattcttgcttcaaatgcaattggatgcttaggctggtttcatcaaggcataggtttacctagtatttgtttcccgtacaattcatgcctgcatctggtgtactcagaattcagaaatgcttgcaggggcatgatatcttacctcgcctatttggaacagaaatcaaggcttgtgtgctttcaattgaaatacaagttgcaatagttctgctcc

SEQ ID NO: 832 - DNA, 1018 bp, Tropaeolum majus
gagacttaagtagtttaccgatctcaactacacatctttaattgcttctctcttccacctccatttctccggtggatctcttccataaatccttctcttttcacagaccccatccttcatcttcccctttccaatggccggagctttatctcttctcaggcggatatacctcactctctacaactgggttgttttctttggatgggctcaggttttgtaccttgctttgaagactttgaacgaatcaggccatgagaatatctacactgctgtcgaaaaacctcttctcttagctcaatccgccgctgttttagagattcttcatggtttagtaggtctggttagatctcctatttcttcaacagtaccacagattagttcaaggctgtatttgacttggggaatcctatatagttttccagaggttaggtctcatatactagttacctcactagtcatcagctggtctctcgccgagattattcggtattctttctttggtgtgaaggagggtcttggttttgcaccttcatggctcttgtggctcaggtatagcagctttattttgctatatccaaccggcatctccagtgaagttggattaatatatgttgccctgccatatattaagggatctgagaagtattgtataaggatgccaaacaaatggaacttctctttcgataacttctacgctgcaattgttgttcttggaatttatgtcccaggtactcctcacttgtatggttatatgctcggacagagaaagagagctctctccaaatcgaaaagggagtaaacatctaaatcttttttctggctttctgtacttggtgcttaaaaatgtttgtactctgtgacttggtaaatttatgtgatcaaagttttcttgacattgggaaaagaaaatctgtatcgtgttgttcgtcttggtgatgtcatatacgaatagttttttgaataaaatatgttagaaataaccaacatgagttgtccactgtaaaaccaaattaatagt

SEQ ID NO: 833 - DNA, 1084 bp, Arachis hypogaea
gtctctatcttgttgcatccgccaacgaacaaaagcaccccccacccacacttgcatgttcctcagatctcacattcaatggcgggtttcttctctcttctcaggcgcctctacctctccatttacaactggaccgtcttctttggatggtctcaggttctgtatcatgtcctgataacgttgaaggagtcgggtcatgaaaacgtttacaacgcagccgaaaaacctttgctttttgctcaaaccgccgctgtgttagagattctgcatggtttggtagggcttgtccggtctccagtttcagcaaccttgccacagataggttctaggttgtacctgacttggggcatcttatggagtttccctgagacccggaatcatgtgcttgttacctccctactaatcagctggtccatcactgagataattcgctattctttctttggcttcaaggaggctttcggttttgccccgtcatggcttttgtggctaagatatagcactttcttactgctgtatccaacaggcattagcagtgaagttggtctgatatacattgcactgccattcatcaaggcatctgagaagtattgcataagaatgccaaacaaatggaacttctcgttcgactacttctatgctgctattgttgtacttggaatttatgtcccaggaagccctcacatgtatacatacatgcttgcacagaggaagaaagcgctctcaaaatcaaagagggaatgattagcatctgttgtagtttatcattggattttggccaaacataggatataggcatgtctttgtcttggtttggattcacatatgtatccaactaactgttgcctttcttgcaagtgtatgcttaagagtgaagaaattaaagtattttgttgttagtttatttgttgcaagttcctttagctaataatgcctttcaatgtacatgaacctaataatatgcgaaattccaaataacgaatgtgtggtgaggaaacaatttgtgaggctttttgggtgtcaaactgaagctactcacccttcctcgacttcaattatataaaacaaaaagcttcggttagca

SEQ ID NO: 834 - DNA, 806 bp, Prunus persica
attagtgttgtaggctgctagatctgccatagcttcatcaatggcgggagcattatccgctctcaggcgcctgtatctctctctctataactggaccgtcttcctcggatggttgcaggtactgtatcttgctctcaagactctcaacgaattaggccaccagcatgtttacaaagccgttgaacgtccacttcttcttgctcaatccgccgccgttttggagattcttcatggtctagtaggtttggtcagatctccgatatcagcgacactgccgcaaattggttcaagattgtatcttacttggggagtcctctggagttttcctgagactcagagtcatatacttgtgagctctttggtcatcagttggtctatcactgagattattcgatactctttctttggcatgaaggaggcacttggttttgcaccttcatggctcttgtggctcaggtatagcacatttatcttgttgtatccaactggcatcacaagtgaagtgggtctaatttatattgccttacaatacattcagaagtctgaaaagtattctgtaaggatgccaaacaagtggaacttctctttcgattacttctatgctgccattatcgctctaggaatctatgtcccaggcagccctcacatgtaccggtatatgcttagtcagaggaagaaagctctttcaaaaaccaaagcggcgtagatggcgacaaaggtttaatgtatttctcatagtcatgataatatcagtcatatggttgtgtgtaaaatggaattttattcttgaaaaggctatttattta

SEQ ID NO: 835 - DNA, 1016 bp, Brassica rapa
ggcttttcacttccgatctctccgccataaagtctttaactcttttgctctctttggtgagtccgaagaatctttctatctagcgttagttcatggcggggtctttctccttcgtccgtcgcgtgtacctcactctctacaactggatcgtctttgcaggatgggctcaagttctgtactttgcggtaaagacgttgaaggaaacgggacatgaacatgtctatgacgctgtggagaagcctctccagcttgctcagaccgccgccgttctcgagattcttcatggattagtaggtttggtcagatctcctgtctctgctactctgccgcagataggttcaaggctgtttctgacttggggcatcctatacagctttccagaggtccagtcacattttcttgttgcgtcgctggtcataagctggtctatcacggagattatccgctactccttctttggtcttaaggaagctctaggctttgcaccttcatggcacttgtggctcagatacagcagctttttagtgctgtacccgaccggtatcaccagtgaagtaggtcttatctaccttgccttaccacacatcaagacgtctgagatgtacagcgttaggatgccaaacacactgaacttctcgttcgatttcttctacgcaacgatactcgtccttgcaatctatgtcccaggcagtccacacatgtacaggtacatgcttggtcaacgtaagagagctctctccaaatccaagagggaataataaaaaaagcttatagagagtggagagaccaaagcctcagctcatcaactgcttcttttctcttgcctagtttctttcatgttcttctctttgttagactctttaagtctttcgttttctttaattcctcagggatcgtgtaaactttaagcaggttactatatcaagactaatgtaatgactaggttaatacgaattctattgtcttgcttctttactgcgattttaaacatgaaaattaagcacaaaaaaaaaaaa

SEQ ID NO: 836 - DNA, 1258 bp, Gossypium hirsutum
tctctctctaggtcatagagatttcagcttgcttcccatcatcccagtccctcccattactccatataacttgttcatttgttctactctctagctagcctttttccccacaaatcaaatataatcttcgtttcctttacttttgggttcccatggcgtcggctttgactgttctcaggcggctctacctttccatctataattggctcgtcttcatcggctggtttcaggttctgtttttagcgttaaaggctttgaaagaatcaggtcatgaacatgtctataatgctgtcgaaaagcctctccttctagctcaatccgctgccgttatggagattcttcatggcttaataggtctggttaggtcaccggtgtcatcaactctgccgcagataggatcaagattgtatttaacttggggaattttatggagttttcctgagattcgaactcacattcttgttacttctttggtcatcagttgggccattacagagattattcgctattcattctttggcatgaaggaggcctttggttttgcaccttcatggcatttgtggcttaggtatagcacattcttggttttgtatccaactggcatcagcagtgaagttggtctgatctactttgccttgccatatatcaaggcttctgagaagtattgctttagaatgccaaacaagtggaatttctcctttgattacttctatgctgcaattcttgcccttggaatctatgtcccaggtagtcctcacttgtaccattatatgctcgggcagaggaagagagcactttccaaatcaaaaaaggagtgaactgttttcgaggtttgcggcattgtggttgttatctccgaactttggtgcatgtatcatttcattctttttagtattgctttttggctaaaatgttcaagggttagcatctttttggctgaatatgatggtgtaggtgcagctgctgaatttaccaaaatttgttggtgagtttggtggcgtgctgcgtgaatccagaaatctccaagttttgttgtggttgttcttattgcttattagagtatcataaattatcatttgtttctttccacaccgtcttctaaatccttggtgtataataaattgtaagttaaaaggtactggagtcgttaacgccgcagttggatttctacctgaattttttatatttaattttagcttagctcaataaaaagaaaaaagtaccgactgcgactctgcgttgataccaacctgcgcgg

SEQ ID NO: 837 - DNA, 1247 bp, Gossypium hirsutum
agagtacatggggaacccagttcatctccatttctctctctctaggtcatagagatttcagcttgcttcccatcatcccagtccctcccattactccatataacttgttcatttgttctactctctagctagcctttttccccacaaatcaaatataatcttcgtttcctttacttttgggttcccatggcgtcggctttgactgttctcaggcggctctacctttccatctacaattggctcgtcttcatcggctggtttcaggttctgtttttagcgttaaaggctttgaaagaatcaggtcatgaacatgtctataatgctgtcgaaaagcctctccttctagctcaatccgctgccgttatggagattcttcatggcttaataggtctggttagatcaccggtgtcatcaactctgccgcagataggatcaagattgtatttaacttggggaattttatggagttttcctgagattcgaactcacattcttgttacttcgttggtcatcagttgggccattacagagattattcgctattcattctttggcatgaaggaggcctttggttttgcaccttcatggcatttgtggcttaggtatagcacattcttggttttgtatccaactggcatcagcagtgaagttggtctgatctactttgccttgccatatatcaaggcttcggagaagtattgctttagaatgccaaacaagtggaatttctcctttgattacttctatgctgcaattcttgcccttggaatctatgtcccaggtagtcctcacttgtaccgttatatgctcggacagaggaagagagcactttccaaatcaaaaaaggagtgaactgttttcgaggtttgcggcattgtggttgttatctccgaactttggtgcatgtatcatttcattctttttagtattgctttttggctaaaatgttcaagggttagcatctttttggctgaatatgatggtgtaggtgcagctgctgaatttaccaaaatttgttggtgagtttggtggcgtgctgcgtgaatccagaaatctccaagttttgttgtggttgttcttattacttaattagagtatcataaattatcatttgtttctttccacaccgtcttctaaatccttggtgtataataaattgtaagttaaaaggtactggagtcgttaacgccgcagttggatttctacctgaattttttagatttaattttagcttagctcaataaaaa

SEQ ID NO: 838 - DNA, 921 bp, Thellungiella halophila
  misc_feature (684)..(684): n is a, c, g, or t
  misc_feature (915)..(915): n is a, c, g, or t
gataaatctctactctttgctctctctctctctatagcttagtcgcaatctccactcttcatggcgggctttctctccttcgttcggcgcgtgtacctcactctctacaactggatcgtctttgctggatgggctcaggttttgtactttgcgataaggactttgaaggaaacggggcatgaaaatgtctacgacgccatcgagaagcctctccagcttgctcagactgctgccgttctcgagattcttcacggattagtaggtttggtcagatctccggtttctgctactctgccacagataggttcacggctgtttctgacttggggcatcctatacagttttccagaggtccgatctcatttccttgttacgtcgctggtcattagctggtccatcacggagattattcgctactccttctttggtcttaaggaagctctaggctttgcaccttcatggcacttgtggctcagatacagcagctttttgttgctataccctaccggtatcaccagtgaagtaggtcttatctaccttgctttaccacacatcaagtcatccgagatgtacagcgttaggatgccaaacatattgaacttctcattcgactacttctatgcaacgataattgtccttgccatctatgttccaggtagtccacacatgtacaggtacatgctngggcagcgaaagagtgctctctccaaatccaagagggaataaaagctgtagagaagagaccaaagctcatcaactgattttcttctcttgtgtggttctttcatgtacttcgtctctctttgttagactatttaaagtctttctttgagtcttatttttttctttacttcctcggcgattgtttaatgttaagtgtaatgcgatttctaaattaatacgaagattattggngatccc

SEQ ID NO: 839 - DNA, 834 bp, Prunus persica
aaaaaaaaaaaaaaaaaaaaaaaaaacgaggtgttgtaggctgctagatctgccatagcttcatcaatggcgggagcattatccgctctcaggcgcctgtatctctctctctataactggaccgtcttcctcggatggttgcaggtactgtatcttgctctcaagactctcaacgaattaggccaccagcatgtttacaaagccgttgaacgtccacttcttcttgctcaatccgccgccgttttggagattcttcatggtctagtaggtttggtcagatctccgatatcagcgacactgccgcaaattggttcaagattgtatcttacttggggagtcctctggagttttcctgagactcagagtcatatacttgtgagctctttggtcatcagttggtctatcactgagattattcgatactctttctttggcatgaaggaggcacttggttttgcaccttcatggctcttgtggctcaggtatagcacatttatcttgttgtatccaactggcatcacaagtgaagtgggtctaatttatattgccttacaatacattcagaagtctgaaaagtattctgtaaggatgccaaacaagtggaacttctctttcgattacttctatgctgccattatcgctctaggaatctatgtcccaggcagccctcacatgtaccggtatatgcttagtcagaggaagaaagctctttcaaaaaccaaagcggcgtagatggcgacaaaggtttaatgtatttctcatagtcatgataatatcagtcatatggttgtgtgtaaaatggaattttattcttgaaaaggctatttatttcct

SEQ ID NO: 840 - DNA, 884 bp, Vitis vinifera
tcccatggcgttcttctcacttctaaggcgtctgtatctcaccatctacaactgggtcgtcttcttcggatgggctcaggtattgttttttgctctttcaactctgaaagaatcgggccaccagcatgtctaccgcgcagttgaaaggcctcttcagctcgcccaaacggccgccgttctggagatttttcatggcctagtaggattggtgagatctccaatcacagcgacactgccacagattggttcaaggttgtatgtaacttggggcattttatggagttttcctgaggttcaaactcatgtacttgttagctctttggtgatcagctggtctatcactgagatcattcggtattctttctttggcgtgaaggagttgcttggttttgcaccagcctggctcttgtggctcaggtatagcacctttctgttgttgtatccaaccggcattaccagtgaagttggtctaatatatattgccttgccatacattaaggaatcagcaaaatattgtttgaggatgcccaacaaatggaacttctcttttgattacttctatgctgcacttctggtcattgcattctatgtaccaggcagtcctcatatgtaccagtacatgcttgggcagaggaagcgagctctctccaaatcgaagagggagtagagtaaattttcaatgttgaactctggtttattgaagctttgtaagtgtagcagcataacatttttccagttcatgatttgggctggacaaatttgtttttagcatgggcaaaatctttaaatctcctaaaggcttaaaaagaatgaggttgatgttttagaaactgtatccatggacctcagctcatgtcaaatatcttttcatatttttttctgca

SEQ ID NO: 841 - DNA, 1368 bp, Triticum aestivum
aaaaaggaagggaaaaatctcccggggcgcaagcaaacgtgacgccacgcctcactccgtccctcgtcctcgtcctcttcctcctctccccactttccccgttaataattcggcaatcgatcgctgccgccgccgcgactgcgactgaagcctctgctccgctccgctctgctctgctcgccgctggaagatggagcctgaccagagtggcaccgggcagacttctccccgcgggaacgactgggaggtcgtgcagctcaccgcttcaaactacgcttctgcacctggtccggcgagaactgaaccttccgacgaggaggctgaaggccaggtgtatgacgcagaggggggtgattccgcagccgcgtcgctgctcatgtctggccatttctcggtgccgcagagtgaggctgagaaactcctcatggaagctgatactagcatatatcagcaggaggcgcgcggcagccagtatgcagtttctgacaagggtggagatggtatgtacgaagaccagcaggagaaactgaaggacgacggtcttgacaggatcccgtccttcgacaaagggaaaagcctttcccctgttgatatggagcctgacgatgggaacgcattgcacagcgttagtcaggctggggaagacccagttacattctcatcatctggttacagtgcaacggaggctgagaaagaagttaccgagagtgccaaggagaagactgaagaaaatataacgctccaaaatgtcgaccctgtcactgattcgtccaatgttgttgcttccggtgaggagagcaagcctgacggttctggagccccacgcaatgtgtggtggcagaagcaacttatatcactctacaggagcgctaaagagagcaacaagctctggcctatcgttgtggctgctgccgctttgatggggatggcatatttccggcggcgctggcagaagggcaagctgcagcttcagcaggtcaaattgcaacctgccagcagcaaggagagaatcaaccaggccaccgtaccgcttaaccgaatcaaggacattcttgtcgctggcaaccacccgagtccggctactcatggaaatgctcgattgggctgatgatgataaccatcccgccgacggatgatgtatcctgaaactagtgtatgcaatggagaaatacccgatgccgcagaacgtatggacgtttatgcgtgctggctgtgtaattaaaccccaaaactcctcctgggtatgtaaatatacacgagttttgtgtggttgctttccctcctttgggagaactcccaccttggccaggttcagtgtgctgctgcagtttgtcaggcactgtaacttcttccgttgatttcgtggat

SEQ ID NO: 842 - DNA, 1450 bp, Triticum aestivum
ccacgcgtccgaaggaaagaatctcccggggcgcaagcaaaggtgacgccacgcctcaatccggccttcgtcgtcctcctcttcctccccccactttccccacaatagtttggcgatcgctcgctgccgccgccgcgaccgcgactgaagcctctgctccgctccgctccgctcgccgctggaagatggagcctgaccagagtggcaccgggcagacttctccccgtgggaacgactgggaggtcgtgcagctcaccgcgtcgaactacgcgtctgcgcctggcccggctagaactgaaccttctgacgaggagtctgaaggccaagtgtatggcgcagaagggggtgattcggcagccgcggcactgctgatgtctggccacttctcggttccgcagaatgaggctgagaatctcctcatgggagctgatactagcatagagcagcaggaggcgcgcggcagccagtacgcagtctctgacaagggtgatgatggtgatagggaggaagacccgcaggagaaactgaaggatgatgttcttgacaggatcccgtccttcgacaaagggaaaagcctttcctctgttgatatggaacctgatgatggcagcgagttgcacaggggtagtctggttggaaaagacccagttacgttctcatcctctgtttacaatgcaactgacgctgagaaagaagctaccgagagtgccaaggagaagactgaagaaagtccaactctccaaaatattgaccctgtcactgattcgtccaatattgttgcttccggtgacgagagcaagcctgacggttctggagccccacgcaatgcatggtggcagaagcaacttatatcgctctacaggagcgctaaagagagcaacaagctctggcctatcgttgtggctgctgctgctctgatggggatggcgtatttccggcggcgctggcagaagggcaagctgcagcttcagcaggtcaaattgcaacctgccagcagcaaggagagaatcaaccaggccaccgtaccgcttaaccgaatcaaggacattcttgtcgccggcaaccacccgagtccggctcctcacggaaatgctcgattgggctgatgatgataaccatcccgcctgacggatgatgtatcctgaaactagtgtatgcaatggagaaatagccgatgccgcagaacgtatgggcgtttatgcgtgctggctgtgtaattaaaccccaaaactcctcctgggcatgtaaatatacacgagttttgtgtggttgctttccctcctttggaagaactctctccttggccaggttcagtgtgctgctgcttcagtttgtcggccactgtaacttcttccgttgctcccgtggatattttttatctgtcttgttgcgggttgcagtttgtcaggttgtcggccgatatatacacgatgaacttatgataaaaaaa

SEQ ID NO: 843 - DNA, 1439 bp, Triticum aestivum
  misc_feature (48)..(48): n is a, c, g, or t
aaggaaagaatctcccggggcgcaagcaaaggtgacgccacgcctcantccggccttcgtcgtcctcctcttcctccccccactttccccacaatagtttggcgatcgctcgctgccgccgccgcgaccgcgactgaagcctctgctccgctccgctccgctcgccgctggaagatggagcctgaccagagtggcaccgggcagacttctccccgtgggaacgactgggaggtcgtgcagctcaccgcgtcgaactacgcgtctgcgcctggcccggctagaactgaaccttctgacgaggagtctgaaggccaagtgtatggcgcagaagggggtgattcggcagccgcggcactgctgatgtctggccacttctcggttccgcagaatgaggctgagaatctcctcatgggagctgatactagcatagagcagcaggaggcgcgcggcagccagtacgcagtctctgacaagggtgatgatggtgatagggaggaagacccgcaggagaaactgaaggatgatgttcttgacaggatcccgtccttcgacaaagggaaaagcctttcctctgttgatatggaacctgatgatggcagcgagttgcacaggggtagtctggttggaaaagacccagttacgttctcatcctctgtttacaatgcaactgacgctgagaaagaagctaccgagagtgccaaggagaagactgaagaaagtccaactctccaaaatattgaccctgtcactgattcgtccaatattgttgcttccggtgacgagagcaagcctgacggttctggagccccacgcaatgcatggtggcagaagcaacttatatcgctctacaggagcgctaaagagagcaacaagctctggcctatcgttgtggctgctgctgctctgatggggatggcgtatttccggcggcgctggcagaagggcaagctgcagcttcagcaggtcaaattgcaacctgccagcagcaaggagagaatcaaccaggccaccgtaccgcttaaccgaatcaaggacattcttgtcgccggcaaccacccgagtccggctcctcacggaaatgctcgattgggctgatgatgataaccatcccgcctgacggatgatgtatcctgaaactagtgtatgcaatggagaaatagccgatgccgcagaacgtatgggcgtttatgcgtgctggctgtgtaattaaaccccaaaactcctcctgggcatgtaaatatacacgagttttgtgtggttgctttccctcctttggaagaactctctccttggccaggttcagtgtgctgctgcttcagtttgtcggccactgtaacttcttccgttgctcccgtggatattttttatctgtcttgttgcgggttgcagtttgtcaggttgtcggccgatatatacacgatgaacttatgataaaaaaa

SEQ ID NO: 844 - DNA, 1461 bp, Hordeum vulgare
ccacgcctcaccccgactctcctctcctcgtcctccccctctccccactttccccgttaaaaattcggccatcggtcgcgacggaagcctcctctgctccgctctccgctcgccgctcgaagatggagcctcaccagagtggcaccgggcagacttctccccgcgggaacgactgggaggtcgtgcagctcaccgcgtcaaactacgcgtctgcgcctggtccggcaagaaccgaaccttccgacgaggagtctgaaggccaggtgtatggcgcagaagggggcgattcggcagcctcggcgctgctgatgtctggccatttctcggtgccgcagaatgagcctgggggtctccttgtggaagctaatgctagcatagagcggcaggaggcacacggcagccagtatgcagtctctgacaagggcgatgacgatgatacggaggacgaccggcaggagaaactgaaggatgatgatcttgacaggaccccgtccttcgacaaagggaaaagcctttcctctgttgatatggaacctgatgatggcagcgagttgcacaggggtagtccggttgggaaagacctggttacgttcaaatcgtctggttacagcgcaactgacgccgagaaagaagctattgacagtgccaatgagaaggccgaagaaaatacaatgctccaaaatgttgatcctgtcactgactcgtccaatgttgttgcttctggcgaagagagcaagcctgacggttctggagccccacgcaacgtgtggtggcagaagcaacttatatcgctgtacaggagcgctaaggagagcaacaagctgtggcctatcgttgtggctgctgccgctttgatggggatggcgtatttccgacggcgctggcagaagggcaaactgcagcttcagcaggtcaaagtgcaacctgccagcagcaaggagagaatcaaccaggctgccgtaccgctaaaccggatcaaagacatccttgtcgccggcaaccacccgagtccggctgcccatggaaatgctcgattgggctgatgataacgcccccgtcgacgcacggtgtatcctgaaactaagtattgcattgcatggagacatcggcagaactgtaaattgaggcgatgagcgtcgtcgtctcgtccacctgatgccgcagaacgtgtggacgtttatgcgtgctggctgtgtaattaaaccccaaaacttctcctgggcatgtaaatatacacgagttttgtgtggttgctttccctcctttggaagaaacccctccttggcctggttcagagtgctgctgctgtagtttgtcagccactgtaacttcttccgttgctctcgtggatcttttatctatcttgttccgggtgtagctccttccgttgctctcgtggattttcttttatcttccgggttgcaatgtatcggccaatatatacacgatgaacttatatga

SEQ ID NO: 845 - DNA, 1462 bp, Hordeum vulgare
ccagcgcctcaccccgactctcctctcctcgtcctccccctctccccactttccccgttaaaaattcggccatcggtcgcgacggaagcctcctctgctccgctctccgctcgccgctcgaagatggagcctcaccagagtggcaccgggcagacttctccccgcgggaacgactgggaggtcgtgcagctcaccgcgtcaaactacgcgtctgcgcctggtccggcaagaaccgaaccttccgacgaggagtctgaaggccaggtgtatggcgcagaagggggcgattcggcagcctcggcgctgctgatgtctggccatttctcggtgccgcagaatgagcctgggggtctccttgtggaagctaatgctagcatagagcggcaggaggcacacggcagccagtatgcagtctctgacaagggcgatgacgatgatacggaggacgaccggcaggagaaactgaaggatgatgatcttgacaggaccccgtccttcgacaaagggaaaagcctttcctctgttgatatggaacctgatgatggcagcgagttgcacaggggtagtccggttgggaaagacctggttacgttcaaatcgtctggttacagcgcaactgacgccgagaaagaagctattgacagtgccaatgagaaggccgaagaaaatacaatgctccaaaatgttgatcctgtcactgactcgtccaatgttgttgcttctggcgaagagagcaagcctgacggttctggagccccacgcaacgtgtggtggcagaagcaacttatatcgctgtacaggagcgctaaggagagcaacaagctgtggcctatcgttgtggctgctgccgctttgatggggatggcgtatttccgacggcgctggcagaagggcaagctgcagcttcagcaggtcaaagtgcaacctgccagcagcaaggagagaatcaaccaggctgccgtaccgctaaaccggatcaaagacatccttgtcgccggcaaccacccgagtccggctgcccatggaaatgctcgattgggctgatgataacgcccccgtcgacgcacggtgtatcctgaaactaagtattgcattgcatggagacatcggcagaactgtaaattgaggcgatgagcgtcgtcgtctcgtccacctgatgccgcagaacgtgtggacgtttatgcgtgctggctgtgtaattaaaccccaaaacttctcctgggcatgtaaatatacacgagttttgtgtggttgctttccctcctttggaagaaacccctccttggcctggttcagagtgctgctgctgtagtttgtcagccactgtaacttcttccgttgctctcgtggatcttttatctatcttgttccgggtgtagctccttccgttgctctcgtggattttcttttatcttccgggttgcaatgtatcggccaatatatacacgatgaacttatatga

SEQ ID NO: 846 - DNA, 1529 bp, Sorghum bicolor
tctacacttgtgtgacagatttgctggtcacacggatggaattggcgcgggcggcgggctggcagttacacagctgcagcggcaataactcccgctgcccaccggctcacctgtccttcaataccaaattcaatccggccagtggttggcccgccgctgccagatcgaatcggactctcaatacatgcagcccaccaccgagacgccgaagctatatttcatgccatctgatctgattcgatgcgtgtggcgtctctgcttttactagatcatcagtagtacccagttcaggagcctggtcagagcacatccaggcgtcttctccctcctcaccgcggctccggcgatggcgggcgtgggctcggcgttgcggcggctctacctctccgtctacaactgggtcgtcttcttcggatgggcgcaggtgctgtactacgcggtcctgacgctgcgggagagcgggcacaaggccgtctacgccgccgtcgagaagccgctgcagttcgcgcagacagccgccatcatggagattcttcatgggctcgtagggttggtgaggtctccggtctctgcaactcttccacagattggatccaggctgttccttacgtggggtgtcttgtggagttttcctgagacccagtcacatcttcttgttactaccctggtcataagctggtctatcactgagatcatcagatactctttctttggaatgaaggaggcatttggctttgcaccttcctggttattatggcttaggtacagcacctttatgttgttgtatcctactggtatctctagtgaagttggtctgatctacattgccttgccttacatgaaggcatcggagaaatactgtcttaggatgcccaacaaatggaacttttcatacgattacttctattcgtctattcttgccctcctgatttatgttccaggaagcccgcacatgtaccgttacatgctctcacagaggaagaaggcactatcaaaggccaaagcggcttaatgctgctcaagggctctgtagatggtttgtgtgatgtcgaaatgtgcctcacggctcaagttttcgacatttccggtagaatctagtgattggggatattattagaatggagctcttcatatgaactgccccaatcatttcagctatcagccgttgcatggttaaattgtaatttgttccgaatcgccctcaattgggcgagtttccatgttgattatatggcaatgtgtttcacatccttctctcatctggtactgtgttctcttatttgtagcaaataatgtatgattgttgtgctggaatcatttcagctatcggctgttgcatggttaaattgtaatttgctccgaccgacccccaattgggtgaatttccatgttgattatatggcaatatgtttcgcatccttctctcatctggtactgtgttctctacttctcttgtttctagcaaacaatgtatgattgataatctagtgccatgaacattttcatgctctagttatagtagttgatgt

SEQ ID NO: 847 - DNA, 1135 bp, Saccharum officinarum
cacagctcaggagcctggtcagagtagccaagcccacccagtcccgtcccggcgtcttctccctcctcaccgcggctccggcgatggcgggcatcggctcggcgttgcggcggctctacctctccgtctacaactgggtcgtcttcttcggatgggcgcaggtgctgtactacgcggtcctgacgctgcgggagagcgggcacaaggccgtctacgccgccgtcgagaagccgctgcagttcgcgcagacagccgccgtcatggagattcttcatgggcttgtagggttggtgaggtctccggtctctgcaactcttccacagattggatccagattgttccttacatggggtgtcttgtggagttttcctgagacccagtcacatcttcttgttactaccctggtcataagctggtctatcactgagatcatcagatactctttctttggaatgaaggaggcatttggctttgcaccttcctggttattatggcttaggtacagcacctttatgttgttgtatcctactggtatctctagtgaagttggtctgatctacattgccttgccttatatgaaggcatcggagaaatactgtcttaggatgcccaacaaatggaacttctcatacgattacttctatacatctattcttgccctcctgatttatgttcccggaagtccgcacatgtaccgttacatgctctcacagaggaagaaggcactatcaaaggccaaagcggcataatgctgctcaagggttctgtagaatggtttgtgcgatgtcggaatgtgcctcacggctcaagttttcgacatttccggtagaatctagtgattggggatattattagaatggagctcttcatatgaactgccccatacgtgtaatgtgttgtaccggaattatttcagctatcagttgttgcatggttaaattgtaatttgctccaaatcacccccaattgggtgaatttccatgttgattatatggcaatgtgtttcgcattcttctctcaactggtagtggtctcttgtttctagccaacaatatttgattgattattatccagtgcgccggaccttttcccaaacacccacccaccacccaacaccctaatcctaccgaggtcg

SEQ ID NO: 848 - DNA, 1427 bp, Setaria italica
ccgcgggcggcgggcgggcagttatgcagctgcagcggcaataactcccccgctgcccaccggctcacctgtcctccatcggccccgatccgatccccaattcaattccaaattcaatccgatccgaccagtggttggcccgccgctgccagatcgaatcgaactcccccgtccggtcgtccgtgcagctcaccgccaagacgcccaagcttattacgccacccgttctggtgcgtgcggcgtgctactatagcgaggtgagcacctgcacccctgtcggagcagccaaggacatccccgtcgcggcgtcttgttcctccactcctcactgcggctccggcgatggcgggcgtcggctcggcgctgcggcggctctacctctccgtgtacaactgggtcgtcttcttcggatgggcgcaggtgctgtactacgcggtcctggcgctgcgggagagcgggcacgaggccgtctacgccgccgtcgagcgcccgctgcagttcgcgcagaccgccgccatcatggagattctgcacggccttgtagggctggtgaggtctccagtctctgcaacccttcctcaaattggatccaggttgttcctgacatggggtgtgttgtggagttttcccgagacccagtcccacatccttgtttccacactggtcatcagctggtcgatcactgagatcatcagatactccttctttgggatgaaggaggcatttggatctgcaccttcatggctcctgtggcttaggtacagcacctttatgctcctgtatcctactggtatctctagtgaagtaggcctcatatacaccgcattgccttacatgcaggcgacagagaaatacagctttaggatgcctaacaagtggaatttctcgtacgattatctctacacatctattcttgccctcgtgatctacattccaggaagcccgcacatgttcggctacatgctctcgcagcgcaagaaggccctgtcgaaggccaagactgcgtgatgctgctcaagagctttgtagaagggctcgtgtgatgtcagaatgtgtaccttctttcggtagaagttagcgattggggcggggagggggttggaatggaacttcgccatgaattgcctgatcagtacgtgttgtcccaatgatgtatcagctgttgcatgcttaaattattgttgatccaaaatcgcccataacagggtgaatttccatgtgatttggtgcctatgtttggattaatgcttatccctcatatatcttgctagatgtgctgttgtactgtgtcgctcggatttggacaacaatacatgattggttgtccagtgtccacgaactttttccttcttgtgccagtagtatcatctactgccttttcagtaaacattttcatgtcttgagacggtgacacttgaatggatatg

SEQ ID NO: 849 - DNA, 2768 bp, Oryza sativa
agtctgatagacagttgacttggctgagctgagcagttctatcacttggaaagctactgaaaacaactcagacgaaattgaacgagaagtggttgcagtactgaacttgcagcagatcacatggatgatattggcgggagagccggctcagtcagttattagggtagctgcagctgcaataactgccaccgccagccattcttccccccatccatccaccccgattcattgcgaattcagttgcgtcagtagttcgttggttggccagcctccaacccaccggaattcgcaaatccgagcaagcagtctgctgctgattgcatcctctaatctgatgctgatgcgagcagtaatcaacagctatagtagattcagtccacgcgcccattaaagccaagccagtatctttgtccaggcctcgcgttcctcctccgcctccttgttagctactgctgagtgctcggcgatggcgggcgtcgggtcggcggtgcggcggctctacctctccgtttacaactgggccgtcttcttcggatgggcgcaggtgctgtactacgcggtcacgacgctgctggagagcggccatgaggccgtctacgccgccgtcgagcggccgctgcagttcgcgcagaccgccgccttcttggagattcttcatgggcttgtaggtttggtgaggtctccagtctctgcaactcttccacaaattggatcgaggttgtttcttacctggggcatcctgtggagctttccagagacacattcacatatccttgttacttccttggtcataagctggtccatcactgagatcattagatattccttctttggcatgaaggaggcattcggatttgctccttcctggctcttatggctgaggtatagcacctttatggtattgtatcctactggtatcagcagtgaggtcggtttaatctacattgccttgccttacatgaaggcatcagagaaatactgccttaggatgcccaacaaatggaacttctcctttgatttcttctatgcatccatcctttctctcgccatctacgtgcccggatcgcctcacatgttcacctacatgcttgcccaacggaagaaggcattggcaaaggctaaggctgcataatggtgatgctcaagagctttcttgaatttttcatgtgtggcttaaggatctgcctaaatagctcatatttgctactcttttagtacaagtctgtagatgaggaaatgttggaaagaactactatcttaatcccagcatttgttgtaactgtagtaactgcccatcatttgttgtaactgtagtcttctaccaagaattgtatgatattttacctggttaaattattgaatgattgatccaaaatttgccggcttgtttcaagttgcactctttctgcgtttgctgttagcctgttatgctgtatgttgcacactttgcactgcgggctatagagaattggcacatttgcatatttattactggtatgcaattatgagtcccattgtttcacttatgcttataagcagttttaaattttataacttaattttgaagttgattttgtggttttctcatcgtagcaacatttgcttttgaatcactaagaacacatataaaattttttatccatattatgtttatattgctaataactgattcaaataagcataagcataaagccaaataatgagttcgtatcttaaatacaaaatatgatttcaagcagttaagctaactttgttttgaaaggaaaatgagccaaatttaaaccctacgaaaaccgtccaaaacgctatgggaagtcccaaaaaaagtttatgtgcagcatttaactatttgccacattttttttgacgtaaaaggtagggagattctaccttgtaaccattatattaactagaaagatagcccgcgcgaatgcgcgggcatgtgttatagattgcttattaaatacttaattatatagattaaatatcaaccggatgacacctaccatgttttcaaagtatcatttctctatttcttttcatcgacattgcttacataattttaccaaactattcgttagaatttaaatatgtaatatttaatacatccctataaacaattatctatcatctcttcttcatcgtaaagttagatttactttgtttgaaaaacatgtctaataaattaagtgtaaataaaaataaggtgatttgtcttgtttaattgaatgtttagtattttttaaaataaatcctaaagaactattactgttaataaatatgctttatttgtcccaccaaattagtcctccttctagatggttcagatttacacaaaatgttatatacttacatataaattaacaaagatgtatcataggcctcatttccttgtgatatgcatgatctatattatcctttttaaaagataatacctagttaacatgaatctgaaaacttaaatttaatagtaacaaataaaacttttcaacaactatatactgctatcttagtgtggcttatatatgcaattatatacaaataaactcataatgctacggagtaattataatcttaagaataataattagttaaaaatctaatatagttgattctgttgtttgtaattattgatcatttttactaattagttaaaaattagaagatggatgaattgaatgagagaggagacgaacagagtgaaaggggagagagtatgcttgcatataattacttgttatactattttagttgtttactttattaac

SEQ ID NO: 850 - DNA, 1110 bp, Cenchrus ciliaris
  misc_feature (154)..(154): n is a, c, g, or t
  misc_feature (950)..(950): n is a, c, g, or t
  misc_feature (994)..(994): n is a, c, g, or t
gtccggtcgtcgcagcagcccgtcgccaagacacccgagcttattttacgccgtccgatctggtgcagtagtagcgagttgagcacacctctgtcagagcagccaaaggacatcccagtcgcggcatcttgttcctcagctcctcactgcggcnccggcgatggcggcgggcgtcggctcggcgctgcggcgcctctacctcgccgtctacaactgggtcgtcttcttcggatgggcgcaggtgctgtactacgcggtcctggcgctgcgggagaacgggcaccaggcagtctacgccgccgtcgagcgcccgctgcagttcgcgcagaccgccgctattctggagattctgcacggcctcgtagggctggtgaggtctccggtcacagcaacccttccacaaatcggatccaggttgttcctgacatggggtgtgttgtggagcttcccagagacccagtcccacatcctagtttctagcctggtcataagctggtctattactgagatcatcagatactcgttcttcgggatgaaggaggcatttggatctgcaccttcgtggctcttgtggcttaggtacagcacctttatgctcctgtatcctactggtatcgccagtgaagtaggcctcatatacaccgcattgccttacatgcaggcaacagagaaatactgccttaggatgcctaacaagtggaacttctcatatgattatctctatacatctattctcgccctcgtgatctacattccaggaagcccgcacatgttcacctacatgctctcgcagcgcaagaaggccctgtcgaaggccaagactgcgtgatgctgctcgaaagctttgtacaagggcttgtatgaatgttagaatgtgcctaatcgctcaagttccgactcttccagtagaaaattagttattgggagtttgttggaatggaacttcgccncaaatgattgtatcagctgttgcgtgcttaaattattgttgatntaaaattacccataacagggtgaattccgatgctgattcggtgtgtatatctggcacagatgtgctgttgtactgtatcactcggatttggacaacaatatatgattggttgacca

SEQ ID NO: 851 - DNA, 959 bp, Cynodon dactylon
agcatccgagcccgtcttctctcgctgtcaacctccttcctcctcccggcagctcggcgatggcgggcgtcggttccgcggtgcggcggctctacctctccgtctacaactgggtcgtcttctacggatgggcacaggtgctgtactacgcggtcacgacgctgcggcagagtgggcatgaggccgtctacgccgccgtcgagcggccgctgcagttcgcccagactgccgccatcatggaaattcttcatgggcttgtaggactggtgagatctccggtctcggcaactcttccacaaattggatcaagattgtttctcacatggggcatcttgtatagttttcctgagacacaatctcatattcttgttacttccctggtcataagctggtccatcactgaggttattagatattcattctttggtatgaaggaggcacttggatttgcaccctcctggctcttatggcttaggtacagcacctttttgatattgtatcctactggtatcactagtgaagtcggactcatctacattgccctgcctttcatgatggcatcagagaaatactgccttaggatgccaaacaaatggaatttctcctttgattacttctacatgtctattcttgtcatgggcatctatatcccaggaagccctcacatgtacaattacatgcgtgcccaaaggaagaaggccttgtccaaggcaaaaagcgcatgaccctgcttaggagcttcctaggacactgtttgtggcttctcaatgctcaagtttgttactcccttaacagaagttagtgggttgggagtgttactattcaacagtttgcatgatttggtagctacttgttgtactgagattgtgttagctcgtgtatgattgaacaagtgatctgaatcgcacaatgtggtgcagattacaatgcaaaacatcactctttcgttgggcgtgctt

SEQ ID NO: 852 - DNA, 2127 bp, Oryza sativa
tgatcatggtgctttgcgaagttttttgctctattgccaatcaccttatggaggttttacaaagtttttgtacgatcaattcccggatatctaccattcttactatggacttgccgctctttccttgctggaagaggaagggctggagccactctgcaccgaactggggatcctctctgctgcattgtagcttggaattgattgttcatcttctgtattcagtcaagttatggtgttctttaaagtccattcttgtaatctaatacaacatacagctgaaaagaatgcaagtaatctatagagttcgtttgtttgtttgggtaggcaggtcatgcaacattgtcttggataatatgattgtgaagtacagaggagcattctgtaaaggctatttcattttcagttagtcgaactaactgatattctgatagacagttgagttggctgagcagttctatcacttggaaagctattgaaaacaactcatgtaacagctgaacaaaattatcatctttattctgtttcttgatgtgcttcctatgtatcactgattaattctggtagttgtagatgctgatatacacacacagacacacaatttcttttcttttgacaggccatcaggttaacagcataatacttgtgattgagaacagagagagaaatgagagatttttttttactgaacctgcgtgtctgaactcttctgaagataaaattgaaagttgcagtactgaactgaatttgcagcaaatcacatggatgatattggcgggaaagccggctcagtcagctgcagctgccataactgccaccgccacccccacatccactccgattcattgcgaattcagtttgatcagtggttggtcggttggccagcctcccatccaccggaattctcaaatcggagcaagcagcctactgattgcgattgcatcctctgatctgatctgctgatgcgaatgcgagcagtaatcaacagcgtagtagattcagtccacgcgcccattaaagccaagccactgtccttgtccatctttgtccaggcctcgcgttcctcggttcctcctcctccttgctagctgctgctgagtgctcggcgatgacgggcgtcgggtcggcggtgcggcggctctacctctccgtctacaactgggccgtcttcttcggatgggcgcaggtgctgtactacgcggtcacgacgctgctggagagcggccatgaggccgtctacgccgccgtcgagcggccgctgcagttcgcgcagaccgccgccttcttggagattcttcatgggcttgtaggtttggtgaggtctccagtctctgcaactcttccacaaattggatcaaggttgtttcttacctggggcatcctgtggagctttccagagacacattcacatatccttgttacttccttggtcataagctggtccatcactgagatcattagatattccttctttggcatgaaggagacattcggatttgccccttcctggctcttatggctgaggtatagcacctttatggtattgtatcctactggtatcagcagtgaggtcggtttaatctacattgccttgccttacatgaaggcaacagagaaatattgccttaggatgcccaacaaatggaacttctcctttgatttctcctatgcatccattctttctctcgccgtctacgtgcccggatcgcctcacatgttcacctacatgcttgcccaacggaagaaggcattggcaaaggctaaggctgcataatggtgatgctcaagagctttcttgaatttgtcacttgtggcttaaggatctgcctaaatagctcacatttgctactcttttagtagaagtctgtagatgaggacatgttggaaagaactactattacactgcccatcatttgttgtaactgtagtcttctaccaagaattctagattttacctggttaaattattgaatgattgatccaaaatttaccagcttgtttcaaattgcactctttttgcgtttgctgttagcctgttatgctgtatgttgcacactttgcactgcgtgctatagagaattggcatatttgcatatttactggtttgcaattatgagtcccattgtttca

SEQ ID NO: 853 - DNA, 1356 bp, Pennisetum glaucum
ccccaattcaattccgaattcaatcagatccaaccagtcagtggttggcccgccgctgccagatcgaatcgaactcggccgtccgtgcagcagcccaccgccaagacgcccgagcttatttcacgccgtccgatctgatggtagcgagttgagcacacctctgtcagagcagccggacagccaagaacatccccgtcgcagcgtcttgttcctccctccgctcctcactgcggctccggcgatggcggcgggagtcggctcggcgctgcggcggctctacctctccgtctacaactgggtcgtcttcgtcggatgggcgcaggtgctgtactacgcggttttgacgctgttggagagcgggcatgaggccgtctacggcgccgtcgagcggccgctgcagttcgcgcagaccgccgccatcatggagattcttcatggacttgtaggtttggtgaggtctccaatctctgcaactcttccacagattggatcaagattgtttcttacatggggtatcttatggagtttccccgagacccgttctaatattcttgttacctcattggttataagttggtctatcactgagatcattagatactccttctttggtatgaaggagacatttggatctgcaccatattggctattatggcttaggtataccacattcatggtactgtatcctactggtatctccagtgaggttggtctgatttatgctgctttgccttacatgcaggcaactgagaaatattgtctaaggatgccaaacaaatggaatttctcttatgattacatgtacacatctattcttgctctcgctgtttacattccaggaagtccccatatgtttaggtatatgctttctcagcgtaagaaggcactgtcaaagtcaaaaacagcataaacagctcaaggtctttatagagtaccatgtgtgaactctcaaagcgcctcttgagttcttctactttccagaagttagtgaaatgtgggcgggtactcatttcttggttgcccaaaaacatgttgtaccatgaatcatcagatttgtttggctaaaattattggtccaagtctcccaaaatggacatggtgaacattacaatctgatacaacagctacttgttaattatgttagtgatttaacatgattctgtgtgacatgtatttccttgtacaccctgctttgtcattgagataccgagctgtgcagccttaatgttgacgagatgaaggaccatttcttcaatgtttagttgtctaggaatcttatgattctgcggcagcctttagaaaaaacaattgcggggtttgagtttattaatttgctggatataccctgcagtacag

SEQ ID NO: 854 - DNA, 1200 bp, Brachypodium distachyon
actctcttcagtgctcctgtccgagcgacccgttcccgcacgattcaatgcgaaatcaattcgggcagcagtaagttaagttagctggccagccgccgcctaaaccatccaagatccagctcccgatccgatccagcaaacaaaaggcagccaaaggagtattagttgtttgattctgactctgattcctcctcttctcctgatccaactctgcatccgtcctcgtcttcttcttgctcctgatccgtgaagctccggcggatccgccaatggctgcggccgctgggtcggtgctccggcggctctacctctccgcatacaactgggtcgtcttcttcggatgggcgcaggtgctgtactacgcggtcacggcgttgctggagagcggccatggcgccgtttacgccgccgtcgagaagccgctgcagttcgcgcagaccgccgcgttcatggagattcttcatgggcttgtagggttggtgaggtctccggtatcagcaacccttccacagattgggtcaaggttgttccttacatggggtatcttgtggagcttccctgagacacgctctcatattctcgttacttccttggtaataagctggtccattaccgagattattagatattctttcttcggtatgaaggaggcacttggatttgcaccttcatggcttttatggctcaggtatagcaccttcatgatattgtatcctaccggtatcttcagtgaggttggcctaatctacattgccctgccttacatgaaggcatcagagaaatactacattaagatgcctaacaaatggaatttctcctttgactacttctacgcatctgcaattgccatcggcgtctacgttccaggagggccacacatgttcacttatatgcttgcccagaggaagaaggccctttcaaaggcaaagactgcatgaaattgctgaatgctttgcagttggagtatcttctaatgtgacgtctgaatgtgccctccgggctcacgtgtactactcgttttctagcataagttagttagcggggagtgtcattattagacatgaaacccaacatgtactgtaagtctgtaacagtggtgattgttggattttccatggtttatgaatgattgatcaaagatgatcttccatgtttattctctggctgttctagtaaattagcctattgtcttttctgcca

SEQ ID NO: 855 - DNA, 1162 bp, Panicum virgatum
  misc_feature (351)..(351): n is a, c, g, or t
  misc_feature (770)..(770): n is a, c, g, or t
gctcgacccggaaaaatgctacaactcttttcatgattcaacccagaattcctagtttcctcctataagttccattgtctgaatctgaataaccttataagttccattatctgaatctgaatgtccttagagtataacctagtatttgacggcatctgatgcacgcgttcctccgtgtgcaagccaattcaggaccccggtcacagtcacccttcggtgttttcttcctctctgcggctccgggcgttttcttcctcttagcggctccggagatggcgggcgtcggctcggcggtgcggcggatctacctggctgtctacaattggatcgtcttcgccggatgggcgcagntgctgtactacgcgatttggcgctgtggtcgagcggccatgaggctgtctacaacgctgtcgagcggccgctgcagttcgcgcaaacagccgccatcatggagattctgcatggacttgtaggtcttgtgaggtctccggtatctgctactcttccacaaattggatccaggttgttccttacatggggcatcttgtggagtttccctgagacccgtttccacattcttgtaactactctggtcataagctggtcgatcacagagatcattagatactctttttttgggatgaaggaagcacttggatttacaccttcatggctcctatggctgaggtatagcacctttatggtcttgtatcctactggtatctcaagcgaggttggcctgatttggattgccttaccatacataaagncatcggagaaatattgctttaggttgccgaacagatggaatttctcgtatgattactactttacatccattcttgccctcatgatctatattccaggaagcccgcatatgttcacctacatgctctctcagcgcaagaaagctctatcgaaggctaaaactgcataatgctgctaggtgcttcgtaatagaatgcattgtgtgatgtctcaatgtgcctcaacagaagttagtgactggggattgttagaatagaactcttctcatgacttcacggggtgaatttccatgtcgatttgatgccttcgttaatccctcatacgtctgatacaaatgtctgttgttgtacctgaaatgccatgttaattcgatttccttttccccccccctgat

SEQ ID NO: 856 - DNA, 1260 bp, Panicum virgatum
cttcgctcgacccggaaaaatgctacgactcttttcatgattcaacccagaattcctagtttcctcctataagttccattcactgtgttcggctggtggattttgcgctgcttcaggctgcttctgccgcgctgctgccgttcggctggtggctgctggacgcgtggctgctgcttgctgctggacgctagctgctgctcggctgctgctcgctgctgctggctgatgctgctgcatccaccagccgaacggaccccggtcacagtcacccttcggtgttttcttcctctctgcggctccgggcgttttcttcctctctgcggctctgggcgttttgttcctctcggcggctccggagatggcgggcgtcggctcggcggtgcggcggctctacctggctgtctacaattggatcgtcttcgccggatgggcgcaggtgctatactacgcgattttggcgctgttggagagcggccatgaggctgtctacggcgctgtcgagcggccgctgcagttcgctcaaacagccgccatcatggagattctacatggacttgtaggtcttgtgaggtctccaatctctgcaactcttccacaaattggatcaaggttgttccttacatggggcatcttgtggagttttcctgagactcgctctaatattcttgttacttcattggtcataagttggtccattactgagattattagatattctttctttggtacgaaggagacatttggattcgcaccatcgtggctattgtggctaaggtatagcacttttatggtattataccctactggcatctcgagcgaggttggtctaatttttgctgctctacctcatatgatggcatctcagaaatattgtctaaggttgccaaacaaatggaatttctcttacgattacttatatacatctattcttgctctcgcggtttacattccaggaagtccacatatgtttaaatatatgctttcccagcgtaagaaggcattgtcgaagtcaaaaaccgtgtaatgttgctcaatggccttttagaatagcacatgcgtcatctctcgaagtgccccatgagtatttttaaaacttttccagcagaagttagtgaaatggggaatggcactctttacgtgattgcccaaaagtatgttgtaccttaaaatatccgcttttatttggttattaaaattattggcccaaatcgcccagcatggacattgtgacattaccatatgatatatggctacttactg

SEQ ID NO: 857 - DNA, 1062 bp, Triticum aestivum
  misc_feature (952)..(952): n is a, c, g, or t
  misc_feature (963)..(963): n is a, c, g, or t
  misc_feature (1007)..(1007): n is a, c, g, or t
cgccgcgtgctatttcttccatccgcctccgtgttgcagcgggacatcggcggccattatttgatccgcggcaggcgcgtcccagccctgcgccgtcttctagtctagaatggcgggcgtcgggtcggcggtgcggcggctctacctctccgtctacaactgggtcgtcttcgtcggatgggcgcaggtgctctactacgcggtgacggcgctgctggccggcggccatgagggcgtctacgccgccgtcgagcgcccgctgcagctcgcgcagaccgccgccgtcatggagattcttcatgggctcgtagggttggtgaggtctccggtcactgcaactcttccacaaataggatcgaggttgtttcttacatggggcatcctgtggagctttcctgagacacaatctcatattcttgtaacttctttggtcataagctggtccatcaccgagatcattagatattctttcttcggcttgaaggagatgcttggatttgcaccttcttggcttttatggcttaggtatagcacatttctgatattgtatcctatcggtatccttagcgaagttggtctaatctacattgctctgccttatatgaaggtatctgaaaaatactttgttaaaatgcctaacaaatggaatttctccttcgactacttctacacatgtgttatcgccattggtgtctatgttccaggtgggccgcacatgttcacgtacatgcttgcccagaggaagaaggccctgtcaaaggcaaagactgcatgaagttgatgtgagccttatagttggagcatgcaatgcaaaccctgcagtctcatgttgtacgaatagtcggtgtgagttgtcattgttagacatgaattacccggcatgtgttgtaacgatgatgattgttggatttctcatggttgaattaatcattgatcaacctctgcattgagncaatgattatnaccatcagataaaaacaatattcatctttggaagtgctcatccnttatgagccaatggctatatcacatcttaacaaggagaactttgtgaagcaaatg

SEQ ID NO: 858 - DNA, 1151 bp, Triticum aestivum
tgcagcggcaatcactaactgccacgagctgctgctgcccaccactctctcactcgctcgtcctgtccgaacgatccgatccgatctcgtcagattccttccagattcaaaccgattgcggcagagtttgttggccagccgcctcctaatccaactccccgacccgagcaacgccgcgtgctatttcttccttccgcctccgtgttgtagcgggacatcggcggccattatttgatccgcggcaggcgcgtcccagccctgcgccgtcttctagtctagaatggcgggcgtcgggtcggcggtgcggcggctctacctctccgtctacaactgggtcgtcttcgtcggatgggcgcaggtgctctactacgcggtgacggcgctgctggccggcggccatgagggcgtctacgccgccgtcgagcgcccgctgcagctcgcgcagaccgccgccgtcatggagattcttcatgggctcgtagggttggtgaggtctccggtcactgcaactcttccacaaataggatcgaggttgtttcttacatggggcatcctgtggagctttcctgagacacaatctcatattcttgtaacttctttggtcataagctggtccatcaccgagatcattagatattctttcttcggcttgaaggagatgcttggatttgcaccttcttggcttttatggcttaggtatagcacatttctgatattgtatcctatcggtatccttagcgaagttggtctaatctacattgctctgccttatatgaaggtatctgaaaaatactttgttaaaatgcctaacaaatggaatttctccttcgactacttctacacatgtgttatcgccattggtgtctatgttccaggtgggccgcacatgttcacgtacatgcttgcccagaggaagaaggccctgtcaaaggcaaagactgcatgaagttgatgtgagccttatagttggagcatgcaatgcaaaccctgcagtctcatgttgtacgaatagtcggtgtgagttgtcattgttagacatgaattacccggcatgtgttgtaacgatgatgattgttggatttctcatggttgaattaatcattgatcaacctctgcattgagacaatgattatgaccatcagataaaaaca

SEQ ID NO: 859 - DNA, 1344 bp, Triticum aestivum
tgcagcggcaatcactaactgccacgagctgctgctgcccaccactctctcactcgctcgtcctgtccgaacgatccgatccgatctcgtcagattccttccagattcaaaccgattgcggcagagtttgttggccagccgcctcctaatccaactccccgacccgagcaacgccgcgtgctatttcttccttccgcctccgtgttgtagcgggacatcggcggccattatttgatccgctgcaggcgcatccagagccctgcggcgtcttctagtctagaatggccggcgtcgggtcggcggtgcggcggctctacctctccgtctacaactgggtcgtcttcgtcggatgggcgcaggtgctctactacgcggtcacggcgctgctggacggcggccatgagggcgtctatgccgccgtcgagcgcccgctgcagctcgcgcagaccgccgccgtcatggagattcttcatgggcttgtagggttggtgaggtctccggtcactgcaacccttccacaaataggatcgaggttgtttcttacatggggcatcctgtggagctttccggagacacaatctcatattcttgtaacttctttggtcatcagctggtccatcaccgagatcattagatattctttcttcggcttgaaggagacacttggatttgcaccttcctggcttttatggctcaggtatagcacatttatgatattgtatcctaccggcatccttagcgaggtcggtttgatttacattgctctgccttacatcaaggtatccgagaaatactttgttaagatgcctaacaaatggaatttctcctttgactacttttacacatgtgctatcgccatcggtgtctatgttccaggtgggccgcacatgttcacatacatgcttgcccagaggaagaaggccctgtcaaaggcaaagactgcatgaagttgctgtgagccttgtagatggggcatgcaatgcaaaccctactacagtgtcatgttgtagagtagttggtgtgagatcggtaattctattcggtgaattacccgacctgtgttgtaacaatgatgattgttggatttcccatggtggaatccatcattgatcaaactctgcattgagccaatgattatgaccaaagaagtggcataatcctatcagataaaagcaatattcatcttcggaagtgctcgtccattatgagccaatgactagatgtcaacttgacaaggaaaacttttgtggagcagatggtacactggttatttcacaggacaagtgttgtctctattctagtatatgtgcatatgtacaatcttgttacaagatccttaacatt

SEQ ID NO: 860 - DNA, 1029 bp, Pseudoroegneria spicata
  misc_feature (108)..(108): n is a, c, g, or t
  misc_feature (227)..(227): n is a, c, g, or t
  misc_feature (389)..(389): n is a, c, g, or t
  misc_feature (584)..(584): n is a, c, g, or t
  misc_feature (849)..(849): n is a, c, g, or t
  misc_feature (920)..(921): n is a, c, g, or t
tggacatcggcggccattatttgatccgctgcaggcgcatcccagccctgcgccgtcttctatctagagaataagaataaatggccggcgtcgggtcggcggtgcggnggctctacctctccgtctacaactgggtcgtcttctacggatgggcgcaggtgctctactacgcggtcacggcgctgctgggcggcggccatgagggcgtctacgccgccgtcgagcgnccgctgcagctcgcgcagaccgccgccgtcatggagattcttcatgggcttgtagggttggtgaggtctccggtctctgcaacccttccacaaataggatcgaggttgtttcttacatggggcatcttgtggagctttcctgagacacaaactcatattctngtaacttctttggtcataagctggtccatcaccgagatcatcagatactctttcttcggtttgaaggagacacttggatttgcaccttcctggcttttatggcttaggtatagcacatttctgatattgtatcctaccggtatccttagtgaggtcggtctgatctacattgctctgccttacattaaggtatcngagaaatactttgttaagatgcctaacaaatggaatttttcctttgactacttctacacatgtgttatcgccatcggtgtctatgttccaggtgggccgcacatgttcacttatatgcttgcccagaggaagaaggccctgtcaaaggcaaagactgcatgaagttgctgtgagccttgtagctggagcatgcaatgcaaaccctacagcctcatgttgtacgaatagctggtgtgagttgtcattgttagacatgaattacccnacatgtgttgtaacaatgatgattgttggatttctcatggttgaattaatcattgatcaacctctgcatcnngccaatgattatgaccatcagataagaacaatattcatctttggaagtgctcattcattatgagccaatggctagatctcaacttaacaaggaaaactttgtggagca

SEQ ID NO: 861 - DNA, 872 bp, Triticum aestivum
cgcatcccagccctgcggcgtctgcggcctagagaacaaataaatggccggcgtcgggtcggcggtgcggcggctctacctcgccgtctacaactgggtcgtcttcgtcggatgggcgcaggtgctctactacgcggtgacggcgctgctgggcggcggccatgagggcgtctacgccgccgtcgagcgcccgctgcaactcgcgcagaccgccgccgtcatggagattcttcatgggcttgtagggttggtaaggtctcctgtcgctgcaacccttccacaaataggatcaaggttgtttcttacatggggcatcttgtggagctttcctgagacacaatctcatattcttgtaacttctttggtcataagctggtccatcacggagatcatcagatattccttctttggcctgaaggagacgcttgggtttgcaccttcctggcttttatggctcaggtatagcacatttctgatattgtatcctaccggtatccttagcgaggtcggtctgatctacattgctcttccttacattaaggtatccgagaaataccttgttaagatgcctaacaaatggaatttctcctttgactacttttacacatgtgctatcgccatcggtgtctatgttccaggtgggccgcacatgttcacgtatatgcttgcccagaggaagaaggccctgtcaaaggcaaagactacatgaagttgctgtgagccttgtagctggagcatgcaatgcaaactctccagtctcatgttgtacgaatagctggtgtgagttgtcattgttagacatgaattactcgacatgtgttgtaacaatgatgattgttggatttctcatggttgaattaatcattgatcaa

SEQ ID NO: 862 - DNA, 1222 bp, Triticum aestivum
gctcactcgctcgtcgtgtccgaacgatccgatctcgccagattccgtccggattcaaaccgatcgcgtgtcgatcccggcagagtttgttggccagccgcctcctaatccaactcccgatccgcgtgctatttcttccttccgcctccgtgttgcagcgggacacatcggcggccattatttgatccgcctcgctgcagccgcatcccagccctgcggcgtctgcggcctagagaacaaataaatggccggcgtcgggtcggcggtgcggcggctctacctcgccgtctacaactgggtcgtcttcgtcggatgggcgcaggtgctctactacgcggtgacggcgctgctgggcggcggccatgagggcgtctacgccgccgtcgagcgcccgctgcaactcgcgcagaccgccgccgtcatggagattcttcatgggcttgtagggttggtaaggtctcctgtcgctgcaacccttccacaaataggatcaaggttgtttcttacatggggcatcttgtggagctttcctgagacacaatctcatattcttgtaacttctttggtcataagctggtccatcacggagatcatcagatattccttctttggcctgaaggagacgcttgggtttgcaccttcctggcttttatggctcaggtatagcacatttctgatattgtatcctaccggtatccttagcgaggtcggtctgatctacattgctcttccttacattaaggtatccgagaaataccttgttaagatgcctaacaaatggaatttctcctttgactacttttacacatgtgctatcgccatcggtgtctatgttccaggtgggccgcacatgttcacgtatatgcttgcccagaggaagaaggccctgtcaaaggcaaagactacatgaagttgctgtgagccttgtagctggagcatgcaatgcaaactctccagtctcatgttgtacgaatagctggtgtgagttgtcattgttagacatgaattactcgacatgtgttgtaacaatgatgattgttggatttctcatggttgaattaatcattgatcaacctctgcattgagccaatgattataaccatcagataaaaacaatattcatctttggaagtgctcatccgttatgagccaatggctatatcacatcttaacaaggagaactttgtgaagcaaatggtacctgcccgggcggccgctcgaa

SEQ ID NO: 863 - DNA, 987 bp, Hordeum vulgare
gcgggacaccggcggccattatttgatccgccgcagacgcatcccatccccccgtgacccccggcgactttcttcttcttcctcctcgtgctgctccggagagaataaataaacaaatggccggcgtcgggtcggcggtgcggcggctctacctctccgcctacaactgggtcgtcttctacggatgggcgcaggtgctctactatgcgatcacggcgctactgggggacggccacgagggcgtctacgccgccgtcgagcgcccgctgcagctcgctcagaccgccgccgtcatggagattcttcatgggcttgtagggttggtgaggtctccagtcactgcaacccttccacagataggatcaagattgtttcttacatggggcatcttgtggagctttcccgagacacagtcgcatattctcgtatcttcgttggtcataagctggtctatcactgagatcattagatattctttcttcggcttgaaggagacgcttggattcgcaccttcctggcttttgtggcttaggtatagtacatttatgatattgtatcctaccggtatctttagtgaggtcagtctgatctacatcgctctgccttacatgaaggtatccgagaggtactttcttaagatgcctaacaagtggaatttttcctttgactacttttacacatgtgttatcgccataggtgtctatattccaggtgggccacacatgttcacgtacatgcttgcccagaggaagaaggcactgtcaaaggcaaagactgcatgagatttgttggtagtcttgtacctggagcatgcaatgcacaccatacaatctcatgctgtacaagagtagttggtgtgaactgaattactcggcatgtgttgtaacaacgatgattgtctgatctcccacggttgaattgatcattgatcaaactctgcattgagccaatgattatggccatcggataaaaacaatattcatcttt

SEQ ID NO: 864 - DNA, 951 bp, Eragrostis curvula
  misc_feature (735)..(735): n is a, c, g, or t
  misc_feature (951)..(951): n is a, c, g, or t
aaggcagcaaagagggcgtgcatgtattcaccgcgccttatctgatggtgctgtcctagtcccggacccggtcagagcatctctctctcgtcgccagtgttcgtcctcccagcagctcagcgatggcgggcttcggttccgcggtgcggcgactctacctctccgtctacaactgggtcgtcttctacggatgggcgcaggtgctgtactacgcggtcatggcactgcaggagagcgggcatgaggccgtctacgccgccgtcgagcggccgctgcagttcgcgcagactgccgccatcatggagattcttcatgggattgtaggcttggtgaggtctccgatctcggcaactcttccacaaattggatcaagattgtttcttacgtggggcgtcttatggagttttcctgagacacaatctcacattcttgttacttccttggtcataagctggtccatcactgagattattagatattctttcttcggaatgaaggaggcactaggatttgcaccttcctggctcttatggcttaggtacagcacctttttgctactgtatcctactggtatcactagtgaggtcggcctaatctacattgccctgcctttcatgaaggcatctgagagatactgccttcggatgcccaacaaatggaatttctccttcgactacatgtatgggtctattcttgccctcgccatctacgtaccaggaaggcctcacatgtacnactaaatgcttaagcaacggaagaaggccttgtccaagggcaaaaacagaataattcagatacaagagtttcataaaagcagataattgcacatagaagcggaaaataatgtaagagatactaacggaaaagttagtgattggaatgtacagcaaatattgctgaattgcgaatatgagaacagggaaatattgagaataaaagacggaacatttn

SEQ ID NO: 865 - DNA, 2216 bp, Zea mays
ccatctccgactccctcttacccttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtggttgagagtggtgctgtgcccatctttgttaagctcctcaactccaatagcgaggatgttcgtgaacaggctgtatgggctttaggtaatgttgctggtgactccccaaagtgccgtgatctggtgctaggccatggtgggctattccccttgctgcaacagcttaatgagcatgctaagctctcgatgctgaggaatgccacatggacactatcaaacttctgccgtgggaagccacaaccgaactttgatcaggtcaaaccagcattgccagcacttcagcaacttatccactctcaggatgaggaggtcctaactgatgcctgttgggctctatcatacctatctgatgggactaatgacaaaatccaagctgttattgaatctggcgtgttccctcgccttgtggaacttctgatgcatccttcagcctctgtactgattccagctctgcgcacggtgggtaacatcgtaactggggacgacatgcagactcagtgtgtcattgacaatcaagcacttccatgccttttgaacctactgaccaccaaccacaagaaaagcatcaagaaagaagcatgctggacaatctcaaacatcacagctggtaacagggaacagattcaggccgtgattaatgcaaacataattgcacctctggtgcaacttctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaattgtaacagtttgcttggagggtcttgagaacatcctgaaagttggcgaggcagagaaaaatcttggtgcaggcgatgtcaatgtttacgcacagatgattgatgatgctgagggcctggacaagattgagaacctacagagccatgacaacactgagatatatgagaaggctgtcaagatgctcgaatcttactggctagaggaggaagatgatgccatgccctctggcgacaatccccagaatggcttcaactttgggaaccagccctctgttccatcaggtggattcaacttcggctgaagatgcccatttggaatggcggctgtgccattgtgccttggcctagtggttggggctagtcagagttggggtagtggcgtcgtcctccaaaaccttggttcggtcccattggtctggtctcaggtgtttgtcatgtcagtcccagtcagcagggtcagtccttgtgctgcatcaccagtggtgctgcatggaagtggtcagtcttcaaggtcagccggttggatcatttgggctcttgctcccaccgcctctggtggtaggcatgaagtcgcaggtgttgtcgggagttgggttttgcctccaatatagcatgaatgaattatattgttttacctatttgatgaggtagaagaaaagaaccttggaagatagggaatgtgttggtttttgtcaaagcggttcctgtcctgtatgacatgttgcatgagtattgacacaaattataagacataatggcaaataggtttttgggagtc

SEQ ID NO: 866 - DNA, 2584 bp, Sorghum bicolor
ccctcttcccccacccgttccccaattcgaaatcgaatcgggtcggtcttgccgtgcgtgcgtgcgtggctgcgcgaacgactcgactgcacaccccccaccccgctcctccctcccgccgccgccgggtcttcccccctagggtttcgccgcgatgtcgctccggccgagcgagcgggagcagatgcggaagggcaactacaagcagacggtggacgcggaggagagccgccgccgccgggagggccagatggtggacatccgcaaggccaagcgcgaggagagcctccagaagaagcgccgcgacggcttcccggcctccgccgccggcgccgtcccgcccatgggacactccaccgcgctccagcagaagctcgatggcttgcccgctatggtgcaggccgtcctctccaacgaccccaccgtgcagcttgacgccaccacgcagttcaggaagctgctctccatagagcgtagtcccccaattgaggaggtgatcagcacaggagtggtccctcgattcatcgagttccttacacgcgaggaccatccccaactccagtttgaggctgcgtgggcactcaccaacattgcctccggcacatcagagaataccaaggtggtggttgagagtggtgctgtgcccatctttgtcaagctcctcaactcccacagcgaggatgttcgtgaacaggctgtgtgggctttaggtaatgttgctggtgactccccaaagtgccgtgatctggtgcttggtcatggtgggcttttccccttgctgcagcagcttaatgagcatgctaagctctcgatgctcaggaatgccacatggactctctccaacttttgccgtgggaagccacaaccaaactttgatcaggtcaaaccagcattgccagcactgcagcgccttatccactctcaggatgaggaggtcctaactgatgcctgctgggctctctcatacctatctgatgggactaatgacaaaatccaagctgtcattgaatctggcgtgttcccacgccttgtggaacttctgatgcatccttcggcctctgtactcattcctgctctgcgcacggtgggtaacattgtaactggggatgacatgcagactcagtgtgtcattgacaatcaagcacttccatgccttttgaacctcctgactaccaaccacaagaaaagcatcaagaaagaagcatgctggacaatctcaaacatcacagctggtaacagggaacaaattcaggccgtgatcaatgcaaacataattgcacctctggtgcaacttctgcaaactgctgaatttgacatcaagaaagaagcagcctgggcaatttcaaatgccacttctgggggcacacatgatcagatcaagtaccttgttgcccaggggtgcattaagccactctgtgacctgcttgtctgcccagatcctagaattgtaacagtttgcttggagggtcttgagaacatcctgaaggttggcgaggcagagaaaaaccttggtggaggcgatgtcaatgtctatgcacagatgattgatgatgctgagggccttgacaagatcgagaacctgcagagccatgacaacactgagatatatgagaaggctgtcaagatgctcgaatcctactggctggaggaggaagatgatgccatgccctcaggcgacaatccccagaatggcttcaactttgggaaccagccctctgttccatcaggtggattcaactttggctgaagatgcccatttggaatggcggctgtgccattatgccttggctagtgcttggggctagtcagaggtggggtagtcgcgtcgtccaagtcgtggttgggtcccattggtctggtctcagggagtcggtcaagtcagtcccagtcagcaacagggtcagtcctagggctgcatcaccagtggtgcagcttggtcagtggtcagtcttcaaggtcagcgggttggatcatttgggctctttgctcccaccaccacctaatggtgggaggcatggagtcgcaggtgttgtcgggagtttgggttttgcctcctcctatatagcatgaatggattatattgtttttacctgtttgatgaggtagaaagaaccttgaaagatagggaatgtgtcggtttttgtcaaagcggttcctgtgctgtataacatgttgcaatgagtattggcacaacttataagacataatgtcaaatgggtttttttggagtccccattctggtctctcgagtctaatttcattggtttattattgtgtattaattatacacaggttttgtggttggttggtcatgtcttgtctgttgtagtcacttgtcttgtttccttgcttttgtatttgccaccgttgtctgaaagttgttccatgcttatctagaacaatagaaatagaaggccagggggtatttgtgagacattttttatatgaggttatcagtatatggttcctagttttatggtggaacctgatttatcgttgtatggccatgataaaaccattgagaattatggtgtagcaactgaatggaatgaaatcaaagaagaaattccgtgcatgttggctc

SEQ ID NO: 867 - DNA, 2510 bp, Saccharum officinarum
cccgttccccaattcgaaatcgaatcgggtcggtctcgccgtgcgtgcgtgcgtggctgcgcgaacgactctcgactgcacacccccccgctccgcgccgccgccgggtcccccctagggtttcgccgcgatgtcgctccggccgagcgagcgggagcagatgcggaagggcaactacaagcagacggtggacgccgaggagagccgccgccgccgcgagggccagatggtggacatccgcaaggccaagcgcgaggagagcctccagaagaagcgccgcgacggcttccccgcctccgccgccggcgccgccccgcccatgggccactccaccgcgctccagcagaagctcgatggcttgccggcgatggtgcaggccgtcctctccaacgaccccgccgtgcagcttgaggccaccacgcagttcaggaagctgctctccatagagcgtagtccaccaattgaggaggtgatcagcacaggagtggtgccccgatttattgagttccttacacgtgaggaccatccccaactccagtttgaggctgcatgggctctcaccaacattgcctcaggaacatcagagaacaccaaggtggtggttgagagtggtgctgtgcccatctttgtcaagctcctcaactcccacagcgaggatgttcgtgaacaggctgtgtgggctttaggtaatgttgctggtgactccccaaagtgccgtgatctggtgcttggccatggtgggctattccccttgctgcagcagcttaatgagcatgctaagctctcgatgctcaggaatgccacatggactctctccaacttctgccgtgggaagccacaaccaaactttgatcaggtcaaaccagcattgccagcactgcagcgccttatccactctcaggatgaggaggtcttaactgatgcctgctgggctctctcatacctatctgatgggactaatgacaaaatccaagctgttattgaatctggcgtgttccctcgccttgtggaacttctgatgcatccttcggcctctgtactcattcctgctctgcgcacggtgggtaacattgtaactggggatgacatgcagactcagtgtgtcattgacaatcaagcacttccatgccttttgaacctcctgactacaaaccacaagaaaagcatcaagaaagaagcatgctggacgatctcaaacatcacagctggtaacagggaacagattcaggccgtgatcaatgctaacataattgcacctctggtgcaacttctgcaaactgctgaatttgacatcaagaaagaagcagcgtgggcaatttcaaatgccacttctggtggcacacatgatcagatcaagtaccttgttgcccaggggtgcattaagccactctgtgacctgcttgtctgcccagatcccagaattgtaacagtttgcttggagggtcttgagaatatcctgaaggttggtgaggcagagaaaaaccttggtggaggcgatgtcaatgtctacgcacagatgattgatgatgctgagggccttgacaagattgagaacctgcagagccatgacaacaccgagatatatgagaaggctgtcaagatgctcgaatcctactggctggaggaggaagatgatgccatgccctcaggcgacaatccccagaatggcttcaactttgggaaccagccctctgttccatcaggtggattcaactttggctgaagatgcccatttggaatggcgactgtgccattatgccttggctagtgcttggggctagtcagaggtggggtagtcgcgtcgtccaagtcgtggttgggtcccattggtctggtctcagggagtcgtcatgtcagtcccagtcagcagcaggtcagtccttgggctgcatcaccagtggtgcagcttggtcagtggtcagtcttcaaggtcagcgggttggatcctttgggcacttgctcccaccaccacctaatggtgggaggcatggagtcgcaggtgttgtcgggagttgggttttgcctcctatatagcatgaatgaattatattgttttacctgtttgatgaggtagaaagaaccttgaaagatagggaatgtgtgtcggtttttgtcaaagtggttcctgtgctgtataacatgttgcaatgagtattggcacaacttataagacataatgtcaaatgggattttgggagtccgattctggtctgagtctaattcattggtttattgtgtattatacacaggtttgtggttctgtcatgtcgtcttgtctgttctagtcacttgtcgtgtctccttgcctgtgtatttgccactgtttgaaagttccatgcttatcaagtacagtagaaggccaggggtatgtgtgacatttttatgaggttattattatatggttcctagttttatggtggaacctgatctatcgttgtatgaccatgacaaaccattggaatttggtgtagcaactgaatggaatgaaatcaaagaatgaatttccgtgc

SEQ ID NO: 868 - DNA, 2404 bp, Setaria italica
cggccgagcgagcgggagcagatgcggaaggggaactacaagcagtcggtggacgcggaggagagccgccgccgccgcgagggccagatggtggacatccgcaaggccaagcgcgaggagagcctccagaagaggcgccacgtcgggttcgccgcctccgccactggcgccgtgccgccgatgggccactcatccgcgctccagcagaagctcgacggcttgccggcgttggtccaggcggtgctctccaacgagcccaacgtgcagctggaggccaccacgcagttcaggaagctgctctccatcgagcgtagtcctccaattgaggaggtgatcagcacaggagtagtgcctcgatttattgagttcctcacacgtgaggaccatccccaactccagtttgaggctgcgtgggcgctgaccaacattgcatcaggcacatcagagaacaccaaggtggttgttgagagtggtgctgtgcccatctttgtcaagctcctcaactcccacagcgaggatgtccgtgagcaggctgtatgggctctagggaatgttgctggtgactccccaaagtgccgcgatctcgtgcttggccacggtggactattccctttgctgcagcagcttaatgagcatgctaaactctcgatgctcaggaatgccacatggactctatccaacttctgccgtgggaagccgcaaccgaactttgatcaggtcaaaccagctctatcagcactgcagcgtctcatccactctcaggatgaggaggtcctaactgatgcctgctgggctctctcctacctatctgatggtactaatgacaagatccaggctgtgattgaatctggcgtgttccctcgccttgtggaacttctgatgcacccttcggcctcagtactcattccagctctgcgcacagtgggcaacattgtaaccggggatgatttacagactcagtgtgtcattgatcaccaagcgcttccatgccttttgaacctcttgactacaaaccacaagaaaagcatcaagaaagaagcatgctggaccatctcaaacatcacagctggtaacagggaacagattcaggctgtgatcaatgcgaacataattgcacctctggtgcatcttctgcaaactgctgaatttgacatcaagaaagaggcagcctgggcaatatcaaatgccacttctggtggtacaaatgaccagattaagtaccttgttggccagggttgcatcaagccactctgtgatctgctcgtttgcccagaccccagaattgtgacagtttgcttggaaggtcttgagaacatcttgaaggttggggaagcagagaagaaccttggggcaggtgatgtcaacgtgtatgcacagttgattgatgatgctgagggcctggacaaaattgagaaccttcagagccatgacaacactgagatatacgagaaggctgtcaagatgcttgagtcctactggttggaggaggaagatgatgccatgccctcaggggacaaccctcagaatggcttcaacttcgggaaccagccctcagttccatcgggtggattcaactttggctgaagatgcccatttggaatgtcgactgtgccattgtaccttgtctggggctagtcagaggtacagttggggtagtcgtgtcgtccaagtcatggtatggtcccattggtctggtatcagggagtcgtcaaagtcagtcccagtcagcagggtcggtcctcgggctgcattgccagtagtgcagcttggtcagtggtcagtccagccggttggatcatttgggctctggcacccaccaccacctgtggtgggagcatggagagtcgcaggtgttgtcgggagttgggttttgcctcctatatagcatgaatgagttatattgttttacctgtttgaggtagaaagaaccttaaaagatagggaatgtgtcggttttttctcaaagcgttcctgtgctgtataacttgttgcattagtattggcacaacttataaaacatgaatgtcaagtgggttttgggagtcccatgcactcttgagagtctattcattggtttattcgatgttccacaggttcttgtatggtccacacaggttcgtcgtgtcgtgttgtctttctgtagccactgttgtctgaaagtttctcatttctgtctagggtagtagaacccttgtcatgtcgtctgcaagttctctggctctgggtaatctgtgtgacatctatgtgaggtggttcctagttttatggtggaacccgattttattgttgtatgatgacatgaacctctggaactttgtagcaatgaaaggaaggagataaaagggaagcttagtccatacatggtgctgatgttttgccattacaatatactttgggtttacgt

SEQ ID NO: 869 - DNA, 2490 bp, Pennisetum glaucum
gtgcgcgagcgagcgagcgactcgcccacacaactcccacccccgctcctcctgacctcacccgccgccgccgccacagcctccctccctctctagggtttcgccgcgatgtctctccggccgagcgagcgggagcagatgcggaaggggaactacaagcagtcggtggacgcggaggagagccgccgccgccgagagggccagatggtggacatccgcaaggccaagcgcgaggagagcctccagaagaggcgccacgtcgggttcgccggcgccgtcccgccgacgagccactcgtccgcgctccagcagaagctcgacggcttgcccgcgttggtgcaggcggtgctctccaacgagcccaacgtgcagctggaggccaccacgcagttcaggaagctgctctccatagaacgtagtcctccaattgaggaggttatcagcacaggagtagtacctcgatttattgagttcctcacacgtgaggaccatccccaactccagtttgaggctgcatgggcgcttaccaacattgcatcaggcacatcagagaacaccaaggtggttgttgagagtggtgctgtgcccatctttgtccagctcctcaactcccacagtgaggacgtccgtgagcaggctgtgtgggctctagggaatgttgctggtgactccccaaagtgccgtgatcttgtgcttagccacggtgggctattccctttgctgcagcagcttaacgagcatgctaaactctcaatgctcaggaatgccacatggactctatccaacttttgtcgtgggaagccgcaacctaactttgatcaggtcaaaccagctctgtcagcactgcagcgtctcatccactctcaggatgaggaggtcctaactgatgcctgctgggctctctcctacctatctgatggtactaatgacaagatccaggctgtgattgaatctggtgtgttccctcgccttgtggaacttctgatgcacccttcggcctcagttctcattccagctctgcgcacagtgggcaacattgtaactggggatgatttgcagactcagtgtgtcattgatcaccaagcgcttccatgccttttgaatcttttgactacaaaccacaaaaaaagcatcaagaaagaagcatgctggacaatctcaaacatcacagctggtaacagggagcaaattcaggctgtcatcgatgcgaacataattgcacctctggtgcatcttctgcaaacagctgaatttgacattaagaaagaggcagcctgggcaatttcaaatgccacttctggtggtacaaatgaccagattaagtaccttgttgcccagggttgcatcaagccactctgtgatctgcttgtttgcccagaccccagaattgtgacagtttgcttggaaggtcttgagaacatcttgaaggttggggaagcagagaagaaccttgggggaggtgatgtcaacgtgtacgcacagttggttgatgatgctgagggcctggacaagattgagaaccttcagagccacgacaacagtgagatatacgagaaggctgtcaagatgcttgagacctactggttggaggaggaagatgatgcaatgccctcaggtgacaaccctcagaatggcttcaacttcgggaaccagccctcagttccatcgggtggattcaactttggctgaagatgcccatctggaatgtcgactgtgctgccattgtaccttgtttgggggctagtcaagaggtacagttggggtagtcgtggtcgtccaagtcattggtctggtcccattggtctggtctcagggagtcagtcaaagtcagtcccagtcatcagggtcgggtcctcgggctgcatcgccagtggtgcagcttggtcagtcttcaaggtcagccggttggatcatttgggctctagcacccaccaccacctgtggtgggagcatggagagtcgcaggtgttgtcgggagtcgggttttgcctcctatatagcatgaatgagttatattgttttacctgtttgaggtggaaagaaccttgaaagatggggaatgtgtggggttttcctcaaagtgttcctgtgctgtataacttgttgcattagtattggcacaacttataaaacatgaatgtcaagtgggttttgggagtcccatgcactcttgagagtcagtctattcattggtttattctatgttccacaggttcttgtatggtccgcacagatttactgtgttgttgtctttctttagccactgttgtctgcaagtttcccaatttctgtctagggtagtagaatccttgtcatgtcttctgaaagtagtctgtgtgacatttgtgtgaggtactgaggtggttcctagttttatggtggaacctgttttattgttgtataatcacaagaacctctggaactttgtagcaaatgaaaagaaggttataaaaaaggaaagcctagtccatacatggtgctagtgttttg

SEQ ID NO: 870 - DNA, 2273 bp, Panicum virgatum
cagatggtgggcatccgcaaggccaagcgcgaggagagcctccagaagaggcgccacgtcgggttccccgcctccgctgccggcgccgtgccggcgggacactcctcggcgctccagcagaagctcgatggattgccggcgttggtgcaggcggtgctctccaacgaccccaacgtgcagctggaggccaccacgcagttcaggaagctgctctccatcgagcgtagtcctccaattgaagaggttatcagcacaggagtggtgcctcggtttattgagttcctcacacgtgaggaccatccccaactccagtttgaggctgcttgggcactcaccaacattgcatctggcacatcagagaacaccaaggtggtggttgagagtggtgctgtgcccatctttgtcaagctcctcaactcccacagcgaggatgtccgcgagcaggctgtatgggctctagggaatgttgctggtgactccccaaaatgccgtgatctcgtgcttggccacggtgggttattccctttgctgcagcagcttaatgagcatgccaaactctcaatgctcaggaatgccacatggactctatccaacttctgccgtgggaagccacaaccaaacttcgatcaggtcaaaccagctctgtcagcactgcagcgtctcatccactctcaggatgaggaggtcctaactgatgcctgctgggctctctcatacctctctgatggaactaatgacaagatccaagctgtgatcgaatctggcgtgttcccacgccttgtagaacttctaatgcacccttcggcctcagtgctcattccagctctgcgcaccgtgggcaacattgtaactggggatgatttgcagactcagtgtgtcatcgatcaccaagcgcttccatgccttttgaacctcttgactaccaaccacaagaaaagcatcaagaaagaagcatgctggaccatctcaaacatcacagctggtaacaaggaacagattcaggctgtgatcaatgcgaacataattgcacctctggtgcatcttctgcaaactgctgaatttgacatcaagaaagaggctgcctgggcaatttcaaatgccacttctggtggcacacatgatcagattaagtaccttgttggccagggttgcatcaagccactctgtgatctgctcgtttgcccagaccccagaattgtcacagtttgcctggaaggtcttgagaacatcttgaaggttggggaagcagagaagaatcttggggcaggtgatgtgaatgtgtatgcacagatgattgatgatgctgagggcctggacaagattgagaaccttcagagccatgacaacactgagatatatgagaaggcagtcaagatgctcgaatcctactggttggaggaggaagatgatgccatgccctcaggcgaaaatcctcagaatggcttcaacttcgggaaccagccttctgttccatcgggtggattcaactttggctgaagatccccatttggaatggcgactgccattgtaccttggctggggctagtcggaggtgcggtttggggtagtcgtgttgtccaagtcatggtatggtcccattggtctggtctcagggagtcgtcgaagtcagtcccagtcaacagggtcagtccgcgggctgcatcaccagtggtgcagcttggtcagtggtcagtcttcaaggtcagccggttggatcatttgggctctggctcccaccaccacctgtggtggggagcatggagagtcgcaggtgttgtcgggagtcgggttttgcctcctatatagcatgaatgagttatattgttttacctgtttgaggtagaaagaaccttgaaagatagggaatgtgtcaagttttttctcaaagcgttcctgtgctgtataacttgttgcatgagtattggcacaacttataaaacatgaatgtcaactgggttttgggagtcccactctggtctctcgagtctattcattggtttattgtatgttccacaggttcatgtatggtccacaggtttgtcgtgtcatgttgtctttgtgtagtcagagttgtctgaaagtttttccatgctcgtctaggatagtaggatccgtgtcatgtcatcaggaaggttctggttcgagtaatctgtgacattggttccaagttttatggcggaatctgtttatctttactgttgtattatgatgacatgaaccttcagactttttgtagcaaatgaatggaagaagataaaaggggagcttagtcc

SEQ ID NO: 871 - DNA, 2632 bp, Oryza sativa
cccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacgatgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaagttggaggggttgccggcgatggtgcaggcggtgcagtccgacgacagcgccgtgcagctggaggccaccacgcagttccggaagctgctctccatcgagcggagtcctccaattgaggaggtgatcaacacaggggtggtgcctcgctttattgccttcctccaacgtgaggattatccccaactccagtttgaggctgcatgggcactcactaacattgcatcaggcacatcagataacaccaaagtggtagttgagtctggtgctgtgcccatctttgtcaaactgcttagctcccccagtgaggatgtccgtgagcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgcatccttcggcttcagtgctcattccagctttgcgcacggtgggtaacatcgtcactggggatgacatgcagactcagtgtgtcatcgatcatcaagctcttccatgtctcttgaacctcttgaccaacaatcataagaaaagcatcaagaaagaagcatgctggactatctcaaacatcactgctggcaatagggaacagattcaggctgtgatcaatgcaaacataattgctcctctagtacatctgctgcaaactgctgaatttgacatcaagaaagaggctgcgtgggcaatctcaaatgccacttctggtggaacacatgatcagattaagtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctgaagatacctatctggaatgatgtaccactgttccttagctacttgcttggggctagtcagagttgggggagtcttgtcgttggagtcttggttgggtcctggcggtctggtctcaggcagtcgtaatgtcagtcccagtccttgggcttgcatcatcgccagtggtgcagcttggtcagtggtcagtcttgaaggtcatccagttggatttacttgggctctgtctcacctgtggtgggagcatgggggagagggcgtccagagccgcaggtgttgtcgggagagagttaccagttggcttttgcctcctatatagcatgaatgaattatattatcatctgttttgaggtaaaaagaaccttgaaagatagggtttattcatggttgtgtcagtttttgtcaagtctctatgtgctgtattaacatgtcagaagagtattggcacaacttataaacatcaaatagcaactgggtttttggtggagtcccatgctggtctgtctattcattggtttgttgttgtaatgtttttaatgtcatggttttgtcgcgtcaaagtttgtcggtggttgtttgcgtacttgctgttgttgttgtcgttgtcgttttgagattcatgttgttatgtctgtcttctgtctagaaaactgaaaactcaggagaaccgcctagggaaaaagaccgcctattttggcgatgagttttggttgagttcttggtgtcatgtgtggagtgtaaaagggaagatgatggttcctagttttaccccctggaacccggtttatgattgtatgattattacgttatgaaccatatgcacatgataaaaggaagagaagggagctgtcccacttcatatttccctat

SEQ ID NO: 872 - DNA, 2233 bp, Brachypodium distachyon
ctccccgttccccaattcgaatcgagccgcaccgaatcgaatcgcgtgggggggcgacttgcccgcacgcacacaacacccactctccgaaccgccgccgccgccttctagggtttcggcttcccgagggggcccccagcccgccgacgatgtcgctgcggccgagcgagcgggcggaggtgcggcgcgggcgctacaaggcgtccgtggacgcggaggagggccggcgcaggcgcgaggaccagatggtggagatccggaagaaccgccgcgaggacttcctcctcaagaagcgccgcgaggggctcccgtcctccgctgcccccggcggggcctcgcagatgggccactcctccgcgctccagcagaagctggagggcttgccggccatggtgcaggccgtgctctcggacgacagcgccgtgcagctcgaggccaccacgcagttccggaagctgctctccatcgagcggagtcctccaatcgaggaggtgattaacacaggtgtggtgccacgcttcattgaattcctcaagcgcgaggattatccccaactccagtttgaggctgcatgggcactcaccaacattgcgtcaggcacatcagaaaacaccaaggtggtggttgagtatggtgctgtgcccatctttgtcacgctcctcagctcaccgagtgaggatgtccgcgagcaggctgtatgggccctggggaatgttgctggtgactctccaaagtgccgtgaccttgtgcttggaagtggtggactattcccattgttgcagcaactgaacgagcatgccaagctctcgatgctcaggaacgccacgtggacactctccaacttctgccgtggaaaaccgcagccaaactttgagcaggtcaaaccagctctctcagcgctgcagcgcctcattcactctcaggatgaggaggtcctcactgatgcctgctgggctctctcatacttgtctgatggaactaatgataagatccaatctgtgattgaatctggtgtgttccctaggcttgtggagcttctcatgcatccgtcggcttcggtgctcattccagctctgcgcacggtgggtaacattgtcactggtgatgatttgcagactcagtgtgtcattgatcatcaagcgcttccctgtctcttgaacctcttgactaccaatcacaagaaaagcatcaagaaagaagcatgctggactatctcaaacatcacagctggtaaccgggaccagattcaggctgttatcaatgcaaacataatcggacctctggtgcatcttctgcaaggtgctgagtttgacatcaagaaagaggcggcttgggcgatttcaaatgccacttctggtggaacacatgatcagattaagtaccttgttgcccagggttgcatcaagccactctgtgatctgctcatttgccccgatcccagaattgtaacagtttgcttggaaggtcttgagaacattttgaaggttggggaggcagaaaaaaaccttggagcaggggatgtcaacacctatgcacagatgattgatgatgctgagggactggaaaagattgagaaccttcagagccatgacaacacagagatatacgagaaggcggttaagatgcttgagtcttactggttggaggaagatgatgaggccatgcccacaggtgagaacccccagaatggcttcaactttggaaatcagcagaactctgttccatcgggtggcttcaactttggctgaagatacccatttggaatggcgtaccgttgtgccttagctacttgcttgggactagtcggaattggggagtcttgtcgtttgagtcatggttgggtcccgtcggtctggtctcaggcagtcgtcaggtcagtctaagcagggtcagtccttggctgcattgtcagtggtgcagtttggtcaatggtcagtcttcaaggtcaaccggtcggatcatttgggttctgcctcaccctatggtgggagcatggggaaaggccatccagagccgctggtgttgtcgggatagtcaccagtcgggttttgcctcctatatagcatgaatggatatcatattaatatctatttgaggtgaaaaagaaccttgaaagatatggttttcatggtcgtgtcggtttttgtcagaagcttttatgtgctttattaacttgtcgtaagagtattggcacaacttataaacatcaatatcaactgggttttgggagtcc

SEQ ID NO: 873 - DNA, 2394 bp, Hordeum vulgare
tccccccctagggtttcgttcgagggttctccgacgatgtcgctgcggcccaacgagcgggccgaggtgcggcgcagccgttacaaggcgtccgtcgatgcggaggacgggcggcgcaggcgggaggatcagatggtggagatccggaagaaccagcgcgacgccaaccttcagaagaagcgccgcgacgggttcccggccggcgccgcgtccgccgccggcggcgcgccgcagatgggccactcctcggctctccagcagaagctggagggcttgccggcgatggtgcaggcggttctctcggacgacaacaccgtgcagctcgaggccaccacccagttccggaagctgctctccatcgaacgaagccctccaattgaggaagtgatcaacacaggcgtggtgcctcgcttcattgagttcctcacacgggaggactatccccaactccagtttgaggccgcatgggcgctcaccaacatcgcgtcaggcacatcagacaacaccaaagtggttgttgagttcggtgctgtgcccatctttgtcaagctactcagctctcctagtgaggatgtccgcgaacaggctgtttgggctctggggaatgttgccggtgactctccaaagtgccgtgaccttgtgcttggaagtggtggactgtacccattgttgcagcagctcaatgagcatgccaagctctcaatgctcaggaatgccacatggacactctccaacttctgccgtgggaaaccacagccaaactttgaacaggtcaaaccggctctctcagcactgcagcgccttatccactctcaggacgaggaggtgctcactgatgcctgctgggctctctcgtacctgtctgatggaactaatgacaagatccaatctgtgattgaatctggcgtttttcctcggcttgtggagcttctcttgcacccttcggcttctgttctcattccagctctgcgcacggtgggtaacatcgtcactggtgatgatttgcagactcagtgtgtcattgataaccaagcgcttccctgtctcttgaacctcttgactaccaatcacaagaaaagcatcaagaaagaagcatgctggactatctcaaacatcacagctggtaaccgggaccagattcaggctgttatccaggcaaacattattggtcctctggtccatctcctgcaaggtgctgaatttgacattaagaaggaggcagcttgggcaatttcaaatgccacttctggtggaacacatgatcagattaagtaccttgttggccagggttgcatcaagccgctctgtgatctgctcatttgcccggatcccagaattgtaacagtttgcttggaaggtcttgagaacatcttgaaggttggggaggcagaaaagaaccttggggcaggggatgtcaacaactatgcgcagatgattgatgacgcagagggactggaaaagattgagaaccttcagagccatgacaacacagaaatatatgagaaggcagtgaagatgcttgagtcctactggttggaggaggaagatgaggtcatgccctcaggtgacaatgcccagaatggcttcaactttggaagtcagcagaactccgttccgtcgggtgggttcaactttggctgaagatacccggttgggcggtgtaccttagctacttgcttgggactagtcagatttgggggaggtgtttgtcgtttgagtcattgttgggtcctgtcggtctggtctcaagaagtcgtcaagtcagtctaagcagggtcagtccttgggcttgcatcgtcagtggtgcagcttggtcaacggtcagtcttcaaggtcaaccggtcggatcatttgggttctgcctcaccctgagggagaggacgtccagagccgcatgtgttgtcgggagagttgggttttgcctcctatatagcttgaaccaaatttatattgatatatctgtgtgaggtaaaaagaaccttgaaagatagggtattcacggttgtcggttgtgtcggtttttgtcagaagcgtttgtgtgctgtattaacttgtcgaaagagtattgagcacaccttataaacatcaatagcaactgggttttgggagtcccatgctggtctattcgttggtttgttgtatgttccacaggttttgtcgtgtcaagtcgtttctacactctgtttggagattgttccacgtctctctttagtgaaagagtagttgtatcacctattgtggtgacgagtttgagtatatggttggagagcagggtttaagttggttcctacttgtactgggaacctggtttagtgttgtatgattatggtcatggaacatagacgcaaaagaagaaatttcttggttacatttcatgttcctgttgatttttct

SEQ ID NO: 874 - DNA, 2389 bp, Triticum aestivum
aatcgagcccaaccgcatcgtgcgtgcgcacccccactccccccctagggtttcgaggttctccgacgatgtcgctgcggcccaacgagcgggccgaggtgcggcgcagccgctacaaggcgtccgtcgacgccgaggacgggcgccgccggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttgcccgcgatggtgcaggcggttctctcggacgacaacgccgtgcagctcgaggccaccacccagttccggaagctgctctccatcgagcgaagccctccaattgaggaagtgatcaacacaggcgtggtgcctcgcttcattgagttcctcacacgggaggactatccccaactccagtttgaggctgcatgggcgctcaccaacatcgcgtcaggcacatcagacaacaccaaagtggtggttgagtatggtgctgtgcccatctttgtcaagctactcagctctcctagtgaggatgtccgcgaacaggctgtttgggctctggggaatgttgctggtgactctccaaagtgccgtgaccttgtgcttggaagtggtggtctgttccctttgttgcagcagctcaatgagcatgccaagctctcgatgctcaggaatgccacatggacactctccaacttctgccgtgggaaaccacagccaaactttgaacaggtcaaaccggctctctcagcactgcagcgccttatccactctcaggatgaggaggtgctaactgatgcctgctgggctctctcgtacctgtctgatggaactaatgacaagatccaatccgtgattgagtctggtgtttttcctcggcttgtggagcttctcttgcacccttcggcttctgttctcattccagctctgcgcacggtgggtaacattgtcactggtgatgatttgcagactcagtgtgtcattgatcaccaagcacttccctgtctcttgaacctcttgactaccaaccacaagaaaagcatcaagaaagaagcatgctggacaatctcaaacatcacagctggtaaccgggaccagattcaggctgtcatccaggcaaacattattggtcctctggtccatctcctgcaaggtgctgaatttgacattaagaaggaggcagcttgggcaatttcaaatgccacttctggtggaacacatgatcagattaagtaccttgttgcccagggttgcatcaagccgctctgtgatctgctcatttgcccggatcccagaattgtaacagtttgcttggaaggtcttgagaacatcctgaaggttggggaggcagaaaagaaccttggtgcaggggatgtcaacaactatgcgcagatgattgatgatgctgagggactggaaaagattgagaaccttcagagccatgacaacacagaaatatatgagaaggcagtgaagatgcttgagtcctactggttggaggaggaagatgaggtcatgccctcaggtgataacgcccagaatggcttcaactttggaagtcagcagaactcggttccatctggtgggttcaactttggctgaagatacccggttggacgtgtaccttagctacttgcttgggactagtcagatttggggaagtcttgtcgttcgagtcattgttgggtcctgtcggtctggtctcaagcagtcgtcaagtcagtctaagcagggtcagtccttgggctgcatcgtcggtggtgcagcttggtcaatggtcagtcttcaaggtcaaccggtcggatcatttgggttctgcctcaccagaggacgtccagagccgcatgtgttgtcgggagagtcgggttttgcctcctatatagcttgaaccaaaattatattgatatatctgtgtgaggtaaaaagaaccttgaaagatagggttttcacggttgtcggttgtgtcggtttttgtcagatgcgtttctgtgctgtattaacttgtcgaaagagtatggagcacaccttataaacatcaatagcaactgggttttgggagtcccatgctggtctattcgttggtttgttgtatgttccacagtttttgtcgtgtcaagtcgtttccactctgtttggagattgttccacgtctgtctagcgaaagagtagttgtatcacctactgtggtgatgagtttgagtatatggttggagagcagggtttaagttggttcccacttttactgcggaacctggtttagtgttgtatgattacggtcatggaacatagacgcaaaagaggaaattcttggttacatt

SEQ ID NO: 875 - DNA, 2426 bp, Avena sativa
cctctttcgaatcgagccccaaccgcatcgtgcgtgcgcgacgcgcccgcacacacccccactcgcccctgccccgttagggtttcgaggttctccgacgatgtcgctgaagcccagcgatcggttggaggcgcggcggagccgctacaaggcctccgtcgacgcggaggacggccggcgccggcgagaggacaacctggtggagatccggaaggccaaccgcgatgcgaacctccagaagaagcgccgcgacgggttccctgcctccgccgcgtccgccgccgggggagcgccacagatgggccactcctcggctctccagcagaagctcgagggcttgccggcgatggtgcaggcggtgctctcggaagacggggctgtgcagctggaggccaccacgcagttccggaagctgctctccatcgagcggagccctccaattgaggaagtgattgccacaggcgtggttcctcgcttcattgtgttcctcacacgcgaggactatccccaacttcagtttgaggctgcatgggcacttaccaacattgcatcaggcacatcagataacaccagagtggtggttgagagcggtgctgtgcccatctttgtcaagctactcagctccccgagtgaggatgtccgcgagcaggctgtatgggctctgggaaatgtcgctggtgactctccaaagtgccgtgaccttgtgcttggaagtggaggactattccctctgttgcagcagctcaatgagcatgccaagctgtcgatgctcaggaatgccacatggacactctccaacttctgccgcgggaagccacagccaaactttgagcaggtcaagccggctctctcagcactgcagcgcctcatccactctcaggacgaggaggtcctcactgatgcctgctgggctctttcatacctgtctgatggaactaatgacaagatccagtctgtgattgaatctggtgtgtttcctaggcttgtggagcttctcacgcatccttcggcttctgtgctcattccagctctgcgtacagtgggtaacattgtcactggtgatgatttgcaaactcagtgtgtcattgatcatcaagcactcccctgcctgttgaacctcttgaccaccaatcacaagaagagcatcaagaaagaagcatgctggacaatctcaaacatcacagctggtaaccgggaccagattcaggctgtgatcaatgcaaacataattggacctctggtgcatcttctgcaaggtgctgaatttgacatcaagaaggaagcagcttgggcaatttcaaatgccacttctggtggaacacatgatcagattaagttccttgttaaccagggttgcatcaagccactctgtgatctgctgatttgcccagatcccagaatcgtaacagtttgcttggaaggtcttgagaacatcttgaaggttggggaggcagaaaagaaccttggggctggggatgtcaacaactatgcgcagatgattgatgatgccgagggactggagaagattgagaaccttcagagccatgacaacactgagatatatgagaaggcggttaagatgctcgagtcctactggttggaggaggaagatgaggccatgccttcaggtgagaacccccagaacggcttcaactttggagatcagcagaactcggctccatctggcgggttcaacttcggctgaagataccggggtggaacagtgtaccttagctacttgcttgggactagtcagaactgggggagtcttgtcgtttgagtcatggttgggtttgtcagtctggtctcaagcagtcgtcatgtcagtctaagcggggtcagtcctttgcgctgcatcatcagtggtgcagtctggtcaatggtcagtcttcaaggtcaagctggtcggatcatttgggttctgcctcaccctgtggtgggagcatggggagggggcattcagagccgcaggcgttgtcgggagagtcgccggtcgggttttgcctcctatatatatagactgaatgatgaaaattatattgatatctgtcttgaggtaaaaagaaccttgaaagatagggttttcacggtcgtgtcggttttatgtgctgtattaacttgtcgcaagagtattggcacaccttatgaacatcaatagcaattgggttttgggagtcccatgctggtctattcattggtttgtttgtgtatgatccacaggttttgttggtctaagttgttgtggattgcacacttgctgtcttattttgaatttgttccacgtctgtctagcaaaagactagtatcacctgttgtggtgataggtctgcagtttgagcacttgtgcattgcgggtcctacttaatggaacatacgttgtagcaaatggaagcaaaaagagatagaaattcttggttacatttcta

SEQ ID NO: 876 - DNA, 1601 bp, Manihot esculenta
tggtaatcatgtcgttgcggccaagcgcgaggaccgaggtccgcaggaataggtataaggtcgccgtcgatgctgaagagggtcgccgaaggcgagaagataatatggtggaaatccggaagaatcgtcgggaggaaagcttgcagaagaagaggcgtgaaggcctccaagcccaacccgtgccagctgcaattcattcctcggctgtcgagaagaagttggagcatctaccttccatggttgctggtgtctggtctgaagatagcaatttgcagcttgaggcgaccactcaattcaggaagttgctctcaattgaacgtagccctccaattgaggaagtcatacaggctggtgttgttcctcgctttgttgagttccttatgagggaggactttcctcagcttcagtttgaagcagcttgggctctcacaaacattgcttcagggacatctgaaaatactagggtggtaattgatcatggagctgttcccatatttgtaaagcttctgggttctccaagtgatgatgttcgcgaacaggctgtgtgggcgttgggaaatgttgctggagattcacctaaatgtcgtgatcttgttcttggccatggagctttgattcctttgcttgctcagttgaatgagcacgctaaactttctatgcttaggaatgctacatggacactctcaaacttctgtcgaggcaagccacagccaccttttgaccaggtcaagcctgctcttccagctcttgcacatttaattcactctaatgatgaggaagtcttgactgatgcatgttgggccctctcgtatctttctgatggtaccaacgataaaattcaagctgttattgaagcaggagtatgccctcggctagttgagcttttactgcacccatctccctccgttctcattcctgcacttcgcactgttgggaatattgtcactggtgatgatatgcagacccagtgtatcatcaatcatcaagcactgccgtgccttctgaatttgctgacaaataactataaaaagagtatcaagaaggaagcttgttggaccatatctaatatcaccgctggcaacaaagagcagattcaggctgtcattgaggctaatatcattggtccattggttcatctacttcaaaatgcggaatttgacattaaaaaggaggctgcatgggccatctcaaatgcaacatctggtggtactcatgatcaaatcaagtaccttgttagccagggttgcatcaagcccttgtgtgaccttctcatatgtcctgatccaaggatagtgacagtctgcttagaaggtcttgaaaacatcttgaaggtaggagaagctgacaagaatttaggcaacactggagacgtaaatcaatatgcacaaatgattgatgatgccgaggggttggagaaaattgaaaatctacagtcacatgataacacagagatttatgagaaggctgtgaagatccttgagacatattggcttgaggaggaggatgagacaatgccgccaggagatgcttcccagtctgggttccagtttggcgggagtgagatgcctgctgttccatctggtggatttaattttagctaa

SEQ ID NO: 877 - DNA, 2067 bp, Manihot esculenta
taatcatgtctttgaggccaagcgcgaggaccgaggtccgcaggaatagatacaaggttgctgttgatgctgaggaaggtcgtcgcaggcgagaagacaacatggtggagatccgaaagaatcgtcgcgaggagagcctgcagaagaagcgccgtgagggactccaagcgcagccgatgcctgcttcgattcactcctccgctgtcgagaagaagttggagcatctcccatcaatggttgctggtgtttggtctgatgatagtaatttgcagcttgaggcaacaacacaattcaggaaattgctctccattgagcgtagccctccaattgaggaagtaatacaggctggtgttgtcccccgttttgttgagtttcttatgagggaggattttcctcagcttcagtttgaagcagcttgggctctcacaaatattgcttctgggacttctgagaatacaagggtggtaattgatcatggagctgtccccatatttgtaaagcttcttggttctccaagtgatgatgttcgtgaacaggctgtgtgggcattgggaaatgttgctggagattctcctaaatgtcgtgatcttgttcttggccatggagctttgattcctttgcttgcacagttgaatgagcatgctaaactatctatgctaaggaatgctacatggacgctgtctaacttctgccgaggcaagccacagccaccttttgaccaggttaaacctgccctccctgctcttgcacgtttaattcattctaatgatgaggaagtcttgactgatgcatgttgggcactctcgtatctttctgatggtaccaatgacaaaattcaagctgttattgaagccggagtatgccctcggctagttgagcttttattacacccatctccttcagttctgattcctgcactccgcactgttgggaacattgtcactggtgatgatatgcagacccagtgtatcatcaatcatcaagcactgccttgccttctgaatttgttgacaaataactataagaagagtatcaagaaggaagcttgttggacaatttctaacataactgccggaaacaaagagcagattcaggctgtaattgaggctaatatcattggcccattagttcatctacttcaaaatgctgagtttgacattaagaaggaggctgcatgggcaatctcaaatgctacttccggtggttctcatgaacaaatcaagtaccttgttagccaaggttgcattaagcccttatgtgaccttctcatatgccctgatccaaggatagttacagtgtgtctagaaggtcttgaaaacatcttgaaggtaggagaagctgacaagaatttaggcaacactggaggggtaaatcaatatgcacaaatgattgatgatgctgaagggttggagaaaattgaaaatctacagtctcatgacaacacagagatttatgagaaggctgtgaagatgcttgagacatattggctggaggaggaggatgagacaatgcctccaggagatgcttcccaatctgggttccaatttggtgggggtgaaatgcctgctgttccatctggtggatttaatttcagctagacgagttgtcactggttcagtattgaagttgtgaaatgtggcgaaacagttgtcagcttcaggctgggtgtcatggtgtcatgtttgggtctactggttcagtcttaaggtgtggtagaaaaggcaggacagttcggggttttcagattgacgagattaatattggtgtgggaagacaaaatgagttgggtcacattatgaacatgggttttctctgctataaacttgagaaaaccgtgctcatttttggtgggggggattgttcttggaggttgggctctcagaacgaaaatggggtctttttgaatgtatttgttgtcatagtttgttttagtagcgtctctgccctttccacagtctgtcgattttggcactcccagaatccatttagtggcgtgcttgtacttactaggaatatggaaaaatatatatatatttatttatttataatttttagagtcagttgcgt

SEQ ID NO: 878 - DNA, 2309 bp, Theobroma cacao
ctcttcaaatcaatcaaaatccccccaaaatcttattttcattttccctctagggttttcagccgaaggaaaacaagaagaacaagaaaaagagaaggagttcttgagggttttagttcgatcactgtctttttctctttagggttgtgttttttcgggaattgagagaagatgtcgttgaggccaaacgcaaggacggaggttcggaggaacaggtacaaagtggcggtggacgccgaggaaggaaggcggaggagggaggataacatggtggagattaggaagaaccgccgtgaagagagtttgcagaagaagcgacgtgaaggactccaagctcagccaatgcctgcttctcttcactcctctgctgttgaaaaaaagttggaaaatttgccagccatggttgctggtgtttggagtgaggatagtaatctgcagcttgagtcaaccactcagtttaggaaattgctttcaattgaacgcagcccacctattgaggaagtaatacaagctggtgttgttcctcgctttgttgagttccttatgagggaagatttcccgcagcttcagtttgaggcagcatgggccctcacaaatattgcttctggaacatctgagaacacaaaggtggtaattgatcatggggctgttccaatatttgtgaagttacttggttcccctagtgatgatgttcgtgagcaggctgtgtgggcattgggaaatgttgctggtgattctcctagatgtcgtgatcttgtccttggccatggtgctttgcttcctttgttggcacagttgaatgagcatgcaaagctttctatgctgagaaatgctacttggacactctcaaatttttgtcggggcaagccacagcctccctttgatcaggttaaacctgcacttcctgctttggcacgccttattcactcaaatgatgaagaagtcttaactgatgcatgctgggcgctctcatatctttctgatggtacaaatgacaaaattcaagctgttatcgaagcgggtgtatgtgcgcgtctcgttgaacttttgctgcacccatctccgtcagtgctcattcctgctcttcgcactgttggaaatattgttacaggagatgatctgcaaacccagtgtatcatcaatcatcaagcattgccatgccttttgaatctgttgacaaataattttaaaaagagcatcaagaaggaagcttgttggacaatttcaaatatcacagctggaaataaggagcagatacaggctgtgattgaagctaatattattgctccactggttcatctgcttcaaaatgccgaatttgatattaagaaagaagctgcgtgggccatttcaaatgctacatctggtggaactcatgatcaaatcaagttccttgtaagtcaaggttgtatcaagccgttgtgtgatcttcttaactgccctgatccaaggatagttacagtttgtttagaagggcttgaaaatattttgaaggtaggagaagctgataagaatcagggcaatactggaggtgtgaatctctatgcacaaatgattgatgatgcagagggtttagagaagattgagaatttacagtctcacgataacactgagatctatgaaaaggctgtgaaagttcttgagacatattggttggaggaggaggatgagacaatgccaccaggtgatgcctctcaaacagggtttcagtttggaccgggtgaggttcatgttccgtcagggggattcaatttcagctagaggaattatatctggtcctgtgtaagtccttatggatatggtggaacaatagttgggttccaggtcaggcgtcttgttgtcatgtttgggtcctgtcaagggtcgggtgtggtgtcgagggtgctgggctggcttggaagaacacagccaggttcatattatgcaagaaaggaaatggagggaagatgagattggtgatctgctacaataaattgaggaatcagagtgtttattttgggtgctcgtgaaacaaatattggagtctgtctcaatttgtagttgtcatggttagtggtgatgtctttgcaatggcattgctgggtgattttggcaattcccaaaacagttacaacttgttatgagtaacatgggaatattcttttgcttctacgtaattggagtgttgtgttgtcatatcatgcatcaaaatatgcctcttttagatagtcttatattttttgtgtagtgtatacaatgcctcgttggaagctttgtcaaaacatatcatttggaggggaaatagagttactactaatgtaattgatggt

SEQ ID NO: 879 - DNA, 2131 bp, Centaurea maculosa
  misc_feature (214)..(214): n is a, c, g, or t
  misc_feature (220)..(220): n is a, c, g, or t
  misc_feature (259)..(259): n is a, c, g, or t
  misc_feature (343)..(343): n is a, c, g, or t
  misc_feature (361)..(361): n is a, c, g, or t
  misc_feature (445)..(445): n is a, c, g, or t
  misc_feature (466)..(466): n is a, c, g, or t
  misc_feature (523)..(523): n is a, c, g, or t
  misc_feature (571)..(571): n is a, c, g, or t
  misc_feature (589)..(589): n is a, c, g, or t
  misc_feature (844)..(844): n is a, c, g, or t
  misc_feature (952)..(952): n is a, c, g, or t
  misc_feature (1042)..(1042): n is a, c, g, or t
  misc_feature (1045)..(1045): n is a, c, g, or t
  misc_feature (1048)..(1048): n is a, c, g, or t
  misc_feature (1057)..(1057): n is a, c, g, or t
  misc_feature (1063)..(1063): n is a, c, g, or t
  misc_feature (1084)..(1084): n is a, c, g, or t
  misc_feature (1127)..(1127): n is a, c, g, or t
  misc_feature (1132)..(1132): n is a, c, g, or t
  misc_feature (1135)..(1135): n is a, c, g, or t
ttctcttcggcccgcccgtctctctctctctcttcccgctctatatagagacctgcaattgatcatgtgctcacgtattctgtaaaccttcactcgctttagaccacatttctagggtttttttttttccttcttagcaaccatgtcggtgaggcctaacgcgaggacggaggttcgccggaatcggtacaaggtggcggtggatgccgagganggacgncggaggagagaagacaacatggttgagatccgtaagaanaagcgagaagagagtttgcagaagaagagacgagaagtgctcactggtagtcagttttctgtgcctgttcaatctgcttctgcngccgaaaagaagttaganaatctacctgcaatggttgctggagtttggtccgatgataacaatatgcagcttgaggctactactcagtttcgtaagctgttntcaatagaacgcagccctccnattgaggaagttatccaatctggtgttgttcctcgttttgttgagtttcttgttagngaggatttcccccaactacagtttgaggcagcctgggctttgactaanattgcttcggggacatcngaacacacaaaagtggtgattgatcatggtgctgtgccgatatttgtaaaacttcttgcatctccaagtgatgatgttcgagagcaggctgtatgggcgctagggaatgttgctggtgattcccctaaatgtcgtgatcttgtactcggacaaggtgctttgattcctttgctggctcagttaaacgagcatgctaaactgtctatgttgcgcaatgctacgtggacgctttccaatttttgtagaggcaagccncaaccctcttttgatcagaccaggcctgcacttccggctcttcagcaacttattcattcaaacgatgaagaagttctgactgatgcttgttgggcactctcatatctntcagatggtaccaatgataaaatccaagcagtaatagaagcaaacgtatgcccaagattggttgagttactcaatcatccttctccttcngtnctnatccctgcncttcgnacggttgggaacattgttacnggtgatgatatgcaaactcagtatatcattaatcatcaagcantgccntgncttctgaatctgctgagcaataatcacaaaaagagcatcaagaaagaagcttgttggactatatcaaacatcactgctggcaacaaggaacagattcaaactgttattgaagcaaatatcattggccctctagttcatttgcttcagaatgcagaatttgatatcaagaaggaggctgcatgggctatctcaaatgctacttctggtggaagccatgaccaaattaagtatctagttagtcagggatgtatcaaaccgttgtgcgacctacttgtctgtccagaccctagaattgtgactgtttgtctagaggggctcgagaacatactaaaggttggtgaagctgagaagaatttagggcgatcaggagatgtaaatctttatgcacaaatgattgatgatgctgaaggcttggagaagattgaaaaccttcagagtcatgataacaatgagatatacgagaaagcagtgaaacttctcgagacatattggttggaggaagaggatgatgcaatgccacctggtgaaaccactcagcctggtttccattttgaaggtggtgatgtttctattcccagtggtggatttaacttcaactgattgaaggactttctgcttgaagttaagtgtcatttacggtggagtactgttggctacgcatcagtcttctgtctgttttcacttgggtcccgcttgctccgatattgtagtgtgcttgaagtttttggcctggttcaggttttcaccaaacaatagcagtgaaatgttaatggattgattatgtaaaagtaatatgtttgtttcattttggggaggctttttgacgattcaaattgggatttatagaagttcccctctattgcgtctacccttgtatatcttctttgcgatttctttatgtcagcagtatgggatttctaattccgtacatgtgctataacatgcctctgcttattcgtgtatgtaccatgaaaaccagttctctattacactagt

SEQ ID NO: 880 - DNA, 1617 bp, Ricinus communis
gtaatttaaaagtaagataagatgtcgttgaggccgagcgctagaaccgaggttcgaaggaacagatacaaagtggcggtggatgcggaggaaggtcgccgtaggcgagaagataacatggtcgagatccgtaaaaatcggcgtgaggagagtttacagaagaagagacgtgaaggacttcaagctcagcctatgccagcttctcttcactcctcggccgtcgagaagaagttggagcatctaccatctatggttgccggtgtttggtctgatgatagtaacctgcagcttgaggcaaccactcaatttagaaaattgctttcaatcgagcgcagccctccaattgaggaagtcatacaagctggtgttgttcctcgctttgttgagtttcttatgagggaggactttccgcagcttcagtttgaagcagcttgggctctgacaaacattgcctctgggacatctgagaatacgagggtggtaattgatcatggagctgtccctatatttgtaaagcttcttgcttctccaagtgatgatgttcgtgaacaggctgtttgggcactgggaaatgttgctggtgattctcctaaatgtcgtgatctggtccttggcaatggagcattgcttcctttactggcacagttgaatgagcatgctaaactttctatgctgaggaatgctacatggacactctcaaacttttgccgaggcaagccacaaccattttttgagcaggttaagcctgcacttccagcccttgcacgtctaattcattctaatgatgaagaagttttgactgatgcatgttgggcgctctcgtatctttctgatggcaccaatgacaaaattcaagctgttattgaagcaggagtgtgccctcggctagttgaacttttactgcacccatctccatcagttctcattcctgcccttcgcactgttgggaatattgtcactggcgatgatatgcagacacagtgtattatcaatcatcaagcactgccctgccttctgaatttgttgacaaataactataaaaagagtatcaagaaggaagcttgttggaccatctctaatataacagctggcaacaaggagcagattcaggctgtaattgaggcaaatattattggtccattggttcatttgcttgaaaatgctgaattcgacattaagaaagaggctgcttgggcgatctcaaatgctacatctggtggtactcatgatcaaatcaaatatcttgttagccaagggtgcatcaagcccttgtgtgaccttctcatctgccctgatccaaggattgtgactgtctgcttagaaggtctggaaaacatattgaaggtaggggaagctgacaagaatttgggcaacaatgatggtggtgtaaatctatacgcgcaaatgattgatgatgctgaggggttggagaaaattgagaatctacagtcacatgacaatatagaaatttatgagaaggctgtgaagattcttgagacatattggttggaagaggaggatgagaccatgcctccaggagatgcttcacaatctgggttccaatttggagggagtgatatgcctactattccctctggtggatttaatttcagctaa

SEQ ID NO: 881 - DNA, 2738 bp, Sequoia sempervirens
agcgccaggaggctagggtttttttgatttttcgctctctgcgttttatcaagggtttgaaattcctgattttttagcagttagggtttctagggtttgaaggttgttcttccggagccgagtggggttttacagtttgtttcagccatgtcgctgaggcccgtttcgaggactgaggtccgtaggaagaattataaggtggccgttgatgccgatgaagcgcgccggaagcgtgaggataatatggtggagatcaggaagaataagagggaagaaagcttgctaaaaaagagaagagaaggtatgcaagcgcagcagtttgctccagctgtacagtcgtcggccgttgagaagaagttggagagccttcctgctatggtagctggagtatggtctgatgatcctagtttgcagcttgaagcaacaactcaattccggaagctactatcaattgagcgtagtcctccaattgaggaagttatagaagcgggtgttgtcccacgttttgtagagtttctgacaaggcaggactttccccaacttcagtttgaggcagcatgggcattgacaaatatagcttcaggcacatctgatcatactcgagtagtcattgaccatggagctgtaccaatttttgtacaactccttagttctccaagtgatgatgttcgggagcaggctgtctgggcattgggtaatgtggctggtgactccccaaagtgcagagatctagttctttctcatggtgctctcatgccacttcttgctcaattgaatgaacatgctaagctttcaatgttgagaaatgcaacatggactttgtctaatttctgccgaggcaaaccacaaccagcgtttgaacaaacaaagcctgctctacctgcacttgagcggcttattcattcgaacgatgaagaagttttaacagatgcttgctgggctctgtcttatctctctgatgggacaaatgataaaattcaagctgtgattgaggctggtgtctgtcgtaggcttgttgagctcctgctccatccctctccatctgtccttattccagctctccgaacagtgggcaatattgtaactggtgatgatatgcagactcagtacataatcaacaatcaagcacttccttgcctgctagctctcctaacccataatcacaagaagagcatcaagaaggaagcttgctggaccatttcaaacataaccgcaggcaacaaagaacagattcaggctgtgatcgatgcaaacatcattcctccacttgttcagctccttcaaactgctgagtttgatattaagaaagaagcagcatgggccatatcaaatgcaacttctggtggtacacatgaacagatcaagtatttggtgaatcaaggatgcattaagcctctgtgtgaccttttagtctgtccagatccaaggattattactgtttgtcttgaaggactagagaatattttgaaagttggagaagctgagaaggatcttggtaatacaggaggtgtgaatctatatgcccagtatatcgatgatgctgaaggacttgagaagattgagaacttgcaaagccatgataacaatgagatttatgagaaagcagtaaaaatattagaaacatactggctggaagatgaagaagatgatcaagctttacctgctggaagtgatgctgctcagccaacattcaattttggtgccaatcaaccaacagtgccatctggtggattcaactttggttgaaaagggatttgagctgatgcaacttggggggctatgctatgggtgttaagagactgtttccaatatctcttatctatatgttggagtccgtcattgcaaggaaaaatgcttggtttttggatggtgctggtgacaggctatttctgttgggatgtcagtctgacaatgctaaccaaatcatgcagacatgagctcctcggaattaatgggtcagcatttgttggtttggtagtacagttttcatgctgtattatggtctttgtccatatgctatgttaaagttgcaataattagataaatggactgtctgacgagccacctcatgtcctttatagctctgtaacagagctttttgttgtccgtgtcatgtgccatgcctcttggcatttggacaattacttggacaggtctcaagggtcatactaacactggttatgcatgcattgtattcattgcatcaagaaagtgagtcgtcatgttatgtatatgacacttaccggtcagtcttgtggccacagaaaaatggcctaccactaatcttgggtttcaggacaatcctgaatccctaaaatgcatgcctatagtgcatcctcactctaggaattcgccttgagttttcttggaccataaactttttaagttgaagtccacttttccactaacctccatctctcttctccctgaatgtgtcaatctgtgcatttgcagttgccccatcatcttcttggagtcagtttaaagggattttctattttttatctttattttcgtagtttacagttcctgtcgccagttctcatcctatttgggttgctatacgccttttttggacagttctatgcacttgaatgtatatcagtttccaaagagttttggggactattttgtcaattgttgattatctatttgtaatgaattgaaagtttactagtaatgatcctatatttaaagacattgggtatttgtttgaaaatattatataaaacgaggcc

SEQ ID NO: 882 - DNA, 2279 bp, Eucalyptus grandis
ctctgaccgatcgcaaccctctctaaaaccctctcgctttctctctctagggttttgcccgctccccttccctggtccaccacctcggctgcgcccccgatcgatcccccgccccgacgatgtcgctccggccgaacgcgaggacggaggtccgccgtaaccgctacaaggtggcggtcgacgcggaggaggggcggcggcggagggaggacaacatggtggagattcgcaagaaccggcgcgaggagagcctgcagaagaagaggcgggagggcctccaggcccagcagcagaccgcgccgtcgctccactcttccgccgtcgagaagaagctggaacatttgccttccatgattggtggtgtatatagtgatgataataacttgcaactggaggccactactcaatttagaaaattactctctattgaacgcagccctccaattgaagaagttatacaatctggagttgttccacggtttgttgagtttctaatgagggaggattttcctcaactccagttcgaagcagcgtgggctcttactaatattgcttccgggacatctgagaacactaaagttgtggttgatcacggagccgtccctatatttgttaaacttcttgcttctcctagtgatgatgttcgtgagcaggctgtgtgggcactgggaaatgttgctggtgattctcctaaatgccgtgatctggttcttgcaaatggagctttgcttcctttattggcacagttgaatgagcatgctaaactgtcaatgctgagaaatgctacctggactctctcgaacttttgtaggggaaagccacaacctccttttgatcaggttaggcccgcacttccagctcttgaacgtcttatccattcaaatgatgaagaggtcttgactgatgcatgttgggcactatcctatctttctgatggaacaaatgacaaaattcaagctgtaattgaagctggcgtttgtcccaggcttgttgaactgcttctccatccatctccgtcagtgctgattcctgcccttcgcactgttgggaatatcgtaactggggatgatttacaaactcagtgcatcatcaaccaccaagcactaccatgccttcttaacctgttgactggaaattacaagaaaagcatcaagaaggaagcatgttggaccatctcaaacatcactgctggaaacaaggagcagattcaggctgtcatagaggctaatataatagctccactcgtccatttacttcaaaatgctgaatttgacatcaaaaaggaagctgcatgggcaatctccaatgctacatccggaggttctcatgaacagataaagttccttgtttgtcaagggtgtataaagcctctgtgtgatcttctcatctgtcctgatccaagaattgtgaccgtctgtttagaaggtcttgagaacattttgaaggttggggaagctgagaaaaacctaggaggtacaggtgatgtgaatctttatgctcaaatgattgacgatgccgagggcttagagaagattgagaacttgcagagtcatgacaacaatgagatatatgagaaagcggttaagcttcttgaaacatactggttggaagaagaagatgaggcgatgcctcctgaggattctgcgcaccctggtgtaccgtttggaggaaatgagctgcctcctgttccgtctggtggtttcaagtttggctaagggaaagctgttgctgaattatataaagttgtcaaactgcggagggatggaatggaatctgcattgaggtcaggtgtcgctcatagtcgccctgttgtgtccagtttttatgagattttggagtcatgcttggaatggcttgggtctggattaagctttgtgaagagagcaattcggtgtggttatatgtggattgatgacgctgcagctaaagagcgctcttggtcgaagtttttgttgcaagaggtcgtcgctgtcagttgggctcctgtcaaggatcttgcagttttaaagtaattactgtcgggctattgtagtcttgttgtcttcacaatggtatattgttatattgctccgctgaaatcttgagcagtattttatttctttacagttgttaagggtcactattatagttattttccattttccattttctccctgttcttgcggatttttctgtcgtcgagacagagcgtggcagcaattgccttctatttgttgaaatgtcaactcttatgttatatgcaaaagatgtgaataaatgattcctttggcttttgcttc

SEQ ID NO: 883 - DNA, 2947 bp, Podocarpus macrophillus
tctctattggctgtgaagtccgtgttcgaatccgagcgaggtcgaaagaagttttgtgcgtacactagggtttgtagggtttgaaaggtttctgcaacgacattctttggttgtctagggtttctgcgaccatgtcgttgaggccgatttcccgcacagaggtgcggaagaagagctacaaggtagccgttgacgcagatgaggcgagaagaaagagagaagataatatggtggaaatccgcaagaataagagggaggagagtcttctcaagaagagaagggagggaatgcaggcgcagcagttcactccacaggtgcagtcgtctgccgtcgagaaaaagttggaaagccttcctgctatggtgggtggagtatggtccgatgatccttctttgcagcttgaagcaacaacacaatttcggaagcttctgtcgattgagcgcagtcctcccatagaggaggttattgaagcaggggtggttcctcggtttgtggagttccttacaaggcaggacttcccacagcttcagtttgaagcagcttgggcgttgacaaatatagcttcaggaacttccgaccatactcgagttgtgattgaccatggtgctgtgccaatatttgttcaacttcttagttctccaagtgatgatgtgcgggaacaggctgtctgggccttgggaaatgtagctggtgactctcccaagtgcagagatcttgttctttctcatggtgctctcatgccacttcttgctcaattgaatgagcatgctaagctttcaatgttgagaaatgccacatggactctctctaatttctgccgaggcaaaccacaaccagcatttgagcaaacaaagccagctcttccggcacttgagcgacttattcattcaaacgatgaagaagttctgacagatgcctgctgggcactttcttatctctctgatgggacaaatgataaaattcaagctgtgattgaggctggtgtttgccgtagacttgttgagctcctgctccatccttctccatctgttctgatacctgctcttcgaactgtgggaaatattgtaactggtgatgatgtgcaaactcagtacatcatcaacaaccaagcacttccttgtctcctagctctcttgacccataatcacaagaagagtatcaagaaggaagcatgctggactatttctaatataactgcaggcaacaaagatcagatacaggctgtgatcgatgcaaatatcattcccccacttgtacagctgcttcaaactgcggagtttgacatcaagaaagaagcagcatgggctatatcaaatgcaacatctggaggaacacatgaacagataaagtatcttgtgaatcaaggatgcattaagcctttatgtgaccttttggtatgcccagatcctcgcattattactgtttgcctcgaaggacttgagaatattttgaaagttggagaagctgagaaagaccttggtaattctggaggtgtgaatctgtatgctcagtatattgatgatgctgaagggcttgagaagattgagaacttgcagagtcatgataacaatgaaatttatgagaaggcagtaaaaattcttgaaacatactggttggaagatgaagaggatgatcaggcactacctgctggtggcgatgtcgctcagccagcattcaattttggctcaaatcagccatcagtgccatctggtggattcaactttggttgaggaggaatttgaaccatcgtgtccagtggggggtgggggtatgcaagttgcgaattgaacttcaaggttgtttatctgtgctgtagtccgtcatgcaaggaaaatgcttggtttttggatgatactggtgacaggctatttctgttggtaatgtcagttggacaatactaacttgatcatgcaggcatgagctcctcggtctaagggtcagccttgttatggcatagtagtacagattgcatgctgtattattgtctttgtccataagtaccagtgaagaagcaatggttggatgaatggactgcctacggagctaccttctgtcttcttatagctccatgctggatggagctaattgtccgagtcaggttccatgcctctatgggcatgtgtgctttgttgcatcaagaaaatgaacagtcatgtttgatgtgatatgtggaagtcagtcttgcagccagtgggattggcttaccattaaccttggatgttgggataatcccgattcctcagaatgcatatttatcatgcattctcatagtctcttggggattttgcctatgaggctttttttggactgtcacttcaaagttgacggtcatcagttctgttttctttgtcctccttgtttatgtgtcttatctggccatgtcccttttcttagtgtcttgatatgtatgcatttgtgttaaaatgttttatttaatctgcttccgtcttattgagtttaactgacgacttctctccgttttaatgtgtcaatctgtcccatcatgcataattgttcatttaccgacaattagttctgttgcttcctggagtgtgtcaaaacggagtacttctcttcgttttaatgtgtcaatctgtcccctctgtcctgcattagttgttcatttactgagttagttctgttgcttcgtggagtatgttaaagggatttttcttctcttattttgtcagtcagtctccctcctgttgccagttgtcattctatcaattgttatttggtatgaatcttttttggacagttctatatatactttgcatgtattactggtaattgttttaagtattcattactggtaatgaattgaaagacttccatttcttgaaaagataaagcatcgaaggatgtatgtattggattgttttggaaaacgctatggatgttgggctgctcaacaattgtgtctttttgaagataaattcaaattgcg

SEQ ID NO: 884 - DNA, 2427 bp, Aristolochia fimbriata
cgacaaatcgccaccgactcggttgaactcgttcgcgcagagtggcgaaagccgccagctttcttgccctttcttccttcccgcttccgttctggttttgggaattcggggctctgcttcgcgctctctctcgctatctctctcgctatctctctctcgctatctctctctatttcctctcaacaggcgataggcttctccgatcgtcgttgccatgtcgctcaggccgaacgccaggacggaggttcgacgcaaccgatacaaggttgccgtcgatgcggaagaagggcgtagacggagagaggacaacatggttgagatccgcaagaataggagggaggaaagccttcagaagaagaggagggaaggcatgcaggctcagcaattcccgacttcgatccatgcctctgctgtcgagaagaagttggaaagtcttcctgccatggtgaatggagtttggtcggacgatagtaatttgcagcttgaggccactacacaatttaggaagctgctttctatcgaacggagtccacctatagaagaagttatccaagctggtgttgttccacgttttgtggacttccttttgagggaggattttcctcagcttcagtttgaggctgcttgggctctcacaaatattgcgtcaggaacctcggagaatactaaagttgttattgatcatggggctgtgcccatatttgtgaagcttcttggttctccgagtgatgatgttagggagcaggcggtgtgggctttgggaaatgttgctggtgattccccaagatgcagggatcttgtccttggccatggtgccttgattccattgctggcacaattgaatgaacatgccaagctttccatgctgagaaatgccacctggaccctctccaacttctgcagaggcaaacctcaaccaccatttgagcagaccaaacctgctctgccggcacttgagcggcttatccattccaatgatgaagaggtccttaccgatgcgtgctgggcactttcttacctttcagatggtacaaatgataaaattcaggctgtcattgaagctggtgtctgccctaggcttgttgaactgcttatgcacccttctccttcagtgcttatcccagctctccgaactgttggcaatattgtcactggggatgacatgcaaactcagtgtattatcaatcatcaagcacttccctgccttttgaatctgttaacacacaatcacaagaagagtataaagaaggaagcatgctggaccatctcaaacatcactgctggcaacaaggaacaaatacaggctgtgattaatgccgatattatcggtccattggtcaatttacttcatactgctgagtttgacataaaaaaggaggctgcatgggcaatctcgaatgccacttctggtggtacccacgatcagatcaaatatcttgtgagccaaggttgcattaagcctctttgtgatcttctggtttgtcctgacccgaggattgtaacagtctgtttggaagggttggagaacattctgaaggttggagaggctgagaagaatgttggtaacactggaggagtgaacctctatgctcagctgattgacgaggctgagggattagagaagatagagaatcttcagagccatgataacactgaaatttatgaaaaagctgtgaaaattcttgaaacatactggttagaggaggaagatgaattgcctcctggtgatgctgcagcagcagcgcaagctggtggattccgctttgggggcgagttaccagttccctctggtggattcaacttcagttgaagaggtatggccagaggtgctaaaagcatgaatgcccagttgtcgaagggctggtcttggtttggttggtcagtcaggggagtcgcgtcgcgtcggtgttgtccagtcttgaagtacggtcgaagggggtgatgctgagaagtcttgctgtcggcctgtagaataaaaaaggatgaaagatggagctgggttttggaaggatggacgatggtgattcaagatgtggggtgttggcttcctgttacgagggagtggtaggagccaaactatactcgtcctatatcgcttgtatttgtcttaaaggcgatgggatacttgtctgccttctttaatttgttgttaggaagtagcatagtgttagcaactccaagatcgaggttttgttgttgcagggtggtacagagtccaatgtctggtttttcctctcagctaatatcatgcctcttaatgtatagcgagagcagaagagtttctctatttgaaattcggttttgattggtgatttgtctttttgtgtaagtcacaactcttttctgttactgtgagagaggggaagggagggatcaatttgtagttaaacttttacaaattagtatcactgcatttaaaaaaaaaaa

SEQ ID NO: 885 - DNA, 2295 bp, Gossypium hirsutum
ttttctgttcctctgggatattcagtgaagaaggaaaatagtgttttgtattccgattctcttttaaattatagttttgttcctgaaaatcggagaagatgtcattgagaccaaactcgaggacggaggttcgaaggaacaggtacaaggtggcggtggacgctgaggaagggaggcggaggagagaggataacatggtggagattaggaagaatcgccgtgaagagagtttgcagaagaagcggcgtgaagggcttcaagcgcagccaatgcctgcttctcttcactcctctgccgttgagaaaaagttggaaaatttgccagccatggttgctggtgtctgggctgacgatagtaatatgcagcttgaggcaaccacacagtttaggaagttgctttcaattgaacgcagcccacctattgaccaagtgatacaagcaggagttgttcctcgcttcattgaattccttgcgagggatgatttcccacagcttcagtttgaggcagcttgggccctaactaatattgcttctgggacatctgagaacacaaaggtggtaattgatcatggggctgttcctatatttgtgaaattgcttgcttcaccaagtgatgatgttcgtgagcaggctgtctgggcactgggaaatgttgctggagattctcctagatgtcgtgacctggttcttagtcatggtgctttgcttcctttgttggcacagttaaatgagcatgttaaactttctatgctgaggaatgcaacatggactctctcaaacttttgtcggggaaagccccagcctccctttgatctggttaaacctgcacttcctgcattgacacaccttattcattcgaatgatgaagaagtcttaactgatgcatgttgggcgctctcatatctttctgatggtacaaatgacaaaatccaagctgttatagaagcaggtgtttgtgggcgtctggtggagctcttgatgcacccatctccttcagtgctaatacctgctcttcgcacagttggaaatattgtcacaggagatgatggtcaaacccagtgtattatcaatcatcaagtgttgccatgccttctaaacctcttgacaaataatttcaaaaagagcatcaagaaggaagcttgttggacaatctcaaatatcacagctggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgtaacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagttctcgagacatattggttggaggaggaggatgagacaatgccgccaggtgatgcctctcaaacagggtttcattttggcgggggtgagcttcctgttccttcagggggattcaatttcagctagaggtatgtagtgctgctgtttgcatgcatttgtttttgtgttggtgcactagtgggagcgtgttatgtcgtttgagatgggactgcatatctgactaccatttgtatgcttttgagctataaaagctgttagtattccaggatttatctggtccagtattgaagtccttatggagatgatgggacaatagttttgggggggggggttccagttgaggcatctagtctttgggttgtgtccacagtcgggtatggtcgaaggtacagtgtgaatggtagtgggctggcgtgggttaacagcacagccaggttcatattatgcatgaagtgggaatggagacagaatagagcttggacagtaaattgaggaacccagactgagtctatatttaatggtcgtaaaacaaatatattgtgtctttgcaattgcaaaagcttggtttgatgattttggcatatgcccagagcagttatgattcacaggggaatatgcttttgtaactatgtaaatccgaacgactccagttagattgttttatatgttgctttgaagtggaaatagacatatataattgttggtttgaagaaagaaaaaagtaccgactgcg

SEQ ID NO: 886 - DNA, 2351 bp, Cucumis melo
ccaatttctccctctcttcttctccggcgaaccaaatccttaatcctcatcggagcatcgtagatttcctctactaatcgggaaggggtttgagttcaaatcatgtcgcttagacccaacgagagggctgaggttcggcggaaccggtacaaggttgcggtggatgctgatgaaggtcggagaagaagggaggataatatggttgagattcggaagaatcgaagagaggagagtctgcagaagaaaaggcgtgagggtcttcaagcccagcaactccaaacttccactcactcatcggcagtagaaaagaagttggaacatcttccttccatggttgcgggtgtttggtctgatgatggtagtctgcaacttgaatccactactcagtttaggaaacttctttcgattgagcgtagtcccccaattgaagaagttatacaggcaggagttgttcctcgttttgttgaatttctaatgagagaggattttccacaacttcagtttgaagctgcttgggctcttacaaacattgcttcgggaacatcagaaaacactaaggtggtcatcgatcatggtgctgtgccaatatttgttaagcttcttggttctccaagtgatgatgtccgggagcaggctgtatgggcattaggaaatgttgctggggactcctcaagatgtcgtgatttggttttaggtcatggagcattgcttcctttattagcacagttgaacgagcaagctaagctttctatgctgagaaatgctacctggacactatcaaatttctgcaggggcaagccacaacctgcttttgatctggtcaaaccagcacttccagctcttgctcgtcttatacattcaaatgatgaagaagttttgactgatgcttgctgggcactttcatacctttctgatggtacaaacgacaaaattcaagctgttattgaggcaggtgtttgccctcgtctcgtcgagctcttaatgcatcctgctccttctgtgcttattcctgcccttcgaactgttggaaacattgttactggtgatgatttgcaaactcaggttattatccaacataatgccctaccttgcctgctaaatttattgactaataatcataagaagagcatcaagaaagaagcttgctggactatatctaatataacggctgggaacaaggcgcaaattcaggctgttatagatgccaatatagttgctccccttgttcatctgctccaaaatgccgaatttgatattaagaaagaggctgcatgggcaatctcaaatgccacatctggaggctctcatgatcagataaagtacctagtaaatcaagggtgtatcaaacctctgtgcgatcttctaatttgccctgatcctaggattgtcacggtttgtttagaagggctcgaaaatatcttgaaggtaggagaagctgaaaagaacacaactgatacaggaggagttaatctttatgctcaattgattgatgatgctgaggggctagagaaaattgagaatctacagagtcatgacaacactgaaatttatgagaaggcagtgaagatcctcgagacttactggttggaagaggaagacgagactatgccaccgggtactgctccccaaggaggattcaattttggtggcgatcgacctgtcgtaccatccgggggattcaactttggctgagaaggcttttttcgaggctatttcgaccacatctccagtcacatcgggtcaggtcaggcgtgttatgtcgttgtttgcctttgcttatcccagtctcagttatattttagcgtgttggttgactgggttgaatgctttttacatgagtttgggattgactggtgatgagacagtggaatatatatatactatatcaattggtaatatagtttccacagatctgagaaatcagagcgatttcgtttgggcaaactgtgattttttattgttttttcttagttggtctacttgtcagaaacatggagtctaagcattgtttgttccctccctttttacgtcattacgcttctatattttttttgttcatagttttttccatagagcaacttttagatttatagcagataccattttggctagctggcttctatatgttgttacttttaaacaacacatgcaaggaagtttggtactattctcattgatgattactcttttttgttacatgccttgaaaaaatcttgatatttcactcttaaccaaaagtccactgcctttttctttaacaatgttgtattgatacattacacaaatctgagagaaggctttttgggaaaaagaataggttgaaccttgaattggatcaaaaaaaaaaaaaa

SEQ ID NO: 887 - DNA, 2333 bp, Populus trichocarpa
tcaactttcaaaaaatcaaacaaaatcctcaattaattgttcgattgattgcttaatccttcaaccaactcgctaatccaaaataatcatcgtattagctaatcctttaatccgaatcgatgtcgttgaggccaagtgcaaggaccgaggtccgccggaacaggtacaaggtggcggtggatgcggaggagggaaggcggaggagggaggataacatggtggagatccgtaagaatcggagagaagagagtcttcaaaagaagagacgtgaaggacttcaggctcaagccatgcctgctagtctccactcttctgctgctgagaagaagttggaacatctgccatcaatggttgcgggtgtttggactgaagatggtaatctgcaattggaggcaaccactcagttcaggaaattactttcaattgagcgcagccctcctattgaggaagttatacaagctggtgttgttcctcgatttgttcagtttcttatgagggaggacttcccacaattacagtttgaagcagcttgggctctcacaaacattgcttctggaacatctgagaacaccaaggtggtgattgatcatggggctgttcctatatttgtacagcttcttgcttctccaagtgacgatgttcgtgagcaggctgtgtgggcattgggaaatgttgctggagattctcctagatgccgtgatcttgtccttggcaatggagctttgcttcctttactggcacaattaaatgagaatgccaaactttctatgctcagaaatgctacatggacactctcaaacttttgtcgaggcaagccacaacctccttttgatcaggttaagcctgcacttccagctcttgcacgccttattcattctgacgatgaagaagtcttaactgatgcatgctgggcactctcatatctctctgatggtacaaatgacaaaattcaagctgttatcgaagcaggagtatgtccacggctagttgagcttctgctgcacccatctccttcagttctgattcctgctcttcgcactgtgggaaatatcgtcactggggatgatatgcagacacagtgtatcatcaatcatcaagcgctgccttgccttttgaacttgttggccaacaattataaaaagagtatcaagaaggaagcttgttggaccatctctaatataacagctggtaacaaggagcagatccaggctgttattgaagctaatattatcggtccacttgttaatctgcttcaaaatgctgagtttgacatcaagaaagaggcagcatgggcaatttcaaatgctacatctggtggtgcccatgaacaaatcaagtaccttgtcagccagggttgtatcaagcccttgtgtgaccttctcatttgcccagatccaaggattgtaacagtctgtttagaaggccttgaaaacatcttaaaggtaggagaagctgacaagaatgtgagtgaaactggaggtgtaaatctctatgctcagatgattgatgatgctgaaggattggagaaaattgagaatctacagtcgcatgacaacactgaaatatatgagaaggcagtgaagattcttgagacatattggttggaagaggaggatgaaacaatgccaccaggagatgcttcccaatctgggttccaatttgggggtgaggctcctgctgttccctctggcggattcaacttcagctaaaggagttttagctgcaggctccattgaagtcctcgaggagtgtggtgagatggtcgtcaggttcaggtcaggtgtcttggtgtcatgtttggtctatctctggtttcgggtagtggttgatagggtgttggactggcttgcgtttcattatggccagtgtaatacgttgcgggaagagaaatgaatgtgattggtggcatgattgaacttgggtttccatgtctagaatattttgggaaacctgagttcattttaaagggagttgttatcccaggagactggggtcttataaaaaggacatggagtctctctctcagttttttttttttaatatttctattgtcctagtcttcatggtagcatctctgcttcccttttcatagtgttaatttttggcactcagaaaatctttatattgccatgcttgtagtttcaaggaatattggaatgatgtttcctttacattgtaagagtcggttgcaaagatacgagtctcctagctgttttctaggatatatacagtgtactggcttgttatttcaaagtgtcaaaaactcttatattgaagggaaatgttgaactgctatcagtattgatttattattttgatttcaccgttcacca

SEQ ID NO: 888 - DNA, 2627 bp, Abies balsamea
aggagcaactatgtctctcagacccatgtcaaggaccgaggttcgaaagaagacctacaaggtggccgtcgatgcagacgaggcccgaaggaagcgagaggataatatggtggaaatcaggaagaataagagagaggagagtctccagaagaagagaagggagggtatgcaggcgcaacagtttccgcccaccgtgcaatcaaccgccgttgaaaagaagttggagagtcttcctgccatggttgcaggagtatggtctgatgaacctaccctgcaactggaggcaacaactcaatttcgcaagttgctttcaattgagcgtagtcctcccatagaggaagttattgatgcaggcgttgttccacgttttgtcgatttcctgacgaggcatgattttccacagcttcagtttgaagcagcatgggctttgacaaacatagcttcaggaacatcagagcatacacgagttgtgattgagcgtggtgctgtaccaatatttgtacagctgctaagttcaccaagtgatgatgttcgtgagcaggctgtatgggcattggggaatgtggccggtgactcccccaaatgcagagatctggttctcagccatggtgcattgccgccacttcttgcccaactgaatgagcatgccaagctttcaatgctgagaaatgctacttggactttatctaatttttgccgagggaaaccacagccagcattcgagcagacaaagccagctcttccagcacttgagcggcttatccattctaatgacgaagaagtcctaactgatgcttgctgggctctgtcttatctctctgatggaacgaatgataaaattcaagctgttattgaagctggtgtctgtcgaaggcttgttgagcttctgctccatccatcaccatctgttcttatccctgctctccggactgtgggcaatattgtaactggggatgatgtacagactcagtacattatcaacaatcaagcccttccctgcctcttggcactgttgactcataaccataagaaaagtataaagaaggaagcatgctggaccatatcaaacataactgcaggaaataaagatcaaatacaggctgttatcgatgcgaacatcattcctcctcttgtgcagttgctgcaaactgctgagtttgatatcaagaaagaagcagcatgggctatatctaatgctacatctgggggtacacatgaacaaatcaaatatcttgtgaatcaagggtgcattaagcctctatgtgaccttctagtctgtccagacccaagaattgtaactgtttgtcttgaggggctggagaatattttgaaagtcggagaagcagagaaggacctagggaacactggaggggtgaatctctatgctcagtttattgatgatgctgaaggactcgagaagatagagaacctgcaaagccatgataacaatgaaatttatgagaaggcagtgaagattcttgaaacgtattggctggaagatgatgaagatgaccaggcattacctgctactggagaggctgcgcaaccagcattcaattttggttcaaatcaaccgactgttccttctggtggattcacttttggttgaaaaggaatttcagctgctgcaacctggggggtgatgccatgggtgttttaaagcaattattccaaggccttataactacattgtagtcgtcagtcgtatgcaagcaaatgcatggtttttggatgtcactggtggcaggggatttctgttggtatgtcattatgacagtactagctaaatcgtgcaaatataagctcctcattttgaatgggttggccttagttggcgtggtggtacagttttcatgctgtactagtatggtggtctttgtccataagtcataaaattgcatagttagataaatggactcttatctgatgagccttctgatcttcatagcgctaagcttgagcttattgatgtatgggtatttagacgaagcagtgtgatgggtcatcaagttttctgtcgtcatactaactgcctggttctacttgcatttgttcttcattgcatcaaagagtctgtcctaagtcggtcttgtggccagtaaatggtcctactaacatactgttcctggataatcctggaacctgtgagaagtgcatgtaatcatgtgttctcctattctcctctggggttttgcccagatttttctttggatgttcacgttctagtgagtcctctgacccttctctttctctccctctttctcaccccaaaaatgcggatgagattagagaaaatcgtgtcttttggaagtctggcgggatttcctcaaatggtacattctgagcgtctcagacccctcctgttgccagtggtcactctattttggtagttgaaacttttattgaatcattttatgcacttgcaatatttgtctccagactggagacttttgctatgtaattttttagaattctattgccaatgaatttgaaggtcttttatcaactattttaaatgtctgggtaaaaataaatctcgtgttttttagtatcatatttggattgttttatacaatatttgctgaatgtatcgtgtactgtattgaaaggaaggtagatttgttggt

SEQ ID NO: 889 - DNA, 2839 bp, Pinus taeda
tttccattgagtaagcggtcgtctttcgtagggagaacttcagacgattttcaggcgttttcggggtatattaggtttttttttagtagcagccatgtctctcagacccatgtcgcggactgaggtccgaaagaagacgtacaaggtggccgttgatgcagatgaggcacgaaggaagcgagaggataatatggtcgaaatcagaaagagtaagagagaggagagccttcagaagaagagaagggagggtatgcaagcgcagcaatttgcacccaccgtgcaatcgtctgccgttgaaaagaagttggagagtcttcctgctatggttgcaggagtatggtctgatgaaccaaacctgcaacttgaagcaacaacccaattccgaaagttgctttcaattgagcgtagtcctcctatagaggaagttattgatgcaggtgttgttcctcgctttgttgaattcctgacgaggcatgattttccacagctgcagtttgaagctgcatgggctttgacaaacatagcttcaggaacatcagagcatacacgagttgtgattgaccgtggagctgtgccaatatttgtacagctgctaagttcaccaagtgatgatgttcgtgagcaggctgtttgggcattgggaaatgtggctggtgactcgcctaaatgcagagatctagttctcagccatggtgccctgatgccactccttgctcaactgaatgagcacgctaagctttctatgttgagaaatgctacttggaccttgtctaatttctgtcgaggcaagccacaacctgcatttgaccagacaaagccagctctaccagcacttgagcgtctgattcattcgaatgatgaagaagtcttaacagatgcttgctgggctctgtcctatctgtctgatggaacaaatgataaaattcaagctgtgattgaggctggcgtctgtcgaagattggttgagcttttgcttcatccatctccatctgttcttatccctgctctccggactgtgggcaatattgtaactggagatgacgtacagactcagtacattatcaacaatcaggcacttccctgcctcttggcactgttgacccataatcacaagaaaagtatcaagaaggaagcatgctggaccatctcaaacataactgcaggaaacaaagatcaaatacaggctgttatcgatgcaaacatcattcctcctcttgtacagttgctgcaaactgctgagtttgatatcaagaaagaagcagcatgggctatatctaatgctacttctggtggtacacatgatcaaatcaagtatcttgtgaatcaaggatgcatcaagcctctatgtgatcttctagtctgtccagacccaagaattgtaactgtttgtcttgaagggctagagaatattttgaaagttggggaagcagagaaggacctggggaacactggaggtgtaaatctctatgcacagtatattgacgatgctgaaggacttgagaagattgagaacctgcaaagtcatgacaataatgaaatttatgagaaggcagtaaagattcttgaaacttattggctggaagatgatgaagatgaccagacgttacctgccactggagatgctgcacaaccaacattcaattttggtgcaaatcaaccaacagttccttctggtggattcacctttggttgaaaaggaatttcagctattgcaacccgggggcgatgctgtgggtgtttcaaagaaaatattccaaggccttattactacactgtagtcagtcgtatgcaagcaaatgcatggtttttggatgttactggtggcaggttacttctgttggtatgtcattatgacagtactaacaaaatcgtgcagatataagctcctcattttgaatgggttggccttagttggcttggtggtacagtctccatgctgtactagtaaggtggtctttgtccataagtcataaaattgcatggttagataaatggactcttatccgatgagccttctgacctttaacgctcaatgcttgagcttattgatatgttgccaagttgaatgccaacttctgggtgtttagacgaagcagtttgatgcgtcatcaaggctcatggtaatactaattgcctggttctacttgcatgtgtcctccatttcatcaaagagtctttttcatcaaagagtctgtcccatatcggtcttgtggctagtaaatggccttactaacatacttttctgggataatcctggaactgtgagaagtgcatgtaatcatgtgctctcttcttctcctctggcattttacccagagtttgcattggatttttcacgttcaagtgagtcctgatccctctctccccttctctttcttttgacaaactttggatgacccagagttttgttcggatttccactttcaagtgagtcctatgacccttttttctccctctctttctcgtgctaaactgtagacgagaatagagaaaattgtctcttggaagtctgataggatttcctcctcatacggtacattctgtgtctcagacccctcctgttgccagtggtcattctattttggtagttgaaacttttattaaatcattttatgcactcgcaatatttgtctccggacttggagactgttttgctatgtaattttttagaattctattgttaatgaatttagaggccttctatcaacgtttttatatgtttggataaaataagctcgagttttgagatcatgttgggattgttttataaaatatgtctatgcatctgaatggcaatacttggtcctcaacattctaatgtgtttcacaaacggtctgc

SEQ ID NO: 890 - DNA, 2678 bp, Taxus baccata
taggttcgaatcccagaagattagggtttttctctgtgcgagtttttagggtttgaatcatctgctatattttgagcagattagggtttgtagggtttgaagctccttattttgggcgttggattgtggattgtttggattgtttcagccatgtctctcaggccggtttcgaggactgaggtccgcaggaagaactacaaggtggctgtggatgccgatgaagcgcgcaggaagcgtgaagacaatatggtggagatcagaaaaataagagggaagaaagcctgttgaagaagaggagagagggtatgcaagcgcagcagttcgctcccgccgtgcagtcatcggccgttgaaaaaagttggagagccttccagccatggttgctggagtgtggtcagacgatcctgcattgcagcttgaagcaacaactcaattccggaagctgctttcaattgagcgcagtcctcccatagaggaagttattgaagcaggtgtggttccacgatttgtggagtttcttacaaggcaggactttccacagcttcagtttgaggcagcatgggcattgacaaatatagcttcggggacatctgagcatactagagtagtcattgaccatggagcagttccaatttttgtacaactccttagttctccaagtgacgatgttcgggagcaggctgtctgggcgttgggtaatgtggctggtgactcccccaagtgcagagatctagttcttactcacggtgctcttatgccacttctagctcaattgaatgagcatgccaagctttcaatgttgagaaatgcaacatggactctatctaatttttgccgaggcaaaccacaaccagcgtttgagcaaacaaagccagcactccctgcacttgagcggcttattcattcaaatgatgaagaggttttgacagatgcttgctgggctctgtcttatctctctgatggcacaaatgataaaattcaagctgtaattgaggctggtgtctgtcgtaggcttgttgagcttctgctccatccctctccatctgtacttattccagctctcagaacagtgggcaatattgtaactggtgatgatgtacagactcagtatatcatcaacaaccaagcactcccttgcctcttagctctcttgacccataatcacaagaagagtattaagaaggaagcatgctggaccatctcaaacatcactgcaggcaacaaagaacagattcaggcagtgatcgatgcaaacatcattcctccccttgtccagctccttcaaactgccgaatttgatattaagaaagaagcagcatgggctatatcaaatgcaacttctgggggtacacatgaacagattaagtatctggtgaatcaaggatgcatcaagcccctgtgtgatcttttagtctgtccagacccaagaattattactgtttgtcttgaaggtctggagaacattttgaaagttggggaagccgagaaggaccttggtaacacttctggtgtgaatctatatgcccagtatattgatgatgctgaaggactggagaagattgagaacttgcagagtcatgataacaatgaaatttatgagaaggcagtgaaaattttggaaacttactggttggaagatgaagaagatgatcaagcattgcctgcaagtggagatgctcgcccccccagcattcaatttcggtacaaatcaaccatcagtgccatctggtggattccagtttggttgaggaggtatttgagctgttgcaagttggggggctatgttatgagtgtcttgaatgactttccaagattgtgtatctgtgctgtagtccgtcattgcaaggataatgcttggtttctggatggtgctggtgacaggccaattgttggtatgtcagtctgacaatactaaccaaatcatgcagacatgagctcctcgaaactaatgagtcagcctcatttggcttggtagtacagtgttcatgctgtattatatggactgtccgagccaccttctgccctttagagctctgtatcagagcttactgctgtcttgagtcatgtgccatgccttctggtttttgcacaatccctttaacaggtctcaacggtcatactaattcttgttatgtatgcattgtactcttcattgcatcaagaaagttgtcatatctggtattgtgacacaagtcagtctcatggtctgggaaaatggcctacactactaaccttgggttgcaggacaatcctaaatcccaaaagcatgcatgtctatcatgcatgctcatattctccaggaattttgcctggagttttttttggatcatcgatttctaagttgatgatcactgacccccatctctctcatcctcttataatgtgtcaatctgtgcatcattttccattgctccatcttcttctggaaaccccgtttgaagggatttcttacttatttgttactttgtcagtgtgtcctctacatcccgttgccagtggtcattctattaaggttgctatacatcttttttggacagttctatgtacttgcatgtatatttgtttccaaataatttttggagactattttgccaattgtcagtagttactggtaatgaattgaaagattactgttcacaatggtatatttaaaaaagatatctggaattgggatatgg

SEQ ID NO: 891 - DNA, 2004 bp, Aquilegia formosa
cttttcgaaaacacaacactctctctttctctttctctaaggtattctaaggtgtagcgatgtcgctcagaccaaacgcgagaactgaggttcgaaggaaccgatataaggttgctgtagatgcagaagaaggaagaagaaggcgagaagataatatggttgagatccgaaagaataaaagagaagaaagcttgcagaagaagagaagagaaggaatgcaaccacagcaatttcctgctgcgttgcacgcttcgaatattgagaaaaagttagaaagtcttcctgttatggttcaaggggtatttgcagatgataaccagttgcagcttgaggcaactactcagttccgaaagctactatcaatagagcgaagcccaccaattgaggaagtgattcagtcaggtgttgtacctcgctttgtcgagttccttatgagagaagattttccacagcttcagtttgaggcagcttgggctcttaccaatattgcttcgggaacctcggacaacactaaagttgtaattgatcatggtgctgtccctatctttgttaagcttcttggttctcccagtgatgatgtcagagagcaggctgtttgggctcttggtaatgttgctggggattctcctagatgccgagatctggtcctttcgcatggtgcattgatcccactgctagctcagttgaatgagcatgctaagctttctatgttgagaaatgcgacttggaccctatccaatttctgcaggggcaagccacagcctccttttgatcagacaaaacctgcacttccagctcttgaaagacttatccattcaaatgatgaagaagtactaactgatgcatgctgggcactttcatacctctctgatggtacaaatgataaaattcaagctgttatcgaagcaggtgtttgtcctcggcttgtggaacttcttctgcatccttcgccttcagttctcattcctgccctgcgtacagttggaaacattgttacaggagatgatgtccagacccagtgtattatcaatcatcaagctcttccatgcctcttaaacctgttgactcacaatcacaagaagagcattaagaaagaagcttgctggaccatttccaacatcacagctggaaacaaggatcaaatacagtccgtgattgctgctgatattattggtcctcttgttcatctcctacaaactgctgagtttgatatcaagaaagaagctgcctgggctatctcaaatgctacatctggtggtactcacgaacagatcaagtaccttgtggtccagggttgcataaaaccattgtgtgatctacttgtctgccctgatccaagaatagtcactgtctgtttggaaggactagagaacatcttgaaggtcggagaaactgaaaagtccttgggcaacactggaggtgtcaatgtctatgcccagtatattgacgaggctgaagggttggagaagattgagaatctacaaagtcatgataacactgaaatatatgagaaagccgtgaagattcttgaaacctattggttagaagaggaggatgagccattgcctccaggtgatgctgcacaaactgggttccgatttggggggagtgagattccttctggtggattcaactttggttgaaggtgtggatggctgtcgtgtgaagcactgtcgagtgcaggcaaaggagagtcctttttatttattatgttttcatgtaggggtagttactgcaaagtcggtcgggatattgttgtttcgagttcttgtagtccgatgcagccttggctagtgtatagctaggagggaaatacaggaaagagtttttattatggttttgttgtcaagttgattcttggaattaagtcttcattttgttttgaagggtaatgttccttccagttctatgaaagatatatatgtagattatgtcaaaccttactggatgatgaaagttaatagtatcatttccatttgttagcttgttacaagtctttttcag

SEQ ID NO: 892 - DNA, 2209 bp, Cucumis sativus
gaaaaaaaaaaggaaaaagaaaacttcgtaccaatttctccctctcttcttctccggcgaaccaaatcccttaatcctcatcggagtatcgtagatttcctttactaatcggggagaggggggtttgagttcgtctctttggtattcaaatcatgtcgcttagacccaacgagagggctgaggttcggcggaaccggtacaaggttgcggtggatgctgatgaaggtcggagaagaagggaggataatatggttgagattcggaagaatcgtagagaggagagtctgcagaagaagaggcgtgagggtcttcaagcccagcaactccaaacttccactcactcatcggtagtagaaaagaagttggaatatcttccttccatggttgcgggtatttggtctgatgatggtagtctgcaacttgaatcgactactcagtttaggaaacttctttcgattgagcgtagtcccccaattgaagaagttatacaggcaggagttgttcctcgttttgttgaatttctgatgagagaggattttccacaacttcagtttgaagctgcttgggctcttacaaatattgcttcgggaacatcagaaaacactaaggtggtcatcgatcatggggctgtgccaatatttgtgaagcttcttggttctccaagtgatgatgtccgggagcaggctgtatgggcattaggaaatgttgctggggactcttcaagatgtcgtgatttggttttaggtcatggagcattggttcctttattagcacagttgaacgagcaagctaagctttctatgctgagaaatgctacttggacattatcaaatttttgcaggggcaagccacaacctgcttttgatctggtcaaaccagcacttccagctcttgctcgtcttatacattcgaatgatgaagaagttttgactgatgcttgctgggcactttcatacctttctgatggtacaaacgacaaaattcaagctgttattgaggcaggtgtttgccctcgtctcgtcgagctcttaatgcatcctgctccttctgttcttattcctgcccttcgaactgtgggaaacattgttactggtgatgatttgcaaactcaggttattatccaacataatgccctaccttgcctgctaaatttattgacaaacaatcacaagaagagcatcaagaaagaagcttgctggactatatctaatattacggctgggaacaaggcacagattcaggccgttatagatgccaatatagttgctccccttgttcatctgctccaaaatgccgaatttgatattaagaaagaggctgcatgggcaatctcaaatgccacatctggaggctctcatgatcagataaagtatctagtaaatcaaggttgtatcaaacctctgtgcgatcttctaatttgccctgatcctaggatcgtcacagtttgtttagaagggctcgaaaatatcttgaaggtaggagaagctgaaaagaacacaactaatacaggaggtgttaatctatatgctcaattgattgacgatgctgaggggctagagaaaattgagaatctacagagtcatgacaacaccgaaatttatgaaaaggcagtgaagatcctcgagacctactggttggaagaggaagatgagactatgccaccaggtactgatccccaagctggattcaattttggtggcgatcgacctgtcgtaccatctgggggattcaactttggctgagaaggctttccccgaggctatttcgacaacatctccagtcacatcgggtcaggtcaggcgtgttatgttgttgtttgcctttgcttatcccagtctcagttatattttagcgtgttggttgactgggttgaatgctttttatatgagtttgggattgactggtgatgagacagtggaatatatatatactatatcaatcggtaatatagtttccacagatctgagaaatcggagcgatttcatttgggcaaactgtgattttttattgttttttcttagttggtctacttgtcagaaacatggagtctaagcattgttttttccctccctttttacatcattacgctcttatatttttttgttcatagttttttccgtagagcaacttttagaattatagcagataccattttggctagctggcttctatatgttgttacttttaaacaacacatgcaaggaagttt

SEQ ID NO: 893 - DNA, 2148 bp, Populus trichocarpa
ctctctaactttcaaaaatcaaacaaaaacctcaaatccccatttctctctctctctctccccttctctctctctaaaaccctcagttgattgtttgatttatcgcgcaatcactcaatcaagtcgccaatcaaaataataatttaattagttattcaattaatctaaaacgatgtcgttgaggccgagcgctaggactgaggtccgccgtaacaggtacaaggtggcggtggatgcggatgagggacggcggaggagagaggataacatggtggagatccgtaagaatcggagagaagagagtcttcaaaagaagagacgtgaaggacttcaggcacaagccatccctgctgctcttcactcttccgctgctgagaaaaagttggaacatctgccatcaatggttgcgggtgtttggtctgaagatggtaatctgcaactggaggcgaccactcagttcaggaaattactttcaattgagcgcagcccgcctatagaggaagttatacaagctggtgtcgttcctcgatttgttcaatttcttatgagggaggatttcccacaactgcagttcgaagctgcttgggctctcacaaacattgcttctgggacatcagagaacaccaaggtggtgattgatcatggagccgtccctatatttgtacaacttcttggttctccaagtgatgatgttcgtgagcaggctgtttgggcattgggaaatgttgctggagattctcctagatgccgtgatcttgtccttggccatggagctttgcttcctttgctggcacaattaaacgagaatgccaagctttccatgctcagaaatgctacatggacgctctcaaacttttgtcgaggcaagccacaacctccttttgatcaggttaagcctgcacttccagctcttgctcgccttattcactctaacgatgaggaagtcttaactgatgcatgttgggcactctcatatctctctgatggtacgaatgacaaaattcaagctgtcattgaagcaggagtatgtccacggctaattgagcttttgctgcatccatctccttcggtcctgattcctgctcttcgcactgttggaaatattgtcactggggatgatatgcagacacagtgtattatcaatcatcaatcactgccttgccttttgaacttgttgaccaacaattataagaagagcatcaagaaggaagcttgttggaccatctctaatataacagctggaaacaaagagcagatccaggctgtaattgaggctaatcttatcggtccacttgtacatctgcttcaaaatgctgagtttgacatcaagaaagagtctgcatgggcaatttcaaacgctacatctggtggtactcatgaacaaatcaagtaccttgttagccagggttgtatcaagcccttatgtgaccttctcatttgccctgatccaaggattgtaacagtctgtttagaaggccttgaaaacatcttaaaggtaggagaagccgacaagaatgtgagtgacactggaggtgtaaatctttatgctcagatgattgatgatgctgaaggattagagaaaattgagaatctacagtctcatgacaactcagagatatatgagaaggcagtgaagattctcgaaacatattggttggaggaggatgacgagacaatgccaccgggtgatgcttcccaatctgggttccaatttggaggcgatgctcctgctgttccctctggtggatttaacttcggctaaaggagttttagctgctgctccattgaagtgtgatgagatggttcaggtcagatgtcttggtgtctcagtgatgagattgttgtcaggttcaggtcaggtgtcttggcgacccggtggtgagatggttgtcaggttcaggtcaggtgtcttggcgtcatgtctggtctatctccggtcccgggtgatagggtgttggactggcttgggtcttaccaaggccgggagagagaaatgtggttggtggcatgattgaccttgggttttcatgtctagaatattttgggaaacctgagttcattttaaaagtagttgtcctaggagattgggctctcttataaaacggatgttgagtcttttttcgtttaaaaatattcttcttttgtccc

SEQ ID NO: 894 - DNA, 1753 bp, Lactuca sativa
aaagttttcttttcggcccgccgttctctctccttctctctctccggacggaaaagaccaaaccctcactcgctctttatataccagtgtccgcgctacagtacatacgaaggatctaaatcgtttctgaaactcaggtctagggttttctctttttgctactagttgtaaccatgtcgctgagacctagcgccagaacggaagttcgccggaaccgatacaaggttgcggtcgatgccgaggaaggccgccggaggagagaagacaatatggtcgagatccgtaagaatcggagagaagaaagcttgcagaagaagagacgcgaagcactcactggtagccagttcgccgtgcccgttcagtccgcttccgccgccgaaaagaagttggaaaatcttcctgccatggttgccggagttttctctgatgataacaatatgcagcttgaggccactactcaattccgtaaacttttatcaatagaacgcagccctcccattgaagaagttattcaatctggtgttgttcctcgctttgttgagtttcttgtaagggaggatttcccacaacttcagtttgaggctgcttgggctttgactaatattgcttcggggacatctgaacacacaaaagtggtgattgatcatggcgctgttccaatatttgtgaagcttcttgcatctccaagtgatgatgttagagaacaggctgtatgggctttaggaaatgttgctggtgattcccctaaatgtcgtgaccttgtacttgcacaaggtgctttgattcctctactatcccaattaaacgagcatgctaagttatccatgttgcgaaatgccacatggacactttcaaatttttgcagaggcaaaccacagccttctttcagtcagacaaaacctgcacttccagctttacagcaacttattcattcaaacgatgaagaagttttgacagatgcttgttgggctctttcatatctttcagatggcacaaatgataaaatccaagctgttattgaagcaaatgtatgtccaagattggttgagctactgaatcacccttctccatctgtccttatccctgctcttcgtactgttggtaacattgttacaggagatgatatgcaaactcagtatataatcaatcatcaagctttgccttgtcttctcaacttgttgaccaataaccacaaaaaaagtattaagaaagaagcttgttggactatatcaaacatcactgctggcaacaaggagcagattcagacagtcattgaagcaaatatcattggccctcttattcatctgcttcaaaatgcagaatttgacatcaagaaggaagctgcatgggccatttcaaatgctacttctggtggaagccatgaccaaatcaagtatttggttgctcaaggatgtataaaaccattgtgtgatttactgatatgtccagacccaagaatagtgacagtttgtttggaaggtcttgagaatatattaaaagttggtgaagcagaaaagaatttgggaagatcaggagatgtgaatctttatgcacaaatgattgatgatgcagaaggtttggagaagattgagaatctacagagtcatgataacaatgagatttatgagaaagcagtgaagcttctcgagacgtattggttggaggaagaagatgatgctatgccacctggcgatgccgcccgcactcagcctgctgggcgctttcattttggtggtggtgatgtttcggttcc

SEQ ID NO: 895 - DNA, 2238 bp, Eucalyptus grandis
ccatgtcgctgcggcccaacgcgaggacggaggtccgccggaaccgctacaaggtggcggtcgacgccgacgaggggcggcggcggcgggaggacaacatggtggagatccggaagagccgccgggaggagagcctgctgaagaagcgacgcgaggggctccaggcgccgcaggcctcgccctcgctccactcctccgccgtcgagaagaagttggaaaatctacctagcatggtggctgctgtattgagcaatgataaatctttgcaagttgacgcaaccacgcagtttagaaagctgctttcaatagaacgcagcccgcctattgaggaggtgattcaatcaggtgtcgttcctcgctttgtcgagtttctcatgaaggaggacttccctcaacttcagttcgaagcagcttgggcactgaccaacattgcttctggtacatctgagaatactaaggtggtaattgatcatggagctgttcctatattcgtgaaacttcttcgttctcctagtgatgatgtgcgtgagcaggctgtttgggctctaggaaatgttgccggtgattctcccaaatgccgcgacctggtacttttaaatggtgccttgcttccattgctggcacaattgaatgagcatgcaaagctttctatgctgaggaatgccacctggacgctttcgaacttctgtagagggaagccccagccactttttgagcaggttaagcctgcacttccagcccttgcacatcttatccattcaactgatgaagaggttttgacggatgcttgttgggctctatcatacctttctgatggcacaaatgataaaattcaagccgtgattgaagctggtgtatgtcctcgtcttgtggaactactgcttcacccatctccatctgtgttgattcctgccctccgcacggttggaaatatcgtcactggagatgatctgcaaacccagtgtgtcattgagcatcaagcactcccctgccttctgaacctgttgactggtaattataagaagagcatcaagaaagaagcttgctggacaatctcgaatattacagctggtaataaggaacagatacaggctgtcgttgaggctgatattattggtccaatggtacaactacttcaaaatgctgaattcgatataaagaaggaggctgcatgggcaatctcaaatgccacatctggcggttctcatgaacaaatcaagttcctagtaaatcaaggatgtgtcaagcctttatgtgatcttctcatctgccctgatccaaggattgtgacagtttgtctagagggtttggagaatatcttgaaggtaggagaagctgagaaaaatcttggcaacactggtgatgtaaatgtctatgctcagatggttgaagatgtggagggcttggagaaaatcgagagcttacagtctcatgacaacaatgagatttatgagaaggcagtaaagattctcgaagcatactggttggaagaagatgacgatgcgatgccaccaggtgatgcccctcaaccagatatgcaatttggagggaataatctgcctcccatgccatccggtggatttaagtttggttagaggattaaagttgggtcctggtcggttacgcgtcgagtctgggtcatggttgagtcaagtctgggtcgtggttgagtcgagtcttaggggcaagatcaagtaggtgcttgaactagcctcaggttccgagtctctggaagcaggtgagagaagttggatattgcgctccttattgaatggttcatttcggatatagtaactcatgaggttattggggggcagcaagtcatccctgacgagctctatcatacataaagcgccactggagtgcctgtttatgtggccatcgcaggaaaggtttcaatgtcacacatgcttagggtcctccacctatctggtcctgtgctgcatgtcgatacccgttgcgttctgtcggagcaatgagttccttgattctttttcttttataagattgattcagtcgggtctttaattagcagcttgaggttgccttgcaatttcttctgcgggttctcaatgtcattatgttgatgcatagtgtttttatcaaacgaatggttctcaagccttcgaagatttcattttttttaccctctttatatgatcatcttcttgcatgattcctgtcaaacaatgtaaaatacgaaatcgacatcttctaatctttgctactcaacttggt

SEQ ID NO: 896 - DNA, 2174 bp, Cucumis melo
caaaacaaaccaaggctcggttcttcttataggatttccaattattgtcgtcgctagggtttttctctataccggcgatcccgatcatttttgaattcctttcaccgaattcccatttctgtgagggtttttgaatccactccaagttaatcgacgaagtagccatgtcgttgaggcctactgctagaaccgaggttcgtcggaaccgttataaggtatccgtcgatgccgaagaaggccgacgccggcgagaggataacatggttgagatcaggaagagtaagcgcgaagagagtcttcagaagaagcgtagggaaggccttcaagcacagcagtttccttctgccgtccacacttccactgtcgagaagaagttagagagccttccgtctatggttgctggggtatggtctgataatagcagtcttcagctcgaggcaacaactcagtttcgaaaattactttcgattgaacgaagccctcccattgaggaagtgattcaatctggagttgttccgcgttttgtagaatttcttgtgagggaggatttccctcaacttcagtttgaggctgcttgggctctcacaaacattgcatctggaacctcagaacacacaaaggtggttattgatcatggtgcagtaccaatttttgttaagctactcgcttctcctagtgacgatgttcgagagcaggctgtttgggctttggggaacgttgctggagattcccctacatgccgtgatcttgttctccgccatggagctttgattccacttctttcccagttgaatgagcatgctaagctttctatgttgagaaatgcaacttggacgctttcaaacttctgcaggggcaagccacaacctccatttgaccaggtaaagccagctcttccagctcttgagcgcttagttcactccaatgatgaagaagttcttacggatgcctgctgggcactctcttatctatctgatggtactaatgacaaaatccaagccgtgatcgaggcaggggtgtgtggacgactcgtacagctgctattacatccttcaccgtcggtcctcattcctgcccttcgcacagttgggaatattgtgactggagatgacattcaaactcagtgtataattaacgatggtgcccttccatgccttctgagcttattgactcacaatcataaaaagagtatcaagaaagaagcttgttggacgatatctaacattactgctggaaacaaggaacagatccaggctgtcatcgaagctggtttaatacctccacttgtcaatttgcttcaaaatgctgagtttgatataaagaaagaggctgcatgggcaatttcgaatgcaacatccggtggaactcatgagcaaattaagtaccttgtcagtcaagggtgcataaaacctttgtgtgatcttcttgtatgcccagatccaaggattgttaccgtctgtttagaggggctggagaacattttgaaggttggagaagccgaaaagaatctgggtaccaatggagatgttaatctatatgcacaaatgattgacgatgctgagggtttagaaaagattgagaatctccagagtcatgacaaccacgagatttatgagaaggctgtcaaaatactcgagacgtattggttggaggaagaggacgaggcattgcccacaactgatggtggtgctcagcctggtttccgctttggtggaaacgaacttccagttccttctggtggattcaactttagttgaaggcttttgaaggatatgtgcggttttggtggtgatactaagggagagtagtacatgtgtcggcgcacaagcttatttgttggggtcaattggattcaattcgggtccaatctggggcatcttaatatcgagtttttagttgggtctggtctcgtccagtttacattgtgttcaaggagatgcttaaaagagggaggagaagagtcaagttcaacgacggccaaaacaatcattcggaaaagtaaaggtaggtcgttttggcaagatgacgtagcatcagtgttcacaaaatatctgcattgcattgtatcatgtaataaaaatgtgctcaactgggcaattatgggtttcatcatataagcatttgatttgtacttagttgggattatgggtctttgctagcgcagggtgttcttt

SEQ ID NO: 897 - DNA, 1869 bp, Euphorbia esula
  misc_feature (190)..(190): n is a, c, g, or t
  misc_feature (311)..(311): n is a, c, g, or t
  misc_feature (498)..(498): n is a, c, g, or t
  misc_feature (541)..(541): n is a, c, g, or t
  misc_feature (717)..(717): n is a, c, g, or t
  misc_feature (1440)..(1440): n is a, c, g, or t
  misc_feature (1646)..(1646): n is a, c, g, or t
attttcatctgccaccaaaaacctctcttatcgatttctctcccgcttcaaatccttcttgatcgttgatcaataatcaatactttcgttgattttacaaagtaaagatgtcgttgaggccaagcgctaggaccgaggttcgtaggaacaggtacaaggtcgccgtcgatgctgaggaaggtcgccgtanacgggaagataacatggtggagatccgaaagaatcgtcgtgaggagagtctccaaaagaaacgcagggagggacttcaatctcagcctatgccggcttctcttcattcatctgctgttganaagaggctggagcatcttccatcaatggttgctggtgtgtggtctgatgatagtaatttgcagcttgaggcaacgactcaatttcggaagttgctatcaatagagcgtagccctccaattgaagaggtcatacaagctggtgttgttcctcgttttgttgagttccttatgagggaggactttcctnagcttcagtttgaagcagcttgggctctcacaaacattgcttntggaacatcagaaaatactagggtggtaattgatcatggagctgtccctatttttgtaaagcttcttgcttctccaagtgatgatgttcgtgaacaggctgtgtgggcattgggaaatgttgctggtgattctcctaaatgccgtgatctagtccttggaaatggagctttgcttnctttactttcacaactgaatgagcatgctaaactctcaatgctaaggaatgctacatggacactatcgaatttctgcaggggcaagccacagccatcctttgaccaggttaagcctgctcttccggcacttgctcgcctaattcattctaatgatgaagaagtgttgactgatgcgtgttgggcactttcatatctttctgatggtaccaatgacaaaattcaagctgttattgaagcaggcgtatgccctcggctagttgaacttttactacacccgtctccttcagttctcatccctgcccttcgcactgttgggaatattgttactggcgatgatatgcagacccagtgtatcatcaatcatcaagcactgccttgcttactgaatttgctgacgaataactacaaaaagagcataaaaaaggaagcttgttggacaatctctaatattactgctggcaacaaagaacagatccagtgtgtaatagaggccaatattattgggccactggttcatttgcttcaaaatgcggagttcgacattaagaaagaagccgcttgggctatatcaaatgctacttctggtggtgcacatgaacaaatcaagtaccttgttagccaaggatgcatcaagcccttatgtgacctgctaatttgccctgatccaaggatcgtaactgtttgtttagagggtcttgaaaacatcttgaaggtaggagaanctgacaagaacttgggcgaaaacggaggtgttaatatatatgcacaaatgattgatgatgccgaggggttggagaaaattgagaatctacagtctcatgacaatacagagatttatgagaaggctgtgaagattctcgaggcatattggttggaagaggatgagacaatgcctccaggagatgcttcccagtctggtttccaattngggggcaatgagatgccagctgttccatccggtggatttaatttcagctaaatggattctcttgctggttctattgggaagcctatggtgggactgttgtcatcttgaggtcaggtgtcttgttgtcatgtttggggtctagcagtccggtcagtctaagttgtgggtcgggagggtactggcctggtccgggtcgtcactagctcaagaattaatacggcgt

SEQ ID NO: 898 - DNA, 2448 bp, Pseudotsuga menziesii
gggttttattcggtagcagccatgtctctcagacccatgtcgaggactgaggtccggaagaagacctacaaggtggccgtcgatgcagatgaggcccgtaggaagcgagaagataatatggtcgaaatcaggaagagtaagagagaggagagcctccagaagaagagaagggagggcatgcaagcccagcaatttgcacccgccgtgcaatcgtccgccgttgaaaagaagttggagagtcttcctgctatggttgcaggggtatggtctgatgaacctaacctgcaactggaggcaacgacccaatttcgaaagttgctttcaattgagcgtagtcctcctatagaggaagttattgatgcaggtgttgttcctcgttttgttgaattcctgacgaggcatgattttccacagcttcagtttgaagcagcttgggctttgacaaacatagcttcgggaacatcagaacatactcgagttgtgattgaccgtggtgctgtaccgatatttgtacagctgctaagttcacctagtgatgatgttcgcgagcaggctgtttgggcattggggaatgtggctggtgattcacccaaatgtagagatctggttctcagtcatggtgccctgatgccactccttgctcaactgaatgagcatgctaagctttcaatgttgagaaatgccacttggactttatctaatttctgccgaggcaaaccacaacctgcatttgagcagacaaagccagctcttcctgcacttgaacggcttattcattctaatgatgaagaagtcttaacagatgcctgctgggctctgtcttatctctctgatgggacaaatgataaaattcaagctgtgatcgaggctggtgtctgtcgaagacttgttgagcttctcctccatccatccccatctgtacttatcccagctctccggactgtgggcaatattgtaactggtgatgatgtacagactcagtacattatcaacaatcaagcacttccctgcctcttggcattgttgactcataatcataagaaaagtatcaagaaggaagcatgctggaccatttcaaacataactgctggaaacaaagatcaaatacaggctgtgatcgatgcgaacatcattcctcctcttgtacagttgctgcaatctgctgagtttgatattaaaaaagaagcagcttgggctatatctaatgctacctccgggggtacacacgaacaaataaaatatcttgtcaatcaaggatgcatcaaacctctttgtgaccttctagtctgtccagacccaagaattgtaactgtttgtcttgaagggctagagaatattttgaaagttggtgaagcagagaaggacctagggaacactggaggtgttaatctctatgctcagtttattgatgatgctgaaggacttgagaagattgagaacctgcaaagtcatgacaacaatgagatttatgagaaggcagtaaagattcttgaaacttattggctagaagatgacgaagatgaccagacattacctgcgactggagatgctgcacagcaaacattcaattttggcacaaatcaacctacagttccttctggtggattcacttttggatgaaaaggaatttcagctattgcaacctggggggcgatgccatgggtgtttcaagtaaatattccaaggccctaactacgtacgctgtagtcagttgtatgcaagcaaatgcatggtttttggatgttactggtggcaggatgtttcggttggtatgtcatcatgacactactaactgaatcgtgcagatataagctcctcattttgaatgggttggccttagttggcttggtggtacagttaccatgctgtactagtaaggtggtctttgtccaaaagtcataaaattgcatggttagataaatggactcatcttatgagccttctgacctttaaagctctatgctagagcttattgatatgttgccgagttgaatgccaaacttttcggtattttggcgaagcagtttaatgggtcattagggttcatagtcatactaactgcctggttatacttgcatgtgttcattgcatcaaagagtctgtcccaagtcggtcttgttgccagtaaaatggccttactaacatactgttccaggataatcttggaactttgagaagtgcatgtaatcatgtgttctcctattattctctggtgttttgcccagggtttgtcttcatctctctctctctcccccccttctttcttgtgctaagctttggatgatccagagtctttttgattttcacgttcaaatgagtcctgtcccttctttctctccctttctctctcgtgccaaactgtggatgagaatagagaaaataatcttttttggagtcctcacgggatttcctcctgaaatgctacactcccgagtgtctcagaccccc

SEQ ID NO: 899 - DNA, 2400 bp, Glycine max
aaaacactcagcaaaagaataaaagaaacccaaaatctctctctctctctcgttcgctttccgtatccatatatatcccaaaccctaccgttaggttccccaattcttcaacaccccgtggaccggtgctctgcttcttagtagttcgtacggtttttccgtcgattgcctccgaaacgatgtcgtatcgcccaagcgggaactccaggaccgaggtccgccggaaccggtacaaggtggcggtggacgcggaggaaggtcggagacggcgagaggacacgatggtggagatccgcaagaaccgcagagaagagagtttgcagaagaagaggcgcgaggggctccaacctcagcagatgcctgcgtccgttcactctagtttggttgagaagaagttggaacatctaccatcgatggttactggtgtttggactgatgataataacctgcagctcgaggcgacgacgcagtttcggaagctgctttcgattgaacgtagtccaccgattgaggaggttatacagactggtgtggtttctcgatttgttgagtttctcatgagggaagactttccgcagttgcagtttgaggcagcttgggctttgacaaatatagcttctggaacgtctgaaaacacaaaggttgtgattgatcacggggctgtcccaattttcgtgaagctacttgcttctcctagtgatgatgtccgcgaacaggcagtgtgggcattaggaaatgtcgctggggattcgcctagatgtcgtgatcttgttctaagtcatggggctttgcttcctttgttggcacaattaaatgaacatgcgaagctttctatgcttagaaatgctacctggacactttcaaacttctgcaggggcaagccacagcctccttttgatcaggttaaacctgcacttcctgctcttgcccgtcttatccattcgaacgatgaagaagttttgactgatgcatgttgggcactgtcatatctttctgatggtacaaatgataaaattcaagctgtaattgaagctggtgtttgtccccgacttgttgagctgctgctgcacccatccccttcagtgctaattcctgctcttcgaactgttggaaatattgtcactggagatgatatgcagacacaggttatcatcaatcaccaggctcttccttgccttctgaatctgttgaccaataattataaaaaaagcatcaagaaggaagcttgttggaccatatcaaacatcacagctggtaataaacagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagtcaagggtgtatcaaacccttgtgtgatcttctcatctgtcctgatcctaggattgtgacagtttgtctggaaggccttgaaaacatcttgaaggtgggagaagctgataaaaatataggcaatactggtgatgtgaatctatatgcccaaatgattgatgaagctgaggggctggagaaaattgagaacctccagagtcatgacaacacagagatttatgaaaaggcggtcaagattcttgagacatactggttggaggaggaagatgagactatgcctccaggggatgcttctcagtcagggttcaactttggtagcagtgacgctcctactgtgccatccggtggattcaactttaattagaagatattcatgctctactggggagttttgggtggtctatccgtaaagtcctccattatgacgcgacagcagttgggggataagtcaacgtcttgtcattgtcctaatgtccttgggtcgtacgaagtccagcaagttaatacatggttgctggactggcttgggttttttgcaatgcctggtatttcatatctcatggtgtaaaatgctttgtggctatatttttttgccaccgtagagaatactagagtcttctttctgccaagtgatcatttcatagaattaatgaatgctcagtctcgtgattttttttccctttgttatatattgtcctagactggagtaaaaagttacgattgttggttttttggcaaatgccaaatgctactgcctatccattagttacaaggaacgttttggagtctttcttttatcctattcctttgtaagcttttttggttgaaaaagttccattatccatcacgttatgtaggtcccggtacatgtagtacttcaacttgggagttggggctatgttttcaaaagaaaatatgctgtaattaattgtgtatgctcggtgctattagcctattatttctatccgttcaatgctagttgtata

SEQ ID NO: 900 - DNA, 2171 bp, Glycine max
agctcctagctagggtttttcgaattcccattcttccttccttccttctgcttttatcgatctccaacgaaaccaaaccatgtcgctcaggccaaatgccagaaccgagattcgccgcaaccgttacaaggtcgccgtcgacgccgacgagggccgccggagaagagaggacaacatggtcgagatccgcaagagcaagcgcgaagagagtttgctcaagaagcgtcgtgaaggcctccaagctcagcaacagtttcccgctcctcttcagaactccaccgtcgacaagaagctggagagtcttcctgccatggttgctggagtttggtcggatgataatagtattcaacttgaagccactacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcatggggcagttcctatatttgtcaagctacttagttcacctagtgatgatgttcgggagcaggcagtgtgggctttgggaaatgttgctggtgactcccctaggtgtagagatctagtgctcagccaaggtgccctcgtcccactgttggcccagttgaatgagcatgcaaaactttcaatgctgagaaatgccacatggacattatctaacttttgcaggggtaagccacagcctccgtttgagcaggtgagaccggcacttccagcactcgagcgtttggttttttccaatgatgaagaagttttgacagatgcttgctgggcattatcatatctctctgatggcacaaatgacaaaatccaagcagttattgaggcaggtgtatgtgccagattggtgcagcttctcatacacccatctccctcagtgctgattcctgctcttcgtacagtgggaaatattgtgactggagatgatatgcagactcagtgtattatcaatcatggtgcactcccctgccttttgaacctgttgacaaataatcataaaaaaagcattaagaaagaagcttgttggactatatcaaacattactgctggaaataaagaacagatacagactgttattgaagctggtctggttgcaccccttgtcaatcttcttcaaaatgcggaatttgacattaaaaaggaagctgcttgggcaatctcaaatgctacatctggtggaattcatgagcagatcaagtacttggtgagtcagggttgcataaagcctctttgtgatcttcttgtttgcccagacccaagaattgttactgtctgtttagaaggcctagagaatattctgaaggttggagaagctgagaagagcctaggtaacactggagatgttaacgagtatgcacagatgatagatgatgctgagggattggagaagattgaaaacctacagagtcatgacaacaatgaaatatatgaaaaggctgttaaaattcttgaaacatattggttggaagaagaagatgagacactaccttcaggagatggtgctcaacctggtttcaatttcggaaacaatgagcttccagtcccatctggtggattcaacttcagctgaagatattttcctgagaagggacttgttggacgaagtagggtttatgccgggtgggcgttgggataaagtctggagggtcagttattgcaccttgtgtccttcgtggttcatgaggtgccggggagggtcagtctacgctaccaagtccaagtaagaagggactggtggattcaacagcagcataatgatcttttcagccgtgtttgttgtacttaaaatacataaagctggtggaaggttgtatatgttgcagtggcagggacacgggtatatggcgaggggtttttttctttaatgcggctttgagtgctgttttttatttgagtcctagttttattggtatgatttattgggtcagtatttgatttgggtaaatatatcatttccaaaccaattttatggtctattccaaattccaatcgaagaattagtgctatttttgtgcgtcattttgaagcttttgctacttgattatttcacccgcaacgcattggccact

SEQ ID NO: 901 - DNA, 2378 bp, Glycine max
caaaagaaacccaaaatctcttcggctctctctcttttccatatccatatatatccccaaaccctaccgttaggttccccaattcaacaccccgtggaccggtgcgctgcttctttgttcgtacggtttccgtcgattgcctccgaaacgatgtcgtatcgcccaagcgggaactccaggaccgaggtccgccgcaaccggtacaaggtggcggtggacgcggacgaaggtcggagacgacgagaggacacgatggtggagatccgcaagaaccgcagagaagagagtttgcagaagaagaggcgcgaaggattccaacctcagcagatacctgcgtccgttcactctagtttggtagagaagaagttggaacacctaccatctatggttactggtgtttggactgatgataataacctgcagctcgaggcgacgacgcagttccggaagctgctttcgattgaacgtagtccgccgattgaggaggttatacagactggtgtggtttctcgctttgttgagtttctcatgagggaagactttccacagttgcagtttgaggcagcctgggctttgacaaatatagcttctgggacgtctgaaaacaccaaggttgtcattgatcacggggctgtcccaattttcgtgaagctacttgcttctcctagtgatgatgtccgtgaacaggcagtgtgggcattaggcaatgtcgcgggggattcacctagatgtcgtgatcttgttctcagtcatggggctttgcttcctttgttggcacaattaaatgaacatgccaagctttctatgcttagaaatgctacctggacactttcaaacttctgcaggggcaagccacagcctccttttgatcaggttaaacctgcacttcctgctcttgcccgtcttatccattcaaacgatgaagaagtattgactgatgcatgttgggcactgtcatatctttctgatggcacaaatgataaaattcaagctgtaattgaagctggtgtttgtccccgacttgttgagctgctgctgcacccatccccttcagtgctaattcctgctcttcgaactgttggaaatattgtcactggagatgatatgcagactcaggttatcatcaatcaccaggctcttccttgccttcttaatctgttgaccaataattataaaaaaagcatcaagaaggaagcttgttggaccatatccaatatcacagctggtaataagcagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagccaagggtgtattaagcccttgtgtgatcttctcatctgtcctgatcctagaattgttacagtttgtctggaaggccttgaaaacatcttgaaggtgggagaagctgataaaaacataggaaatactggtgatgtgaatctatatgcccaaatgattgatgaagctgagggattggagaaaattgagaacctccagagtcatgacaacacagagatttacgaaaaggcggtcaagattcttgagacatactggttggaggaggaagatgagactatgcctccaggggatgcttctcagtcagggttcaactttggtagcagtgacgctcctgctgtgccgtccggtggattcaactttaattagaagatattcatgctctactggggagttttggttggtctatctgtgaagtcctcctttatgacacgacagcagttgggggacaagtcaacgtcttgtcattgtcctaatgtccttgggttgtacgaggtccagcaagtaaatacatggttgctggactgccttgggtttttgcaatgcctgatatttcatatctcatggtgtaaaatgctttgtggctatatttttttgccaccgtagagaatactagagtcttctttctgccaagtgatcatttcatagaattaatgaatgctcagtctcgtgatttttttttcctttgttatatatgtcctagattggagtaaaaagttacgattgttggtttttttggcaaatgccaaatgctactgcctatccattagttacaaggaacgttttggagtctttcttttatcctcttcctttgtaagcttttttagttgacgtttaccccaaagttccatttttcatcacgttatgtaggccccggtacatttacattatttatttagtacttcaacttgggactatgttttcaaaagaaaacatgctgcaattattgtgtagtctcaaaagatatatttattctcggggctattatccgttccatg

SEQ ID NO: 902 - DNA, 2825 bp, Picea glauca
  misc_feature (750)..(750): n is a, c, g, or t
ggtcattggcctttcgtagggagtactttggacgccgatttccattgagtcattggcctttcgtagggagaactttggacgattttcaggcgttttcgggttatatattcgggttttattcagtagcagccatgtctctcagacccatgtcgaggactgaggtccggaagaagacctacaaggtggccgtcgatgcagacgaggctcgaaggaagcgagaggataatatggtcgaaatcaggaagagtaagagggaggagagccttcagaagaagagaagggagggtatgcaagcgcagcaatttgcccccactgtgcaatcgtccgccgttgaaaagaagttggaaagtcttcctgctatggttgcaggagtatggtccgatgaacctaacctgcaattggaggcaacaacccaatttcgaaagttgctttcaattgagcggagtcctcctatagaggaagttattgatgcaggtgttgttcctcgttttgttgaattcctgacgaggcatgattttccacagcttcagtttgaagcagcatgggctttgacaaacatagcttcaggaacatcagagcatacacgagttgtgattgaccgtggagctgtgccaatatttgtacagctgctcagttcaccaagtgatgatgttcgtgagcaggctgtttgggcattggggaatgtggctggtgactcacccaaatgcagagatctggttctcagccatggtgccctgatgccactccttnctcaactgaatgagcatgctaagctttcgatgttgagaaatgccacttggactttgtctaatttctgtcgaggcaaaccacaacctgcattcgagcagacaaagccagctcttccggcacttgagcggcttattcattctaatgatgaagaagtcttaacagatgcatgctgggctctgtcttatctttctgatggaacaaatgataaaattcaggctgtgattgaggctggtgtctgtcgaagactggttgagcttctgctacatccatccccatctgttcttatccctgctctccggactgtgggcaatattgtgactggtgatgatgtacagactcagtacattatcaacaatcaagcacttccctgcctcttggcactgttgacccataatcataagaaaagtatcaagaaggaagcatgctggaccatctcaaacataactgcaggaaacaaagatcaaatacaggctgtgatcgatgcaaacatcattcctcctcttgtacagttgctgcaaactgcagaatttgatatcaagaaagaagcagcatgggctatatctaatgctacctctgggggtacacatgaacaaatcaaatatcttgtgaatcaaggatgcatcaagcctctatgtgatcttctagtctgtccagacccaagaattgtaactgtttgtcttgaagggctagagaatattttgaaagttggagaagcagagaaggacctagggaacactggaggtgtgaatctctatgctcagtttattgatgatgctgaaggactcgagaagattgagaacctgcagagtcatgacaacaatgaaatttatgagaaggcagtaaagattcttgaaacttattggctggaagatgatgaagatgaccaaacattacctgccactggagatgctgctgcacagccaacattcaattttggcacaaatcaaccaacagttccttctggtggattcacttttggttgaaaaggaatttcagctattgcaacccggggggcaatgccgtgggtgtttcaaagcaaatattccagggccttataactacattgtagtcagttgcatgtatgcaagcaaatgcatggtttttggatgttactggtggcaggttatttctgttggtatgtcattatgacagtactaactaaatcgtgcagatataagctcctcattttgaatgggttggccttagttggcttggtggtacagtttccatgctgtaccagtaaggtggtctttgtccataagttctaaaattgcatagttagataaatggactcttatctgatgagccttctgacctttaaagctctaagcttgagctaattgataatgttgccaagttgaatgccagcttctgggtatttagacggaagcagtttgatgggtcatcaaggtttatggtcatactaactgcctggttctacttgcatgtgtccttcattgcatcaaagagtctgtcccatgtcggtcttgtggccagtatttggccttactaacatactgttctgggatgatcctggaaccgtgagaagtgcatgttatcatgtgctatcttattttcctctggtgttttgcccagagttctttttggattttcacaatcaagtgagtcctctgacctttctctctcttctctttcttttgccaaactaaggatgagccagagttttctttggtttttcacgctaagtgagtcctctgacccttctctttcaatctctatctctctttctatccctctccttctcgtgtctcagacccctcctgttgccagtggtcattctattttggtagttgaaacttttattgaatcattatatggactcgcaatatttgtctccggactggagactgttttgctatgtaattttttagaattctattgttaatgaatttggaggtcttctatcaacgattttatatgtttggataaaataatcacgagttttgagatcatattgggattgttttataaaatataaataggaacgtatcttctactgtattgaaacatctgaatggttctgctttgtgcttaagattctaatgtgtttcaca

SEQ ID NO: 903 - DNA, 875 bp, Zea mays
cggcacgagcacaaccggaaaagagaaagcaggagcaccaattcggcgaggaacacatagccaagccaaggaaatggcgcactaccaccccgtgtccgcggacattaccaagacctcgaggccggcttctccgctacgctcctcccctctgaagcccgcgcctcggcagcgtcccggcagtgttctgcgacccctgcgacgacggcgacgagctccacggccgccaccactacctcgacatctgcttccgctgccgtaaactcctgtccggcaacagagacatcttcatgtacagaggtgacctgccgttctgcagcgaggagtgccggcaggagcagatcgagatcgacgaggcgcgagagcagcggctgaagcagacggggcgggccgagcagcagcggcagcgccagcagaagcagagcccccagaggatccccatctgggcgtggtaggatgagaaaaattttgggcgccgggaaaacgaacgaacgtagtaggatttagctgcacctcaagaagaaccccccaagcaagggcgacttgctgcgtgtggaaacaaacggccgtggatcaccgccggcttgacgcaggaagaaggccacgcgccacggcacaggccgggcagggcagggcatccaaccggttgcgtctttttaccttcgttggttgacgaaaccgaatgacctctctcctcctgatctccgaaagatggagatggaggggggttggtttgtgcgtgagtttttgcacggttgcacgagtgaaatggtgtgcgtacgtgctgcgtctggctgggatctatcgccgtgtaaaccctgtcgatacggtatgaaacaagcgagaggcctaaacaagtccctctcgaatttctcgtc

SEQ ID NO: 904 - DNA, 837 bp, Saccharum officinarum
aaaagagaaagcagagcaccaattcgccgaggaaacagacacagagccaaggagaaatggcgcactaccaccaccccgtctccacggaggcttacggagacctcgaggccggcttctccggccactcctcctcctcccctctgaagccggcggcctcgccgaggcggcccggccgcatgttctgcgacccctgcgacgacgccgacgagctccacggccaccaccacttcctcgacatctgcttccgctgccgtaaactcctgtccggcaacagagacatcttcatgtacagaggtgacatgccgttctgcagcgaggagtgccggcaggagcagatcgagatcgacgaggcgagggagcagcggctgaagcagacggggcgggccgagcagcagcggcagcggcagcagaagcagagcccccagaggatccccatctgggcgtggtgatgatgacaaatttttgggcgccgggattcgggaaacgaacgaacggacgtagtaggatttagctccacctcaagaacaagaagaaccccaagcaagggcgacgatgcgtgtggatcaccggctcgacggaggagaaggccacggcacaggccggctgcgccttctacttcgttggttgacgaaaccgatcgaatgacctcctcctcttgatctccgaaagatggagacggaagggttggtttgagcgtgagtttgcacgggttctgttcgtcttgcttgttgttcgagcagctgagcagaaaactcaagagagagagagagagagtcctgggagaaattgttaattcattattagtgctgatgaaaaattggccgtgaacttgtgaat

SEQ ID NO: 905 - DNA, 874 bp, Panicum virgatum
tttcccacccggacaagagaaagcagatcaccaattcgccgaggcaaacagggccaattaagccgccaagggaatggcgcactacaatcccgtctccgtggacgcctacggcgacctcgaggccggcttctccggccactccgccacccctctgaagccggcggcctcgccgaggcggccggggcgcatgttctgcgacccctgcgacgacgccgacgagctccacggccaccaccacttcctcgacatctgcttccgctgccgcaaactcctctccggcaacagagacatcttcatgtacagaggtgacatgccgttctgcagcgaggagtgccggcaggagcagatcgagatcgacgaggcgagggagcagcggctgaagcagacggggagggccgagcagcagcggcagcggcagcagaagcagagcccccagaggatccccatctgggcgtggtgattgcaaaaaattttgagcaccggaaaacgtagtaggatttagctgtatctcaagaaccgaagcacgacgcgtctggaaatcacgcgcggatcgctagctccacggaggcgaaggccacaggccgcagcacaagcccaggcggagggcagagagagggagcgccgaagcggctgcgtctctgttgatgaaaccgaaccagctcctccttttgatctctgaaaggtggagatggaggggttgatttgtccgtgaattagtgctggttctgttcctctggactgttgcacggaaccaaaaaaaaaaagtgtgcgtgcgagcatcttgtgccgcggtcgtttgtgggtttgccgtgtaacctacctgtcgatatgaaaagaagtgagaggcacaaagagcactctcatatttctcatc

SEQ ID NO: 906 - DNA, 1037 bp, Sorghum bicolor
actccacttccttccttccacaacccggaaaagagaaagccgagcaccaattcgccgaggagaggaaacagacacagaacagagccaaggagaaatggcgcactaccaccccaaggaggcttacggagacctcgaggccggcttctccggccactcctcctcctcctcctcccctctgaagccggcggcctcgccgaggcggcccggccgcatgttctgcgacccctgcgacgacgccgacgagctccacggccaccaccactacctcgacatctgcttccgctgccggaaactcctgtccggcaacagggacatcttcatgtacagaggtgacatgccgttctgcagcgaggagtgccggcaggagcagatcgagatcgacgaggcgagggagcagcggctgaagcagacggggcgcgccgagcagcagcggcagcggcagcagaagcagaacccccagaggatccccatctgggcgtggtgatgctgatgctgagaaaatttttgggcgccgggaaacgtacgaacgaacctagtaggatttagcttcacctcaagaacaagaagaacaccaagcaagggcggcgatggtgcgtgcggatcgccgccggctggacggaggagaaggccacggcacaggcctgctgcgtcttttactccgttgattgatcggatcctcttgatctccgaaagatggagacggaagggttggtttgagcgtgagtttgcacgggttctgctgttcctcttgcacgagtgaaaagggtgtgcgtgctgcgtgtgggattgctgccgtgtaacctgtcgatacgtatgaaacaagtgaagaggcctaaagaagtcctcgaatttctcgtcagttttcagctgtcttccgctgctccttcctctgagctagtgatttgtcgcttatttagaagttttctttgcttaccgccacggcagaatcatttgttttggtgtgaactgtagaggagaaaaattatgttcatgttcatgctgtgttaatgctttttgtgtgcgtggagttctttgtt

SEQ ID NO: 907 - DNA, 842 bp, Panicum virgatum
ccctttcccacccggacaagagaaagcagagcaccaattcgccgaggaaaacagagccaagccgccaagggaatggcgcactacaaccccgtctccgtggacgcctacggcgacctagaggccggcttctccggccactccgccacccctctgaagccggcggcctcgccgaggcggccggggcgcatgttctgcgacccttgtgacgacgccgacgagctccacggccaccaccactacctcgacatctgcttccgctgccgcaggctcctctccggcaacagagacatcttcatgtacagaggtgacatgccgttctgcagcgaggagtgccggcaggagcagatcgagatcgaggaggcgagggagcagcggctgaagcacacgggtagggcggagcagcagcggcagcggcagcagaagcagagcccccagaggatccccatctgggcgtggtgattggaaaaaaaatttagcaccgtaaaacgtagtaggatttagctgtatctcaagaaccgaagcacgatgcgtgtggaaatcacgcgcggatcgctagctcgacggaggcgaaggccgcgggccgcagcacaaggcaaggcggagggcagagggagggagagccgaagcggctgcgtctctgttgatgaaatcgaacccgtccttcatcgctctgaaagatggagatggagggtttgattcgtccgtgaattagtgatgtttctgttcctctggactgttgcacggaaccagaaaaaaaaagtgcgcgtgtgtgggtttgccgtgcaacctgttgatacgaaaagaagtgagaggcagaaagagcactctcatatttctcatca

SEQ ID NO: 908 - DNA, 635 bp, Setaria italica
ttccccctctcccaaccggaaaagagaaagcagagcaccaattcgccgaggaaaacagaaccagagccaaaggaaatggcgcactacaaccccgtctccgtggacgcccacggcgacctcgaggctggcttctccggccaccccggcaccccgctgaagccggcggcctcgccgaggcgccctgggcgcatgttctgcgacccctgcgacgacgccgacgagctccacggccaccaccactacctcgacatctgcttccgctgccgcaagctgctctccggaaacagagacatcttcatgtacagaggtgacatgccgttctgcagcgaggagtgccggcaggagcagatcgatatcgacgaggcgagggagcagcggtcgaagcagacggggagggccgagcagcaactgcagcggcagcagcagaagcagagcccccagaggatacccatctgggcgtggtgatgaaacaattttgagcaccagaaaacgtactaggatttagctgtacctcaagaaccgagctatcggagagcacgatgagtgtggaatcacgctcggatcaccagctcgacgggcagagagagagagagagagagagagagagagagagagagagagagagagagagagag

SEQ ID NO: 909 - DNA, 853 bp, Pennisetum glaucum
ccgatctcgggattgtagcgcgccgttccattgtcccttccccccttcccaaccggaaaagagaaagcaggccaccaattcgccgagggaaacagggccaaaggaatggcgcgctacaatcccgtctccgtggacgcctacggcgacctcgaggccggctactccggccaccccggcacccctctgaagccggcggcctcgccgcggcggcccgggcgcatgttctgcgacccctgcgacgacgccgacgagctccacggccaccaccactacctcgacatctgcttccgctgccgcaagctcctctccggcaacagagacatcttcatgtacagaggtgacatgccgttctgcagcgaggagtgccgtcaggagcagatcgagatcgacgaggcgagggagcaccggtcgaagcagacggggagggccgagcagcagcggcagcagcagaagcagaacccccagagaatccccatctgggcgtggtgatgagaaaagattttgattctgagcaccggaaaacgtagtaggatttagctgtatcagaagaaccgagcagtcggagagcatgatgcgtgtggaaccacgcgcggatcacaaactcgatggagaagaccagaggccagaccggctgcttccttttgatctctgaaagatggagacgaaagggagagtggattggcaggcgttctgttcctcggcacagttgaactgaacaaaaaagtgtgggcgcgagcagtgttttttgtggccacggttgtgtgtgggtttggcggtttgccgtgtaacctgttgttgatacgaaacaagcgagaggcgcaagaagctctctctcgggattctcatcagttca

SEQ ID NO: 910 - DNA, 862 bp, Cenchrus ciliaris
  misc_feature (27)..(28): n is a, c, g, or t
  misc_feature (53)..(53): n is a, c, g, or t
  misc_feature (173)..(173): n is a, c, g, or t
  misc_feature (176)..(176): n is a, c, g, or t
  misc_feature (272)..(272): n is a, c, g, or t
  misc_feature (284)..(284): n is a, c, g, or t
  misc_feature (366)..(366): n is a, c, g, or t
  misc_feature (462)..(462): n is a, c, g, or t
  misc_feature (556)..(556): n is a, c, g, or t
  misc_feature (565)..(565): n is a, c, g, or t
  misc_feature (587)..(587): n is a, c, g, or t
  misc_feature (799)..(799): n is a, c, g, or t
cccctttctcaaccggaaaagagaaannagagcaccaattcgccgaggaaacnagggccaaaggaatggcgcgctacaaccccgtctccgtggacgcctacggcgacctcgaggccggctactccggccaccgcggcacccctctgaagccggcggcctcgccgcggcggccnggncgcatgttctgcgacccctgcgacgacgccgacgagctccacggccaccaccactacctcgacatctgcttccgctgccgcaagctcctctccggnaacagagacatnttcatgtacagaggtgacatgccgttctgcagcgaggagtgccgtcaggagcagatcgagatcgacgaggcgagggagcacnggtcgaagcagacggggagggccgagcagcagcggcagcagcagaagcagaagcagagcccccagaggatccccatctgggcgtggtgatgaacanaatttttgagcaccggaaaactccgtaggatttagctgtaccccaagaaccgagctatcggagagcacgatgcgtgtggaaccacgcgcggatngccagctcnacggagaaagagggccacggcngaggccatgccgccgcagacgacacagctcgctcgctccttttgatctctgaaagatggagacggaggggttggtttgagagtgaattggcaggcgctctgttcctgtgcacggttgaactgaacaaaaagtgtgggcgcgagcagttttttgtgccacggttgtgtgtgtgggtttggcggtttgccgtgtaacctgttgatatgaaacangcgagaggcacaagaagctctctcggattcctcatcagttcagctgccttttaccttttgtta

SEQ ID NO: 911 - DNA, 1357 bp, Solanum phureja
gttcctttgaaatcaaagaatattgaaattgcgccttcctccttttccaaaagctatcaatttattataggaacttccaattatgtcagcaaagaattatatatatataatagaaggggttccgtatatttatctaatttatcccattcttcttttctttatagtatttatagtacaagtacactatttcagtaaacttcgcttcatttagttcagtttagttttagtttaggtttattctgtaaaataaaattcaataaaaaataaatagaaataagaattcattcgaaatactaaataagaataaggagtctttatgtcgcgttaccgaggacctcgtttcaaaaaaatacgacgcctgggggctttaccaggactaactaataaaaagcctaggaccggaagtgatcttagaaaccaatcgcgttccgttaaaaaatctcaatatcgtattcgtctagaagaaaaacaaaaattgcgttttcattatggtcttacagaacgacaattacttaaatacgttcgtatcgccagaaaagccaaggggtcaacaggtcaagttttactacaattacttgaaatgcgtttggataacatcctttttcgattgggtatggcttccactattcccgcagcccgtcaattagttaaccatcgacatattttagttaatggtcatatagtagatataccgagttatcgctgcaaaccccgagatattattacggcaaaggatgaacaaaaatccagagctctgattcaaatttctctcgattcatcccctcatgaggaattaccaaatcatttgacccttcagccattccaatataaaggattagtcaatcaaataatagatagtaaatgggtcggtttgaaaataaatgaattgctagtcgtagaatattattctcgtcagacttaaacctcagactaaaaccaagggttcgcaaaaatttcttccctttaggcgaagtaaattaacccaaggttaagtaagttaagtacgatcaatccgagtttgatctagatttcccccatttttgtatcatagaccaaggatctattttcattccttgtctattcttttctttccagtattttgattatgattattttttagtattctattttacgcgtcacagcaattaggaattgagaatctatatctttagatcaaagaagggtctagctgttggaataatggtatccaatgctatttgagcccttgttgttagtaaaattggtgaattaagcgaaggtacggaaagagagggattcgaaccctcggtaaacaaaagcctacatagcagttccaatgctacgccttgaaccactcggccatctctcctacataatg

SEQ ID NO: 912 - DNA, 1251 bp, Solanum phureja
gaaaatcaaagaatattaacaatatttacaatcactatttaataatattagtattagaattgtgataaatcgaaattctagatcgctatattaatccttatgctctagaatattcaatagaatattgactagttaataactaagattccaattccagtagtttagtcaattactatgcatataagatttctgtgatgtgggcccgcttagctcagaggttagagcatcgcatttgtaatgcgatggtcatcggttcgattccgatagccggcttttccctatttttttttcattttttagatgattgataatgttcctttgaaatcaaagaatattgaaattgcgccttcctccttttccaaaagctatcaatttattataggaacttccaattatgtcagcaaagaattatatatatataatagaaggggttccgtatatttatctaatttatcccattcttcttttctttatagtatttatagtacaagtacactatttcagtaaacttcgcttcatttagttcagtttagttttagtttaggtttattctgtaaaataaaattcaataaaaaataaatagaaataagaattcattcgaaatactaaataagaataaggagtctttatgtcgcgttaccgaggacctcgtttcaaaaaaatacgacgcctgggggctttaccaggactaactaataaaaagcctaggaccggaagtgatcttagaaaccaatcgcgttccgttaaaaaatctcaatatcgtattcgtctagaagaaaaacaaaaattgcgttttcattatggtcttacagaacgacaattacttaaatacgttcgtatcgccagaaaagccaaggggtcaataggtcaagttttactacaattacttgaaatgcgtttggataacatcctttttcgattgggtatggcttccactattcccgcagcccgtcaattagttaaccatcgacatattttagttaatggtcatatagtagatataccgagttatcgctgcaaaccccgagatattattacggcaaaggatgaacaaaaatccagagctctgattcaaatttctctcgattcatcccctcatgaggaattaccaaatcatttgacccttcagccattccaatataaaatattagttaatcaaataatagatagtaaatgggtcggtttgaaaataaatgaattgctagtcgtagaatattattctcgtcagacttaaacctcagactaaaacca

SEQ ID NO: 913 - DNA, 652 bp, Guizotia abyssinica
aattaataattaaatagaaataagaagaaggagtctttatgtcgcgttaccgaggtcctcgtttcaaaaaaaatacgtcgcctgggagctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaggggtcaacaggtcaggttttactacaattacttgaaatgcgcctggataacatcctttttcggttgggtatggctccgactattccgggagctcgccaattagttaaccatagacatattttagtaaatggtcgtatagtagatataccaagttatcgctgcaaaccccgagatactattgcggcgagggatgaacaaaaatctagagctctaattcaaaattctctcgattcatcccctcatgaggaattgccaaaccatttgactcttcaaccattccaatataaaggattagtcaatcaaataatagatagtaaatgggtcggcttgaaaataaatgaattgctagttgtagaatattattctcgtcagacttaaacctaac

SEQ ID NO: 914 - DNA, 606 bp, Coffea canephora
atgtcgcgttaccgaggacctcgtttcaaaaaaatacgccgtctgggagctttaccaggactaactaataaaaagcctagagctggaaatgatcttagaaaccaattacgttcgggaaaaaaatctcaatatcgtattcgactagaagaaaaacaaaagttgcgttttcattatggtcttacagaacgacaattacttaaatatgttcgtatcgccggaaaagccaaggggtcaacaggccaagttttactacaattacttgaaatgcgtttggataacatcctttttcgattgggtatggcttcaactattcctgcagctcgtcaattagttaaccatagacatattttagttaatggtcgtatagtagatataccaagttatcgctgcaaaccccgagatattattacggggaaggatgaacaaaaatcccgagctctgattcaaaaatctctggattcatcccctcaagaggaattgccaagtcatttgacccttcacccattccaatataaaggattagtcaatcaaataatagatagtaaatgggtcggtttgaaaataaatgaattgttagtcgtagaatattattctcgacagacttaa

SEQ ID NO: 915 - DNA, 1232 bp, Tragopogon dubius
ctctatttattttattcgatgttttacatgattgataatgcatttttgaaatcaaagaatattaaaaaaaatgtcttcctcttttggcaaaagccattgatttattatgtgataggccaactatctcacgaaaagaatccttttctttttctatatatagaatagaaagatctggatatagaatagaaagatctggatatttatccaactcatctcattattctttaatagaataatacttcattaaatttcgctttatttagaatttagttcatttttagtttaggtttattctgtagaatgaaatttcatcaataagaattaataattaaatataaataagaagaaggagtctttatgtcgcgttaccgaggtcctcgtttcaaaaaaatacgccgcctgggggctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaagggtcaacaggtcaggttttactacaattacttgaaatgcgcctggataacattctttttcgtttgggtatggctccgactattccgggagctcgccaattagttaaccatagacatattttagtcaatggtcgtatagtagatataccgagttatcgctgcaaaccccgagatactattgcggcgagggatgaacaaaaatctaaagctctaattcaaaattctctcgattcatcccctcatgaggaattgccaaaccatttgactcttcaaccattccaatataaaggattagtcaatcaaataatagatagtaaatgggtcggtttgaaaataaatgaattgctagttgtagaatattattctcgtcagacttaaacctaacaaaaataaaatcaacactaataagaataagggttcgaccgattttgctccctttcggcgaagtaaattaacctaaggttaagataaataagggttttatccggatttttcttccatttaggtatcatagaccgagaggggtattttcattccttgtctactctactcttttctttaacagtattttccgtaccacggccattagaaatagagaatccatatcaaagaaaggtctaactgttggaatagtcatatccattgct

SEQ ID NO: 916 - DNA, 606 bp, Parthenium argentatum
atgtcgcgttaccgaggtcctcgtttcaaaaaaatacgtcgcctgggagctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaggggtcaacaggtcaggttttactacaattacttgaaatgcgcctggataacatcctttttcggttgggtatggctccgactattccgggagctcgccaattagttaaccatagacatattttagtaaatggtcgtatagtagatataccaagttatcgctgcaaaccccgagatactattgcggcgagggatgaacaaaaatctagagctctaattcaaaattatctcgattcatcccctcctgaggaattgccaaaccatttgactcttcaaccattccaatataaaggattagtcaatcaaataatagatagtaaatgggtcggcttgaaaataaatgaattgctagttgtagaatattattctcgtcagacttaa

SEQ ID NO: 917 - DNA, 606 bp, Lactuca sativa
atgtcgcgttaccgaggtcctcgtttcaaaaaaatacgccgcctgggggctttaccagggctaactaataaaaggcccagagctggaagtgatcttagaaaccaatcgcgttccgggaaaaaatcccaatatcgaattcgcctagaagaaaaacaaaaattgcgttttcattatggtcttacagaacgacaattacttaaatacgttcgtatcgccggaaaggcaaaagggtcaacaggtcaggttttactacaattacttgaaatgcgccttgataacattctttttcgcttgggtatggctccgactattccgggagctcgccaattagttaaccatagacatattttagtcaatggtcgtatagtagatataccaagttatcgctgcaaaccccgagatactattgcggcgagggatgaacaaaaatctaaagttctaattcaaaattctctcgattcatccccccatgaggaattgccaaaccatttgactcttcaaccattccaatataaaggattagtcaatcaaataatagatagtaaatgggtcggtttgaaaataaatgaattgctagttgtagaatattattctcgtcagacttaa

SEQ ID NO: 918 - DNA, 9077 bp, Artemisia annua
tttactagttctatatcgctagattcatcgttatgttctataatatttaacagttatttgaaattctattctttaattaaataaatatatatatatattatgaatagcgaatatgaatagccaagaattcaaatagttaataggaaagattctaagagtttatggaattcctatgcatgtcgaatttatgttatgcgagcctgcttagctcagaggttagagcatcgcatttgtaatgcgatggtcatcggttcgattccgatagtcggcttttctctatttagtttattcgattttttacatcatttataatgcagctttgaaatctaagcgaaaaaatgtcttcctcttttcgcaaaagccattgatttattatgttataggaacttccaactatctcacgaaaagaatccttttctttttctatatcttttctttttctatatatagaatataacgatctggatatttatccaactcatctcattattctttaatgtttaatagaatatcagtaaatttggctttatttagaatttagttcatttttagtttaggtttattctgtagaatgaaatttcatcaataagaattaattaaaattaaataaatataaagaaggagtctttatgtcgcgttaccgaggtcctcgtttcaaaaaaatacgtcgcctgggggctttaccagggctaactaataaaaggctcagacctggaagtgatcttagaaaccaatcgcgttccgggaaaaaatcccaatatcgtattcgtctagaagaaaaacaaaaattgcgttttcattatggtcttacagaacgacaattacttaaatacgttcgtatcgccggaaaggcaaaggggtcaacaggtcaagttttactacaattacttgaaatgcgcctggataacatcctttttcggttgggtatggccccgactattccgggagctcgccaattagttaaccatagacatattttagtcaatggtcgtatagtagatataccaagttatcgctgcaaaccccgagatactattgcggcgagggatgaacaaaaatctagaactctaattcaaaattctctcgattcatcccctgctgaggaattgccaaaccatttgactcttcaaccattccaatataaaggattagtcaatcaaataatagatagtaaatgggtcggtttgaaaataaatgaattactagttgtagaatattattctcgccagacttaaacctaacaaaaagaaaataaagactaataagaataagtaagaataagggttcgaccaattttgctccctttcggcgaaataaattaacctaaggttaagataaattaagggtttgacccggatttttcttccgtttaggtgtcatagaccgagagggatattttcattccttgtctactcttttctttaacagtattttccgtataagagccattagtaatagaaatagagaatccatatcaaagaaaggtctaactgttggaatagtagtatccattgctatttgatctattgtggttagtaagatcggtaaattaggtgaaggtaaggagagagagggattcgaaccctcggtaagcaaaagcctacatagcagttccaatgctacgccttcaaccactcggccatctctcctacataatgattatgacccaaaaaccgaaaatagaatgaatcattcatattattattgggtaggtacaaccaataaattctaactagaaagcgataaaaattttcatcatagtaaaagcaggatctttcctgggggataaagagaaattttttcttacaaaaactgttaaaaaaattctattcatgtttgcaaaaaaaaataatgttattttctttttctgattatctatttgaccgtattaaataaattctaatgaattgaggggtctctattttgtagactatggttaatgtatatctttagatcatgattctatttagactacgattccatatcagaagaattctcaatttcctttctaggccagttttagagttatcaacaaaaatccttatcccatctatctattaaaaatagaaattgatcaaaaaattttttataattgattttttagagcgtagtgtatacccctaacaacacaaaaaaataggcggttattctattttcatcatagaatgattattcaatcctttttcttctttcataattgaggttattctaagctataacttcaatcaaataagaatagtttcttttgttggtggactattccagtaagatggaatggaatccggttcccatatttatttcttagttcttatcaattcctggaatgtaaaaaagaactattttaatagtgcatttttttgaatagaaggattaatgataatgaatctgtttttatgttatttcgtactgtagaattcttttccttgtgggatcagtaatgagaacaatgatagaatggattcctacctatgtctagatcccggataaatggaaattttattgataaaaccttttcaattgtagccaatatcttattacgaataattccgacaacttcaggagaaaaaggcatttacctattacagagatggtgcgatttgatttttttattactcgcagttttacgagaaatacataggattcgtgatcgggaagaaaaaattgacgcttgttgaaggtaaagtttggaaatagaacaattccttctgtcgtgtatcctcgattaatgcagcctcagatgctatgtttcaattctcgattctagtattgagcgaaaggttatacctataggttccgtattacaggtcaatcctagtctactagtaccaataggcagcagaagggaagaagcactacacctaggaatcaacaacacgaaaactttgttaaaaattatccctttctttagcaggcttgggactaaaagaatggttgggacaacaaacatccatctcgtttgtattttggatacccgtataaccatcgaaggctgttgaagtgactaattcctagaaatagggaagcgttgagaacaaagaattgttggagttatcatttctctctagtaccaatatgtttgatgttaagaaaagatctcttgcaggaaggttggctagagatttcttgtaaaaacactagccctactcagttcataatgtaatgagaagattttcgtcttctttatcattttatcattatgcatataaggaggagccgtatgagatgaaaatctcatgtacggttctgtaacggagattctttgaattgaatgacgaccgtaacggatgtcagctcaatccgaaggaaattatgcggaagctttacagaattattatgaagctatgcgactagaaattgatccctatgaccgaagttatatactctataacataggacttatccacacaagtaacggagaacacacgaaagctttggaatattattttcgagcgctcgaacgaaacccattcttaccacaagcttttaataatatggccgtgatctgtcattaccggggagaacaggccattcggcagggggattctgaaattgcggaggcttggttcgaccaagccgctgagtattggaaacaggctatagcacttactcctggtaattatattgaagctcataattggttgaagatcactagacgtttcgaataaaaaacgatgagaccttttagttattatttagattagatttagattgttttagatatattagatatatatatctttttttatttattaattgtttgttggccccatcatcatcagtcaaataaaatagatcattcctttgggaagaaccaatcaaagaatttctttatatcccttctactatttcgtatggtattttgtagggctaaaggatacatggatagcttacaaaatctattttttcttgtatttctttttttttttagaaaaaaaagactattaaaactaataaaaaagacttcaaatcactgaatatataaaaaattcttagtaatagctaatgcctgctcgcgtgatttggaatagagtaactctatctaaaaaacatgaagcagctccatctaagaacttttaattgagatctgaaaaatactagattgcacaaaaagtagtttttgtatcaatctaaagccagaaaagtttttagaagatccaaaaggtccgttgagcgcctcatggctatgtcataatagatccgaacacttgccccggatcgacttccagatcataattgctctagtgaataactaaagaaaatagatagatgggagagaaagaaactaattatataatagaaatatctctccgagattcactaattatttgactgttggcgggtctctttgtatgtgttgtccggaaagaggaggactcaatgattattcgttcgccggaaccagaagtaaaaattttggtagatagggatcacataaaaacttcattcgaggaatgggctagaccgggtcatttctcaagaacaatagcgaaaggccccgaaactaccacttggatctggaacctacatgctgatgctcacgatttcgatagccataccagtgatttggaggagatctctcgaaaagtatttagtgcgcatttcggtcaactctccatcatcttcctttggctgagtggcatgtatttccacggtgctcgtttttccaattatgaagcatggctaagcgatccgactcacattcggcctagtgcccaggtggtttggccgatagtgggccaagaaatattgaatggtgatgtgggcgggggcttccgaggaatacaaataacctctggtttttttcagatttggcgagcatctggaataactagcgaattacagctctattgtaccgcaattggtggattggtctttgcagcgttaatgctttttgctggttggtttcattatcataaagctgctccaaaactggcttggtttcaagatgtagaatctatgttgaatcaccatttagcggggctactggggcttgggtctctctcttgggcggggcatcaagtacatgtatctttaccgattaaccaatttctaaacgctggagtagatcctaaagaaataccacttcctcatgaatttatcttgaatcgggatcttttggctcaactttatcccagttttgccgagggagcaaccccatttttcaccttgaattggtcaaaatattcggactttcttacttttcgtggaggattagacccagtaactggaggtctatggctaaccgatactgcacatcatcatttagctattgcaattctttttctgatagcgggtcacatgtataggaccaactggggcattggtcatggtctaaaagatattttagaagctcataaaggtccatttacgggccagggccataaaggcctatatgagatcctaacaacgtcatggcatgctcaattatctcttaacctagctatgttaggctctttaaccattattgtagctcatcatatgtatgccatgcccccttatccatatctagctactgactatggtacacaactgtcattgttcacacatcatatgtggattggtggatttctcatagttggtgctgctgcgcatgcagccatttttatggtaagagactatgatccaactactcgatacaacgatctattagatcgtgttcttaggcatcgtgatgcaatcatatcacatcttaactgggcatgtatatttctaggctttcacagttttggtttgtatattcataacatgagcgctttagggcgtcctcaagatatgttttcagataccgctatacaattacaaccggtatttgctcaatggatacaaaacacccacgctttagcacctagtgcaacggcgcctggtgcaacagcaagcaccagtttaacttgggggggcggtgatttagtagcagtgggtggcaaggtagctttgttacctattccattaggaaccgcagattttttggtacatcacattcatgcatttacgattcatgtgacggtattgatacttctgaaaggtgttctatttgctcgtagctctcgtttgataccggataaagcaaatcttgggtttcgttttccttgtgatgggcctggaagagggggtacatgtcaagtatcggcttgggaccatgtcttcttaggactattctggatgtataatgcaatttcagtagtcatatttcatttcagttggaaaatgcagtcagatgtttggggcagtataagcgatcaaggagtagtaactcatatcacgggaggaaacttcgcgcagagttctattactattaatgggtggctccgcgatttcttatgggcacaggcatcccaggtaattcagtcgtatggttcttcattatccgcatatggactttttttcctaggtgctcattttgtctgggcttttagtttaatgtttttattcagtggacgtggttattggcaagaacttattgaatccatcgtttgggctcataataaattaaaagttgctcctgctacccagccgagagccttaagcattgtacaaggacgtgctgtaggagtaacccattaccttctgggtggaattgccacaacgtgggcgttcttcttagcaagaattattgcagtaggataatggctaggaggatttgaaaggcattatggcattaagatttccaaggtttagccaaggcttagctcaggaccccactactcgtcgtatttggtttggtattgctaccgcgcatgacttcgagagtcatgatgatattacggaggaacgtctttatcagaatatttttgcttctcacttcgggcaattagcaataatttttctgtggacttccggaaatctctttcatgtagcttggcaaggaaattttgagtcatgggtacaggaccctttacatgtaagacctattgctcatgcaatttgggatcctcattttggtcaaccggctgtagaagcttttactcgagggggtgctcctattctggtgtttatcagtggtggtatacaatcggtttacgaactaatgaagatctttatactggagctctttttctattatttatttctgccatatctttaatagcgggttggttacacctacaaccgaaatggaaaccgagtgtttcttggttcaaaaatgcagaatctcgtcttaatcatcatttatcaggactgttcggcgtaagttccttggcttggacaggacatttagtccatgtcgctattcctgcatccagaggggagtacgttcgatggaataatttcttagatgtattaccacatccccaagggctaggcccactttttacaggtcagtggaatctttatgctcaaaatcccgattcaagtagtcatttatttggtacctcccaaggagcaggaactgccattttaacccttcttgggggattccatccacaaacccaaagtttatggctgactgatatggctcatcatcatttagctattgcatttgtttttctcattgctggacatatgtatagaactaattttgggattgggcacagtatgaaagatcttttagatgcacatatccctccgggaggtcgattgggacgtgggcataagggcctttatgacacaattaataattcgattcattttcaattaggccttgctctagcttctttaggggttattacttctttggtagctcaacacatgtactctttaccggcttatgcatatagcacaagactttactacccaagctgcgttatatactcatcaccaatacatcgcaggattcatcatgacaggagcttttgctcatggagctatattttttattagggattacaatccggaacagaatgaggataatgtattggcaagaatgttagaacataaagaagctatcatatctcatttaagttgggccagcctctttttgggtttccataccttgggactttatgttcataatgatgtcatgcttgcctttggtactccggagaagcaaatcttaattgaacctatatttgctcaatggatacaatctgctcacggtaaaacttcatatgggttcgatatacttttatcttcaacgaatggcccggcattcaatgcgggtcgaagtatctggttgccgggttggttaaatgctattaatgagaatagtaattcactattcttaacaataggtcctggagactttttggttcatcatgctattgctctgggtttacatacaactacgttgatcttagtaaaaggtgcgctagatgcacgtggttccaagttaatgccagataaaaaggatttcggttatagttttccgtgcgatggcccaggacgaggcggtacttgtgatatttccgcttgggacgcattttatttggcagttttttggatgttaaataccattggatgggttactttttattggcattggaagcacattacattatggcagggtaatgtttcacagtttaatgaatcttccacttatttgatgggctggttaagagattatttatggttaaactcttcacaacttattaatggatataatccttttggtatgaatagtttatcagtctgggcatggatgtttttatttggacatcttgtttgggctactggatttatgtttttaatttcctggcgtggatattggcaggaactttagcgtgggctcatgaacgcacacctttggccaatttgattcgttggagagataaaccggtggcacttcattgtacaagcaaggttggttggattagcccacttttctgtaggttatatatttacttatgcagctttcttgattgcctctacatcagggaaatttggttaatttttttaattgaatgttttgtatctgcgataatctcatttctttcgatgaagaagagatccaccttcttatcttatatttctccatctaggatccgacttgtatcatggatactaataggaacttaacgagtatggcaaaaaaaagtttgattcagagggaaaagaagaggcaaaaattggaacagaattaaaagaagaaataagcaaagttcgatcgttgagtgaacaaaaaaaaaaaaaaagtcggactagaa

SEQ ID NO: 919 - DNA, 670 bp, Helianthus annuus
gaattaataattaaatagaaataagaagaaggagtctttatgccgcgttaccgaggtcctcgtttcaaaaaaatacgtcgcctgggggctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaggggtcaacaggtcaggttttactacaattacttgaaatgcgcctggataacatcctttttcggttgggtatggctccgactattccgggagctcgccaattagttaaccatagacatgttttagtcaatggtcgtatagtagatataccaagttatcgctgcaaaccccgagatactattgcggcgagggatgaacaaaaatctagagctctaattcaaaattctctcgattcatcccctcctgaggaattgccaaaccatttgactcttcaaccattccaatataaaggattagtcaatcaaataatagatagtaaatgggtcggcttgaaaataaatgaattgctagtggtagaatattattctcgtcagacttaaacctagcaaaagttgaagctaaaaa

SEQ ID NO: 920 - DNA, 649 bp, Helianthus annuus
ttaataattaaatagaaataagaagaaggagtctttatgccgcgttaccgaggtcctcgtttcaaaaaaatacgtcgcctgggggctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaggggtcaacaggtcaggttttactacaattacttgaaatgcgcctggataacatcctttttcggttgggtatggctccgactattccgggagctcgccaattagttaaccatagacatgttttagtcaatggtcgtatagtagatataccaagttatcgctgcaaaccccgagatactattgcggcgagggatgaacaaaaatctagagctctaattcaaaattctctcgattcatcccctcctgaggaattgccaaaccatttgactcttcaaccattccaatataaaggattagtcaatcaaataatagatagtaaatgggtcggcttgaaaataaatgaattgctagtggtagaatattattctcgtcagacttaaacctagc

SEQ ID NO: 921 - DNA, 1046 bp, Manihot esculenta
aaaataaggagtttttatgtcacgttaccgagggcctcgtttcaaaaaaatacgccgtctgggggctttgccgggactaactagtaaaaggcctagagtcgggagcgatcttagaaatcaatcacgctccggtaaaaaatctcaatatcgtattcgtttagaagaaaaacaaaaattgcgttttcattatggtgttacagaacgacaattacttaaatacgttcgtatcgccgcaaaagccaaagggtcaacaggtcaggttttactacaattacttgaaatgcgcttggataacatcctttttcgattgggtatggcgtcaactattcctcgagcccgccaattagttaatcatagacatattttagttaatggtcgtatagtagatataccaagttatcgctgcaaaccccgagatattattacagcgagggatgaacaaaaatctagagctatgattcaaaatgatcttgattcatccccccaggaggaattgccaaaacatttgactcttcacccattccaatataaaggattggtcaatcaaataatagatagtaaatgggttggcttgaaaataaatgaattgctagtggtagaatattattctcgtcagacttaaacctaactaaaataacaagggttcggataattttgcccccttgtcgcttaagtaaagaaatacaaaagaaagtaagggcttgatcgggagatttttctcccgttcatatatcatagaacgatagggatattttcattcctttccattttctgcggtattttctgtaccgcagaaattagaaatagagaatctatatcaaggaaaggtctaactgttggaataaaggtatccattgttatgtgatttgatacattgcgatccgtaacattgataaattaggtgaagatacggaaagagagggattcgaacccccggtaaacaaaagcctacatagcagttccaatgctacgccttgaaccactcggccatctctcctgcataatgattatggcccagaacccgagtgaatcgcgagtcatttata

SEQ ID NO: 922 - DNA, 658 bp, Taraxacum officinale
tattaaatttaaataagaagaaggagtctttatgtcgcgttaccgaggtcctcgtttcaaaaaatacgccgcctgggggctttaccagggctaactaataaaaggcccagagctgtaagtgatcttagaaaccaatcgcgtcccgggaaaaaatcccaatatcgaattcgcctagaagaaaaacaaaaattgcgttttcattatggtcttacagaacgacaattacttaaatacgttcgtatcgccggaaaggcaaaagggtcaacaggtcaggttttactacaattacttgaaatgcgcctggataacattctttttcggttgggtatggctccgactattccgggagctcgccaattagttaaccatagacatattttagtcaatggtcgtatagtagatataccaagttatcgctgcaaaccccgagatactattgcggcgagggatgaacaaaaatctaaagctctaattcaaaattctctcgattcatccccccaggaggaattgccaaaccatttgactcttcaaccattccaatataaaggattagtcaatcaaataatagatagtaaatgggtcggtttgaaaataaatgaattgctagttgtagaatattattctcgtcagacttaaacctaacaaaaaaaaaaaaaaa

SEQ ID NO: 923 - DNA, 2263 bp, Ricinus communis
tggaatctggaattttgatggaaggatttctttactttactaatgcaacgcagtcaactccgtttgttagaacagcttccattgagtctctgcacctatccttttttttttattctgtctttatgaacctttgtttgttttcgaaaaacaggatttggctcaggattgcccatttttaattccagggtttctctgaatttgaaagttatcacttagtaggtttccataccaaggctcaatccaattaagtccgtagcgtctaccaatttcgccatatccccttttttgttttgagattcaaatcttattattacccgcctttcatttatattctattggaactgttgaagttattagataccgattcctataaaaattgctataactataaaaagtgtttcctcttcttttttttcttgtctatcttctttcatctctatcagaaatccttctttagtctaatcagaaaggattctatcatttctctatccgcaattcaatatagatgtatatataccacatttattatatatacttctcttactctcattctttctcgtgcaattttgaatactcgaacggtcgattctttttcttttttctatattttttcttttttctatattcatattaagtatgaataactaataatgaaaagaataaaaagttaatagccaagattctactagtttactaaattcctatgcatgtacaatttctgttatgtgagcccgcttagctcagaggttagagcatcgcatttgtaatgcgatggtcatcggttcgactccgatagctggcttttctttatttgtttgattttttacataattgataatgcctttttgaaatcaaagaatattgaaaaagcttcgttcccctttgccaagggggacccattattatgtggtaggaacttcaaattatgaataaaagttcaaagttagagtagttaaatctctgcagaacaaatcaagaacaagaaaaggaccttttttctatatacattattggtatatatacaaaaaggtccggatattgatacaatccatctcattattctttgtagtatactacttcagtagattttgtttcatttatcatatttatcctttagttcagtagttcagttttaatttaggtttttgaaaattcaataaaaataaaataagtaaaataaggagtttttatgtcacgttaccgagggcctcgtttcaaaaaaatacgccgtctgggggctttaccgggactcactagtaaaaggcctagggctgggagcgatcttagaaatcaatcacgctccggtaaaaaatctcaatatcgtattcgtttagaagaaaaacaaaaattacgttttcattatggtcttacagaacgacaattacttaaatacgttcgtatcgccgcaaaagccaaagggtcaacaggtcaggttttactacaattacttgaaatgcgtttggataacatcctttttcgattgggtatggcgtcaactattccccgagcccgccaattagttaatcatagacatattttagttaatggtcgtatagtagatataccaagttatcgctgcaaaccccgagatattattacagcgagggatgaacaaaaatccagagctatgattcaaaattatcttgagtcatccccccaggaggaattgccaaaacatttgactcttgacccatttcaatataaaggattggtcaatcaaataatagataataaatggatcggcttgaaaataaacgaattgctagtggtagaatattattctcgtcagacttaactctaactaaaataacaagggtttggataattttgccccctatcgcctaagtaaagaaacaaaaagaaagtaagggtttggtttgatcggggggttttctcccattcatatatcatagatatatagggatattttcattcctttccaatttttccagtattttttgtaccacagaaattaggaatagagaatctatatcaaggaaaggtctaactgttggaataaaggtatccattgttatgggatttgatacattgcagtcagtaacattgataaattaggtgaaggtacggaaagagagggattcgaaccctcggtaaacaaaagcctacatagcagttccaatgctacgccttgaaccactcggccatctctcctacataatgattatggccccgaacccgagtgaatcgcgagtcattcatattagattgttgaataggtatggtacgtacaatcaattctaac

SEQ ID NO: 924 - DNA, 606 bp, Panax ginseng
atgtcgcgttaccgaggacctcgtttcaaaaaaatacgccgcctgggagctttaccgggactaactaataaaaggcctagagccggaagtgatcttagaaatcaatcgcgttccgggaaaaaatctcaatatcgtattcgtctagaagaaaaacaaaaattgcgttttcattatggtcttacagaacgacaattacttaaatacgttcgtatcgccggaaaagccaaggggtcaacaggtcaggttttactccaattactcgaaatgcgcttggataacatcctttttcgattgggtatggctccgactattcccggagcccgtcaattagttaaccacagacatattttagtcaatggtcgtatagtagatatagcaagttatcgctgcaaaccccgagatattattacggcgagggatgaagaaaactctagaactctgattcaaaattctctcgattcgtcctctcatgacgaattgccaaaacatttgactcttcacccattccaatataaaggattagtcaatcaaattatagatagtaaatgggtcggtttgaaaataaatgaattgctagtcgtagaatattattcgcgccagacttaa

SEQ ID NO: 925 - DNA, 670 bp, Prunus persica
catatttagtttagtaattttgtttatgaaatttcataaaaaataaggagtctttatgtcgcgttacagaggacctcgtttcaaaaaaatccgtcgtctgggggctttaccagggctaactagtaaaaagcctagagccggaagcgatcttagaaaccaatcgcgccccggcaaaaaatctcaatatcgtattcgtttagaagaaaaacaaaaattgcgctttcattatggtcttacagaacaacaattacttaaatacgttcggatcgccggaaaagccaaagggtcaacaggtcaggttttactacaattacttgaaatgcgtttagataacatcctttttcgattaggtatggcttcgactattcctcaagcccgccaattagttaaccacagacatattttagttaatggtcgtatagtagatataccaagttatcgctgcaaaacccgagatattattacagtgagggatgagcaaaaatccagggctctgattcaaaattatcttgattcacccccccgtgaggaattaccaaaacatttgactcttcacccattccaatatgaaggattagtcaatcaaataatagatagtaaatgggtcggtttgaaaataaacgaattgctagttgtagaatattactctcgtcagacttaaccatactaa

SEQ ID NO: 926 - DNA, 767 bp, Solanum tuberosum
ggtacaagtacactatttcagtaaacttcgcttcatttagttcagtttagttttagtttaggtttattctgtaaaataaaattcaataaaaaataaatagaaataagaattcattcgaaatactaaataagaataaggagtctttatgtcgcgttaccgaggacctcgtttcaaaaaaatacgacgcctgggggctttaccaggactaactaataaaaagcctaggaccggaagtgatcttagaaaccaatcgcgttccggtaaaaaatctcaatatcgtattcgtctagaagaaaaacaaaaattgcgttttcattatggtcttacagaacgacaattacttaaatacgttcgtatcgccagaaaagccaaggggtcaacaggtcaagttttactacaattacttgaaatgcgtttggataacatcctttttcgattgggtatggcttccactattcccgcagcccgtcaattagttaaccatcgacatattttagttaatggtcatatagtagatataccgagttatcgctgcaaaccccgagatattattacggcaaaggatgaacaaaaatccagagctctgattcaaatttctctcgattcatcccctcatgaggaattaccaaatcatttgacccttcagccattccaatataaaggattagtcaatcaaataatagatagtaaatgggggtcggtttgaaaataaatgaattgctagtcgtagaatattattctcgtcagacttaaacctcagactaaaa

SEQ ID NO: 927 - DNA, 10706 bp, Quercus alba
ttaacaagcaattagtatttttagacaggatgcccttggttttggtttcttggtagggtttactacatattttgtttattctagaggagtgcttttgacaccatcaaactatatatcaaatggaggaaacataattcggaacatgaggtacttgatcgaattgaagacgctgaaaatgcaaatttagcattagagccttataactaggtaaccaaattaaagagctccgataattatctcttgccacttaattagtgaacaaattaaagatgatgaaaatctttgctcttaagtcctaaaaagttttgtcaccagttttcataaaatcaaggagaatgcttgttagaatgtttaatatctaggtttaaataaataataggaactgcatgtgtttatggttattagttgttgtcttttcatgatcagcacgtaaaggtgaagttgacccattatttatttgttactgaatttaaaaatattttggatatttagacgaaggtaatccataacgtgtttgtttcaaacttgatttgaacggttacatattgtcttgataaaaaattagccatttcgaaaagtaccatccatagtgctactaaactaaactaaatattgtctggtataccaatatacatatttcaccatcttaccttttaactagtcactagtgatgtatcaatatttataatacgaaataaaaatatacatattttgcaaaaaaaaaacccatattatatatattttttaagatgaaacaaatgtatactatttatatttctaccatgtttaaattttatgaaacatggaacaacaaaatacaacttattgacaaaataagaaaataagaaaattttctaagttccatcaaaactcttagggggaaaaaagtaatacaaaaataacattctataacacaaagtattcatccaacaaaattaagatgtcaaacatgagaaaaaaaaatcatgatattttggtggcatccattacctcttgctttcttttagcatttattctatctataaaaactctagaatcaaacttggtatctagaagtttggttcttcctataatagtacacaaacaatctttgattagttctttcaagagggacttctattttgattgatggggacatgtaacaaataaaactattttattttatagtaaaattataataaatctaacttattataactaatactaaattaaataaaataataaataaacatagtactcatattcaaaacaccttgtgatcgatcttcaaccaattctgtgcctcaatataattcccgggagtaagcgttatagcttgtttccaatactcagcggcttgatcgaaccaagcctccgcaatttcagaatttccctgtcgaatggcctgttctccccggtcggaataggcagggaaattccttcccttagaaccgtacttgagagtttcctacctcatacggctcagcagtcaattcttttggtgtccctttttttaataccatatctaattgaatgagatttctcatggatctatctcatttttttcgagttaaccaaaagaggttaagtagatgagtttcaaactttaattttgattaatagttgaatcagttttagttttatcttttctcccaccttcagaagaataaaacataggtctttccgctatcattagagttttctgaaaggtaactatctcggtttcatatataaatttatatagatatagaatttttgaaaaagtcttttctttcttatcgaagaaaagacttactatctttgggatctgattctacaccgctgctcaataccttaggggatcgactctattacataagttgattcctaacttttatctcctatcgttacataagtaagcagttcttattgtatcggaccaaaatctcacttaattgatctttacggtgctttttctgtcaattagaccctttctttatccatagactaaaggatctaggcatacctattacttcctacttcgacttctacgaagtttctttctttttctttgctacagctgataaaaatcgttgttttggacgatacctatgatatgtagaaagcctattttcgagtatttattcgcgtcttattttttctctttctttctttttttctttctatagtggagatagtcgcacgtaatgacagatcacggccatattattaaaagcttgtggtaagaacgggtttcgttctagcgccctaaaataatattccaaagctttcgtatgttctccgttccttgtatggataaggcctatgttatagagtatataacttctatcatagggatcaatttctagtcgcatagcttcataataattctgtaaagcttccgcataatttccttcggattgagctgacatccgttacggtcgtcattcgattcaaagaatctccgttccagaaccgtacgtgagattttcatctcatacggctcctccttttttgatttttatgtgcataatgagaagaatatctggaatcaaaaaagattgaaataatttcattatgaaccgaagggggctagtgtttttacaagaaatttctagccaaccttcctgtaaaagatcttttcttaacatcaagtaccttataaaaatgataactctaacaatttctttgtccttaacacccctcaatttccaggaattagtcacttcaacagtcttcgatggttatacgggtatcaaaaatacgaacgagatggatgtttgttgtcccaaccattcttcttagtcccgatcccgacaaagaaaaggtataatttctaacaaagttttcgtattgttgattcctaggcgtagtgcttcttcccctatgctgcctatcggtactcgtggagtagggttgatttaacccataggataggtgcgtaacctttcgctgaatactagaattgataattgaagcatctgaggctgcattaatcgtggatacacgacagaaggaattgttttatttacaaacttcacctttacaaaaagcgtagatttatttcaaatttgttttctttctatcccgaataatgtatctttctccgaagactgaaagcagtaaataaaaaaatcaaatcgcaccatctctgtaataggtgaatgcctctttttctcctgaagttgtcggaattattcgtaataagatattggctacaattgaaaaggtcttatcaataaaatttccatttatccgagatctaggcataggtaacaatccattctataatttttttattttaactacctcttgcgagaaaatgatcccacaaacaaaggaattaattgtacagtacgaaataacataaaaaagaatcattaaaaaaagatatgaccttctattcaaattatttgtttttttgaaaggaatcaatagaagaaaatatttgaatccgattagattcgatttaatttaatccaaatgtagttgtctaagaatgaaaggaactattccgatttcatcgaagttgaagaatcaaagaatttatcttaccgattaggctaattatagaaggtttaattgatatgacccaaaggttaaaaagactcgaataatcattctatgatgaaaatagaataaccatctgttttgtgttgtgtgcattacatagtgggtagaaactatacaatcaaatagaaaaattcctgggatgattcatgaatttgaaatagatccatgggagtaaggagttattattgaaagatctaaaactggaaataaatcttataaattttatgaatatggaatcatagtctaaaaaagaaaatataatcatgatctaaaagaaacgtatccattagaaacatagtataaaaaaaaatggatcgattgattcgttctaattcattgattaaatcttctggtataaatattgtaatgtaataaagaataaatattggaaaaagacgtgacttcgcaaaaatgaatagatatatatatctatttttttaacagttttcacaaaaaaatgtatcccccccccccttgcccttgaaggaaggctttttctttgctgaaacgttttctatatttttatagttagaatcgacgctacgtacctattcaaaaatagaatatgaaatgactcactattcacccggttttggggccataatcattatgtaggaaagatggccgagtggttgaaggcgtagcattggaactgctatgtaggcttttgtttaccgagggttcgaatccctctctttccgtacctttcaaccaattcaccgatcttattgacagcaatggatcaaagcaaataacaatggataccattattccttagacctttctttgattttgatatagattccttattcctaatttctttagtacggaaaatactgtaaagagtggacaacagggaatgaaaatttccctaccgatccgtgatccatgatccttgaatgggagaaagatccccatatcaaattccttacttttgtcggtctttttgcttaggcgaaagagggaaaaggtgtccgaacccttgttgttttattttaattaggtttaagtctgacgagaataatattctacaactagcaattcatttattttcaaaccgacccatttactatctattatttgattgactaatcctttatattggaatgggtgaaaagtcaaatgttttggtaattcctcatcacgaggggatgaatcaagacaattttgaatcagagctctagatttttgttcatccctcgctgtaataatatcttggggtttgcagcgataacttggtatatctactatacgaccattaactaaaatatgtctatggttaactaattggcgggcttggggaatagtcgaggccatacccaatcgaaaaaggatgttatccaaacgcatttcaagtaattgtagtaaaacccgacccgttgaccctttggcttttccggcaatacgaacgtatttaagtaattgtcgttctgtaagaccataatgaaaacgcaatttttgtttttcttctaaacgaatacgatattgagattttttactggaacgtgattggtttctaagatcgcctccggctttaggccttttactagttagtcccggtaaagcccccagacgtcgtattttttttgaaacgaggccctctgtaacgcgacataaagactccttattttattgaaatttcataaacttaaattaaaactaaactaaatgataaatgaagcgacatcccctagagtatttaccacaaagaataattagatgaattggataaatatccggaccgtattggatttgtatatttaaaaaaaaaatagaaaggttcttttcgtgatttgttatacagggatctagctcctataattttttatttagaatttgaagttcctacgacatagtagatcggtgactcttggaaaaaggggtcgaagctttttcaatattctttgatttcacaatatcaattatgtaaaaaataaaaaaaaataaagaaaagcctgctatcggaatcgaaccgatgaccatcgcattacaaatgcgatgctctaacctctgagctaagcgggctcgcataacaaaaattgtacatacataggaatttagtaaactactgggatcttagctattaattgttcattcttagttttcataccataattaatatgaatatagaatagaatttcaaataaatattaaatagttgaatgaatatattctcgaacataacgattaatattcgaaatggaatctaattagattagaatcttattctacacattctaatcttacttatttattctaattctagatagattctaatttgaaataattctaattctaaatagttagatcaattagaaattaatagaataatataataagaaatttatattaataaatttcttttttttagtcatttttagttatgttatagagggtccgccttaacttaaggaaattaaaaaagtaaaggctacgaataaaaaaaaatgaaaaaagagaaggccgtaatccagatcataatgaaagattcctccgctttcgttcggaaagataaaacaaaaaaaaagaatcgaccgttcgagtatatcaaattacacgataaaatgatataaaagaaagaggggcatacataatctatattggtatagataatatatatctatattgaattgcggatacagaaatgatagaatcatttctgattggatcaactctggatcttcgatagagatgaaatgagataaacaataaaaaaataggagtaaacacttttcgatataggaattggtatctaataaattcaaagattccggcataaatgaaagaaaaaggaaaaaagcgaggaaggacatcataatgagatcctaatcttaaaacaacaaaacaaaaatgggggatatggcgaaattggtagacgctacggacttaattggattgagccttggtatggaaacttaccaagtgataactttcaaattcagagaaaccctggaattaaaaatgggcaatcctgagccaaatcctattttacgaaaacaaataagggttcagaagaaagcaagaataaaaaaaggataggtgcagagactcaatggaagctgttctaacaagtggggttgacttctttacgttattacattaacgtaatccttatatcaaaactacagaaaggataaacctatatacatacgtatatgtacttaatgacgacccgaatctttatttatttatatttctataaataataaataaaaatcgaaagagttgttgtgaatcgatccaaattgaagaaagaatcgaatatttattaataaaatttatcgtacgagaataaagatagagtcccattccacacgtcaataccgacaagaatgaaatttataggaagaggaaaatccgtcgactttagaaatcgtgagggttcgagtccctctatccccaaaaaggcccgtttgattccccaattatttatccgatccgctcttttcgtttcgttagcggtttaaaattcgttatgtttttcaatcattctactcttttacaaatggatctgattggtaaattttttttttcttattacaatatttgtgatatatatgatacgcgtacaaatgaacatctttgaggaaggtatccccacttccaatttgaatgattaacaatacatatcatttcttgtactgtattaaaacttataaagttttctttttgaagatccaagaaattacagggtctggataaagctttgtaagactttttttgtctttttaattgacataaactcaagttatctattaaaataaggacgatgcacggataatggtcgggatagctcagctggtagagcagaggactgaaaatcctcgtgtcaccagttcaaatctggttcctggcacatgatttatttgtatgagtatccgttttacaaatgaattgatatgggtcaacatacatattcattactagtctatatcatgatagatacttatctatctaggtgtctgagaatataccctttctagaattatagaatagatgagtaaagagtatgtctataaaatctgtaaaataaaaaaatgagatttgacttccttttcttttttatttgttcatacggtgtctcttaccgttcaaaaacaatgttaatactttagatatttaatacttcatacatattaaaatagaaaggttaaattaattggttgaaagactcaaaggtatagtctcgcggagttgaaaggtgggaataaccaagattcatttcagatacagtacaaataaaatccaagccctcctctcatttcgttgtcttttcttttcatattctatttcttcatttcctcctatgtgactttgtcgaactcatttaagttttgtgcgtggtacatagttcatgatgcgaaactcttttaggtcatcctaatactaattgtattttttaattgtctttgtttttatttatccttttatttctatttttattgtttctattcaaataaataaatatataatatataaaaatagaaacaattttttttattctatttattttgtattatttatttgtatttgatttatattttatttcgttttatttagcccatttagaatagaatgcgaatgagacttccattacgctctttggtctataagagaacgtacaaacattatttgaatacctggagttgtagaagtgaaaattagtttcttattttattatttatatttaatgagcatcctgtatttcataaaaattcggggcaatataatccttacgtaagggccatcctatccaactttcgggcattaagatacgtttcagacgtggatgattatcataaaagattcccaacatatcataagattccctttcttgaaaatccacactttttaggattccaccttggggcaaatacttttatacatacctcttctggttgatctataccataagctattctcgtaagatgatacacactagaacagtccgcccggtgctacatcataggcacattgggaacgtaaataattgtaaccatatacatataaaatgacagcaatggaatgccaatccccaggctttatttgtaaagtctctattccttggtagtcgaagcccaaagatctatgaactaacccatgtttggctagccaagcagacaaacgaccttgcatcttttttatctctcccacattttgatttgtataaaacttttatttgtctctataagttaagtatttcacatttacgatgaaatttatgaaaattattgtttgttattatgtaaaaaaatgtgaaaaaaaaaaatcctgcctaattcactaattcgggggaagatactgaactcttgttgtatttgaaaaatatttcaagagggatctccgaagtcgatgtagatggtggttgatcgagtaatcctcgatcataatttccagtatgagtacttcgtccaatataaaacttgtggttgatagtaaaacaccgactcccctgttgagacctaattcgatcttcatagatttctcgagatagttttttacgaagttttgttatagcatctataactgcctccggtttaggtggacaacctggcaaatagacatctacaggaattagcttatcgaccccccgaacagtagtataagaatcggtactgaacataccccctgtaattgtacatgctcccatagcaataacatattttggttcaggcatttgttcatataatctcactaaagaagagccattttcattgtactgtaccgcagttaaaattaggtccgcctgtctaggactcgatcttggtaccagcccataaaggtcaaaagtcgaatcgtgagcctattaatgaagcaaaattcaatgaaacaacaactggtaccatatagaagcggccacaaactggacagtcttgaccaatttgaaagatcatttaatgtagttgaaataactgaattttttggggggctgttcgatcaagtaagggaaactcaatggaattcataaccgtttcaatgtttttttttactttctttatctttatttttattgtctgaatattcaagagctaagaccattccaatgctccttttcgccatgcataaactaaaccacaattaggataagcacgaaaatgaaagcttctataaatacagatatacccaatacatcaaaactcattgcccatggataaagaaaaaccgtttcaacatcaaaaacaacaaaaactagagcaaacatataataccgaattcgaaattggagccaagcatcacccattggttctatcccgattcataactagaaagtttctctggccctttgcgaatcggggctaaaactcccgaaatcaaaaatgccaaaataggaatagcacttgctattattagaaatgcatatcatattcgtaaagtagaaacatagacggactccttgcatgcggaaaatatgccggattagttgattggaattggaatgaattgtcaagccatccataactctttagtcaaaacaaaacttcatttggatcgaactgcttagtttcgcctgtttgtttcggcacgtgtcaaccttccgctcacgattcatccactcgaatcccgtttctaatatatatattacttttatactatttctatttatactataaaactaagctataaaactaagagtctcgcggtttcacttcacttcggatttgaatttttatataaattgattagaaggaactaaagagctaaagaaaaggaattttaatttaaatagcattctaattgttttgtttagaattctattattattaaaaatgaaatttctattagaaattcatattctaaattgaaataaaatctatttctttttttattctagttagattatagggctatacggactcgaaccgtagaccttctcggtaaaacagatcaaactaattattatcaaaatgatttgaaccgtttcaaagacccaacatgcattttttttgtgcattgggctctttcataaactgaaagaatatcggctagtctaccatattttttcttgacataaagataaagagatggctccgtgtgctcggattcattattttgattccaataaaaaggcgcactaccaaggtgtttcaaagaggattatcctgacgtaggtctgctttggcctagattaacttaagttaaatggagtatgtctctatcgacccgcttccgcttaa

SEQ ID NO: 928 - DNA, 9286 bp, Arachis hypogaea
ggaatccaaattggtgaagtttgatctctgtagaacaactcaagaaacaaacctcctttttttctctataaatagaataaggttcagatattgatagaattcatacaattcttctttgtactacaatgcttttgtgaatttcgcttcatttctcatatcatatttgtcatttagtttagttttaatttcgatttttcattttttaattaaaaagggagtctttatgtcacgctacagagggcctcgtttcaaaaaaatacgccgtctggggactttacctggactaactagtaaaaagcctacagtcggaagcgaatttagaaaccaatcacgctccggtaaaaaatctcaatatcgtattcgtttagaagaaaaacaaaaattgcgttttcattatggtcttacagaacgccaattgcttaaatacattcgtatcgccggaaaagccaaggggtcaaccggtcaggttttactacaattacttgaaatgcgtttggataacatactttttagattgggtatggcttcgactattcctcaagcccgccaattagttaaccataaacatgttttagttaatggtcgtatagtagatataccaagttatcgctgcaaacctcaagatattattacagcgaaagatgaacaaaaatcgaaagctctgattcaaaattctctggattcagccccacgtgaggaattgccaaaccatttaacccttcatccattccaatataaaggattagtaaatcaaataatagatagtcaatgggttggtttgaaaatcaacgaattgctggttgtagaatattattctcgtcagacttaatactaactaaaaaaacaagagttttgatacgagaattttagctcattcaggtatcatctacatggatataggacgatttgcattccctgtccactttttccagtattttgcatttcatattaccaaaaaattggaattgaaaattcatagcaactaaagttggaataatggtatccgttggcatttgagatattgcagattgatgaattaacggagagagagggattcgaaccctcggtaaacaaacagcctacatagcagttccaatgctacgccttgaaccactcggccatctctcccccatgatgattatggcccagaaaccggagcaatagtgaatgattcatattccatttttggataggcgcccatataaaataaataatcaattcgacctatacgaaataattttttgtttataaaaaaaaccaacttctaggccgtaggctaaaaaaattcattaatgagtccttttttacgttatttcgtactatttgtattgtacaattcctttgtttgtgggattcttttttctcacgcgataaagaattcaattttcgaatggattcctacctatgcctagatctcggataaatggaaattttattgacaagaccttttctattgtagccaatatcttattacgaataattccgacaacctcgggagaaaaggaggcatttacttattacagagatggtgcgatttgattatttttttttaccgatctcagtcttatgagaaagacacattattttattcgtaaaaaaatggcaaaaaaccgacgcttgctgaaggtgaagtttacaaataaaaaagaaattccttctgtcgtgtatccccgattaatgcagcctcatatgcttcaattatagatttttagtattaagcgaaaggttatacctatactatggagttagattaaccttactccactagtagcaataggcggcatgggggaagaagcactacgattaggaatcgacaacacgaaaactttgtaaaaaaattcttcctttcttttcgggatcggaactaacaagaatggttgggacaacaagcatccatctcgttcgtatttttggatacccgtataaccatcgaagggtgttgaggtgactaattccgggaaattaagcggcgttgaggacaaagatattgttggagttatcctttttatccagtaccaacaaacttgatgttaagaaaagatcttttacaggaaggttggctagagatttcttgtaaaaacactagccctgcacaggtgataatgagagagaatactggaatctttttttgatttaatgtattcatttttttttcattatacacataaaggaggagccgtatgagatgaaaatatcacgtacggttctggagcggagattctttgaactgaatgacgaccgtaacggatgtcagcgcaatctgaaggaaattatgcagaagctttacagaattattatgaggctatgcgactggaaattgatccctatgatcgaagttatatactttataacataggccttattcacacaagtaacggagaacatacaaaagctttagaatattattttcgggcactcgaacgaaatccgtttttaccccaagcttttaataatatggccgtgatctgtcattacgtgcgactatctccactatagaaaaaaaggctttgtacatatatatcgttcaaaactacgatttttatcagctgtaggaaacaaaaaaacttcatagaatataaaagtaaaaaaaaatgaagaaatagagatatgcctagatacttttttctatggataaaagatccaattgatagaggaagcgccgtaaagatcaattggcgaggttttaggccgagacaataagaactgcttacaacttatatcatgatacaaaatctatcatgatataagagttaggaatccacttatgtaataaagttgatcccctaccctaaggttttgagcagcggtgtagtatcagatcccacagatagtaagtcttttctttcttatgaaaaataaaaagaagtctttctcaaagattctatagaccatagaaatgtcatattagaaagtatatgatatatgaaattgagatagttacctttcagaaaattagagaatgttaatgtagatgtgttattcttcggaaggtaggagaaaaggtaaaactataaaaataaaaagaaaagagacttttttaatcaaaattcaagtttgaaactcatgtagttaacccattccattttcttttggttaattccagaaaaatggaacaattgactgctgagccgtatgaggcaggaaactctcaagtacggttctaagggaaggaatttactcacctattccgaccgcggagaacaggccattcgacagggagattccgaaattgctgaggcttggtttgatcaagccgctgaatattgggaaacaagctatagcccttacccccggtaattatattgaagcacagaattggttgaagatcacagggcgttcttaatttaataaaacactctttttttagttctatttatattattctatatacccttatatcttaatatatattatttccatatttatttttatatttcttactatatttatcttactaaataatcttatttatatattattatatttaatatttagttttagaatatttaatgcatatttcatttaaatgtatatttaatgtatttaaatgtatatttaatgtaattaaatgtttgttgtctacatcagtccatccaataaaactgaaaatttagaataatattctatatatctattatataaatatattaggctatagtaatagtcaatccaaaaattccattatatcccttctaaaaaaatcgttctttttcgtctcgtattttgtagagataaatggtatgtggatacagcagagaatttgccttttttctgttattcaaactaaagtgaaactcaaaaaagagaactcaaaaaaactaaaagaatagcagtatggcctctagcaatgctgatgactgctcacgtaattggaaatagagtgcataataatctcttctattaaattatttaataagacagacataaaataaattccatctttgaatttcaaattcaaatctgaatcccctagcctaggttgcacaaaaaattattgaattgaaattcaaagtccagaaggagttttagaggattcaaaaggtccgttgagcgcctatatcttatgtcataatagattcgaacacttgccccggattaacttccggatcataattgttctagtgaataactaaagaaaaaattggaatagatagatgggagatagaatagaaagaaactcaatataaaaatctctcaaaagttcactaatcttttttttatattggcaggtctctttgtatgtgttgtccggaaggaggaggactcaatgattattcgttcgccggaaccagaagtaaagattttggtagatagagatcccataaaaacttctttcgaggaatgggcaaaacccggtcatttctcaagaacaatagctaagggacccgatactactacttggatttggaacctacatgctgatgctcatgatttcgatagccatactagtgatttagaggagatttcccgaaaagtatttagtgcccatttcggccaactctccatcatctttctttggcttagtggcatgtatttccatggtgctcgtttttccaattatgaagcatggctaagtgatccaactcacattggacctagtgcccaagtggtttggccaatagtgggccaagaaatattaaatggtgatgttggcgggggtttccgaggaatacaaataacctccggttttttccagatttggcgagcatctggaataactagtgaattacaactttattgcaccgcaattggtgcattagtatttgcagccttaatgctttttgctggttggtttcattatcacaaagctgctccaaaattggcttggttccaagatgtagaatctatgttgaatcaccatttggcaggattactaggacttggatctctttcttgggccgggcatcaagtacatgtatctttaccaattaaccaattttaaatgctggagtagatccaaaggagattccacttcctcatgaatttctcttgaatcgggatcttttggctcaactttatcccagttttgccgagggagcaactccatttttcaccttgaattggtcaaaatacgcggattttcttacttttcgtggaggattagatccagtaactggcggtttatggctgactgatattgcgcaccatcatttagctattgcgattcttttcctgatagctggtcacatgtatagaaccaactgggggattggtcatggtataaaagagatcttagaggcccataagggtccatttacaggccagggtcataaaggtctatatgagatcctaacaacttcatggcatgctcaattatctattaacttagctatgttaggctctttgactattgttgtagctcaccatatgtattctatgcctccttatccatacctagctaccgactatgggacccaactatcattgttcacacatcacatgtggattggtggatttctcatagttggtgctgctgcgcacgcagccatttttatggtaagagactatgatccaactactcgatacaacgatctattagatcgtgtccttaggcatcgcgatgcaatcatatcacatctaaactgggtatgcatatttttaggctttcacagttttggtttgtatattcataatgataccatgagcgctttagggcgcccccaagatatgttttcagataccgctatacaattacaacccgtctttgctcaatggatacaaaatacccacgctttagcaccgaacacaacggctcctggtgcaacaacaagcaccagtttgacttggggcggtggtgatttagtggcagtggggggcaaggttgctttgttacctattccattaggaactgcagattttttggtccatcacattcatgcatttacaattcatgtaacggtattgatactcctaaagggtgttctatttgctcgtagctcgcgattaataccggataaagcaaatctcggttttcgtttcccttgtgatggacccggaagaggagggacatgccaagtatccgcttgggatcatgtcttcttggggctattctggatgtacaatgcaatttcagtagtcatattccatttcagttggaaaatgcaatcagatgtttggggtactataagcgatcaaggggtagttactcatatcacaggaggaaactttgcgcagagttccattaccattaatgggtggctccgcgatttcttatgggcgcaagcctcccaggtaattcagtcttatggttcttcattatctgcatatggtctctttttcttgggtgcccattttgtatgggcttttagtttaatgtttctattcagcgggcgtggttattggcaagaacttattgaatccatcgtttgggctcataataaattaaaagttgctcctgctactcagcctagagccttgagtattgtacagggacgtgctgtaggagtaacccattaccttctgggtggaattgccacaacatgggcattcttcttagcaagaattattgcagtaggataatggctaggaggatttgaaaagcattatggcattaagatttccaaggtttagccaaggtttagctcaggaccccactactcgtcgtatttggtttggtattgctaccgcacatgacttcgagagtcatgatgatattactgaggaacgtctttatcaaaatatttttgcttcgcatttcggacaattagcaataatttttctgtggacttccgggaatctgtttcatgtagcttggcagggaaattttgagacatgggtacaggatcctttacatgtaagacctattgctcatgcaatttgggatcctcattttggtcaaccggctgtagaagcttttactcgtgggggtgctcttggtccagtgaatattgcctattccggtgtttatcagtggtggtatacaatcggtttacgtactaatggggatctttatactggagctctttttctattatttctttcagccatatccttaatagcggggtggttacacctacaaccgaaatggaaaccgagcgtttcttggtttaaaaatgccgaatcccgtcttaatcatcatttgtcaggactattcggagtcagttccttggcttggacaggacatttagttcatgtcgctattccaggagctagaggggaatacgttcgatggaataattttttaggtgtattgccacatcctcaaggattaggtccactttttacaggccagtggaatctttatgctcaaaacccagattccagtagtcatttatttggtacccctcagggagcaggaactgccattctaacacttcttgggggattccatccacaaacgcaaagcttatggctgaccgatattgcgcaccatcatttagctattgcgattcttttcctgatagctggtcacatgtatagaaccaacttcgggattggccacagtataaaagagatcttagaagcacacattcctccagggggtagattggggcgtggacataagggtctttatgacacaatcaataattcacttcattttcaattaggtcttgctctagcctctttaggagttattacttccttggtagctcaacacatgtactctttacctgcttatgcgtttatagcgcaagattttactactcaagcggcgttatatactcatcatcaatacatcgcaggattcattatgacaggagcttttgctcatggagctatattttttattagagattacaatccagaacaaaacgaggataatgtattggcaagaatgttagaccacaaagaagctataatatcgcatttaagttgggccagcctgtttctggggttccatactttgggactttatgtccataatgatgtcatgcttgcttttggcactccggaaaaacaaatcttgatcgaacccatatttgcccaatggatacaatctgcgcatggtaaaacttcatacggcttcgatgtactgttatcttcaacgaatagtccggcgttcaatgcggggcgaagcatatggttgcccggttggttaaatgctataaatgagagtagtaattctctattcttaacaataggacccggagatttcttagttcatcatgctattgctctaggtttacatacaactacattgatcttagtaaaaggtgctttggatgcacgtggttccaagttaatgcagataaaaagattttggttatagttttccttgcgatggtccgggacgaggtggtacttgtgatatttcggcttgggacgcattttatttggcagttttctggatgttaaatacgattggctgggttactttttactggcattggaaacacattacactatggcagggtaatatctcacagtttaatgaatcttctacctatttgatgggatggttaagagattatctatggttaaactcttcacaacttatcaatggatataacccctttggtatgaatagtttatccgtctgggcatggatgttcttatttggacatcttgtttgggctactggatttatgttcttaatctcctggcgcggatattggcaggaattgattgaaactttagcatgggctcatgaacgcacacctttggctaatttgattcgctggagagataaaccagtggctctttccattgtgcaagcgagattggttggattagcccacttttctgtaggttatatatttacttatgcagcgttcttgattgcctctacatcgggcaaatttggttaattttttttgtatccgcatcctttccttctatggagaaggtggtttacagacctcttctatattcaatttctacttctatttctacatctaggatccgacttgtatgattgattgatactaataggaaattaaccattatggcaaggaaaagtttgattgagagggagaagaagagaaaaaaattggaacaaaaatattatttgattcgccgatccttaaaaaaagaaataagcaaagttccgtcgttaagtcaaaaatgggaaattcatggaaagttagaatcactaccgcgtaatagtgcacctacacgtcttcatcgacgttgtttttgaccggaagaccaagagcaaattatcggatttgggttatctggacacatacttcgtgaaatggttaatgcatctttgttgcctggtgcaacaagatcgagttggtaagggcaggttaaaaaattctcctcaatgttttattcatttttatgatcaacgatcataagagggcccctttaccattctgtacaaatagaataaaccatttcc

SEQ ID NO: 929 - DNA, 997 bp, Quercus alba
caaaatcacgaaaagaacctttcattttttttataaatatacaaatccaatacggtccggatatttatccaattcatctaattattctttgtggtaaatactctaggggatgtcgcttcatttatcatttagtttagttttaatttaagtttatgaaatttcaataaaataaggagtctttatgtcgcgttacagagggcctcgtttcaaaaaaatacgacgtctgggggctttaccgggactaactagtaaaaggcctaaagccggaagcgatcttagaaaccaatcacgttccagtaaaaaatctcaatatcgtattcgtttagaagaaaaacaaaaattgcgttttcattatggtcttacagaacgacaattacttaaatacgttcgtattgccggaaaagccaaagggtcaacgggtcgggttttactacaattacttgaaatgcgtttggataacatcctttttcgattgggtatggcctcgactattccccaagcccgccaattagttaaccatagacatattttagttaatggtcgtatagtagatataccaagttatcgctgcaaaccccaagatattattacagcgagggatgaacaaaaatatagagctctgattaaaaattgtcttgattcatcccctcgtgatgaggaattaccaaaacatttgacttttcacccattccaatataaaggattagtcaatcaaataatagatagtaaatgggtcggtttgaaaataaatgaattgctagttgtagaatattattctcgtcagacttaaacctaattaaaataaaacaacaagggttcggacaccttttccctctttcgcctaagcaaaaagaccgacaaaagtaaggaatttgatatggggatctttctcccattcaaggatcatggatcacggatcggtagggaaattttcattccctgttgtccactctttacagtattttccgactaaagaaattaggaataaggaatctta

SEQ ID NO: 930 - DNA, 11141 bp, Vitis vinifera
ctccaggttgaggagttactcggaatgctgccaagatatcagtaggtttggtctcatattcaggagtataataagtcaatttgtaatctttaacaccggctttgaatccaacacttgctttagtctctgtttgtggtgacataagtccctccctacaactcacgaattaagaattttcacaacaacaaaacaaggtctactcgacatgaattaggtgttaatgaaacctttcacaggaatctttcacaaaattctcaactaatattatcaactaatcagaatggttcattattagatcatggtatttaattcgccaaatacattattattttatactctgtcatatgtatggcgcaacccaatctttgtttttcaagtttctaattccttactttttctttttttgaatcgaaatatctaaatataaataataataaattcaccccttgacagtgatatatgttgtatatgtaaatcctaggtgtgaaaatatgaagaattcatccattaacattaaaagaaaaggtataaaaaagaaaagaataggcttaggctaggcgtaaatcgatatgctgaaataagaaataaataagagtcaatgagaaatgagatagaaataatgaatcgtaaatagagttcaggttcgaattccataaagaatatggatgggattgtctataatgatagacaaatgaaagactttcataatcttattcatcattttgaaaacggcttggttgaacttaaaaattagctcattgaataagtaaacaattgaattggattcggttggatggtaccaacgaaatcgagtgctaactcccatttcttattgaattaaccgatcaactttctatcgaacttttggattcgataattttcgcaaaaaatttcgtttaatttgactttattattattattatgagaataaatcctactacttctggtcctggggtttccacgcttgaaaaaaaaaacctggggcgtatcgctcaaatcattggtccggtcctggatgtagcttttcccccgggcaagatgcctaatatttacaatgcgctggtagttaagggtcgagatactgtcggtcaacaaattaatgtgacttgtgaggtacagcaattattaggaaataatcgagttagagctgtggctatgagtgctacagatggtctaatgagaggaatggaagtgattgacacgggagctcctctaagtgttccagtcggtggagcgactctcggacgaattttcaacgtgcttggagagcctgttgataatttaggtcctgtagatactcgcacaacatctcctattcatagatctgcgcccgcctttatacagttagatacaaaattatccatttttgaaacaggaattaaagtagtggatcttttagctccttatcgccgtggaggaaaaattggactattcgggggagctggagtgggtaaaacagtactcattatggaattgatcaacaacattgccaaagctcatgggggtgtatctgtatttggcggagtaggtgaacgtactcgtgaaggaaatgatctttacatggaaatgaaagaatctggagtgattaatgaaaaaaatatttcagaatcaaaagtggctctagtctacggtcagatgaatgaaccgccgggagctcgtatgagagttggtttgactgccctaactatggcggaatatttccgagatgttaatgaacaagacgtacttctatttatcgacaatatcttccgtttcgtccaagcaggatccgaagtatctgccttattgggcagaatgccttccgctgtgggttatcaacctacccttagtaccgaaatgggtactttacaagaaagaattacttctaccaaggaggggtccataacttctattcaagcagtttatgtacctgcggacgatttgaccgaccctgcccctgccacaacatttgcacatttagatgctactaccgtactatcaagaggattagctgccaaaggtatctatccagcagtagatcctttagattcaacgtcaactatgctccaacctcgtatcgttggtgaggaacattatgaaactgcgcaaagagttaagcaaactttacaacgttacaaagaacttcaagacattatagctatccttgggttggacgaattatccgaagaggatcgtttaaccgtagcaagagcacgaaaaattgagcgtttcttatcacaaccctttttcgtagcagaagtatttaccggttctccagggaaatatgttggtctagcagaaacaattagagggtttcaattgatcctttccggagaattagatggtcttcccgaacaggccttttatttggtaggtaacatcgatgaagctaccgcgaaggctatgaacttagaaatggagagcaaattgaagaaatgaccttaaatctttgtgtactgacccctaatcgaattgtttgggattcaaaagtaaaagaaatcattttatctactaatagtggacaaattggcatattaccaaatcacgcccctattgccacagctgtagatataggtattttgagaatacgccttaacgaccaatggttaacgatggctctgatgggcggttttgctagaataggcaataatgagatcactgttttagtaaatgatgcggagaagggtagtgacattgagccacaagaagctcagcaaactcttgaaatagcggaagctaacttgaggaaagctgaaggcaagagacaaataattgaggcaaatctagctcttagacgagctaggacacgagtagaggctatcaatgtgacttcgtaactagtcatgtgcccgaaaaatcaaaagaagttctgtttatacaccctattttgattctgccgattgaatacaatcaaatacaatcaaatggaatgggattctgatgcaacgaaaaataaaattgcattttaaagccaaaaagcaaatagaataggatggaaaagatacaaaatcaataaaagaaggtgggtagaaaacttattagataccattgactctggtatctaataagttctacctactattggatttgaaccaatgactcccgccgtatgaaagcaatactctaaccactgagttaagtaggtcatttatcatcctaaggagaaacaaatggaacccatcacatcgatggattataaatagaatattatttataagcaataccaatcaaacagatcaaagagttatcatgttggatcatggaatattcatcttgacaagaaattatctacatgataaaatatgtatcacaagtacaagggctatagctcagttaggtagagcacctcgtttacacgcgcgccaatgtttttcaggagagtccatcatgcattgatcttattgagaaatcgatgtcttactccatgactttgagggaacaagagaacaatagcctgacaaacgattcggtccgatttgggtgcccatttaatttaagcgccaaatagaacccatcattttgagatattgataaggtgaatacccagtctattcaatgctaggcctaatgagtataaggacctcaaaaaaaatctcttttcgtcctatgaactttaaggtgtatgaagtttcatatttgattctttaatcagaacgatagagactccatttaacttaagttgatctaggccaaaggcagacctacgtcaagataaccctctttgaaaaactttggtagtgctcctggatcagaatcaaaataatgaatcagagcacatggagccatctctttatctttctgtcaagaaaaaatatggtggactaactgatatttatatcagttaatgaaagagcccaatgcaaaaaaaatgcatgttgggtctttgaaacagttcaaatcattttgataataatcagtttgatctgttttaccgagaaggtctacggttcgagtccgtatagccctaatataataaataagccctataaaataaaaaaatgaaaaacaaaaaacgcatttcaatggatccactcggtatttttccagtctcggataaacaaacaaatttttcttcattttgttttttcttcattaatctttgtaagtaaattacatatgaattttcctgtccacaatcaaagagttagtgatatttcttttctttggctttggtatacctacctaatcctggtgaatttttggagtcaaaatcatgacatgagcccagttaaaaataaaaaactccaacccaaatcaaatctaatagaaatctaatctaatagtaagtcacatggatatagaacgacctgggtacaaaccagggtttgaaaaacgaaaatctttgctaagtttcattataaactgtaaacattctcaacattgttaaataggttttttttcttggtataccttacctagcaaagcacaaaaaaaataagtagtcttctctttccgtatccaatcaatacaagttcctatatctggattctaataactaataaaaggaatataccaacaccaatattatctaaatcctgaaatgtaaattcctagacattctcctacatctgattgcttacgctattctaaatcactaagcaaaaagagacaaaaagaagacagccctcctctttgatgattctagtcataaacataaaaaatagaaaataaaaaaaatagatttccattttgaatattaatttttaattaataattattaattaataaaatttttaattaaaagaaaaaatggaattcgaatttataaacaaaaactcaaaattctatttgttgaaattctttttgtttagagagagtccaaggtgaggtgaaagtgagaaggttttatttgtataagagcaatatatatttataatatatcgaaataaaatcgaagtaagtataatggaaataggattccagtcaatgaatcttcaaaggagatacgtaccacagcaaacaaacgaaactagtcggttcgatcaaaataaaatgaattcttgttttgactaaacagttatggatgacttgacaattccaatttgagtcggctaatccagtatattttccacattcataggagtgcttctatgtttctgctttacgaatatgatattttctgggcttttctaataatatcaagtgttattcccattttggcattttttatttccggagttttagctccgattagtaaaggaccagagaaactttctagttatgaatcgggtatagaaccaatgggcgatgcttggttacaatttcgaatccgttattatatgtttgctctagtttttgtcgtttttgatgttgaaacggtttttctttatccatgggcaatgagtttcgatgtattgggtgtatccgtatttatagaagctttaattttcgtgcttatcctaattgttggttcagtttatgcatggcgaaaaggagcattggaatggtcttagctcctgaatattcagacaataaaaagggaaaaaaaaataacattgagacagttatgaattctattgagtttcccttacttgatcgaacaacccaaaattcagttatttcaactacatcaaacgatctttcaaattggtcaagactctccagcttatggccgcttctctatggtaccagttgttgcttcattgaatttgcttcattaataggatcgcgattcgactttgatcgttatggactggtaccaaggtcgagtcctagacaagcggacctaattttaacagctggtacagtaacaatgaaaatggctccttctttagtgagattatatgagcaaatgcctgaaccaaaatatgttattgctatgggagcatgcacaattacaggggggatgttcagtacagattcttatagtactgttcggggagtcgataagcttattcctgtggatgtctatttgccgggctgtccacctaaaccggaggctgttatagatgctataacaaaacttcgtaagaaaatatctcgagaaatctatgaagatagaatcaggtctcaacaagagaatcggtgttttactaccaatcacaagtttcatgttggacgcagtactcatactggaaattatgatcaaaggttactctatcaatccccatctacttcagagatccctcttgaaacatttttcaaatacaaaagttcagtatcttcccccgaatttgtgaattagtcaagattcttttgtacagaataacaagcagcacataaatttcatcgtaaatgcgaaatacttatcaaataaaaatgcaggagagattaaaaagatgcagggtcgtttgtctgcttggctagtcaagcatgggctagttcatagatctttgggcttcgattatcaaggaatagagactttacaaataaagcccgaggattggcattccattgctgtcattttatatgtatatggttataattatctacgctcacaatgtgcctatgatgtagcaccaggaggactgttagctagtgtgtatcatcttacgagaatagagtatggtgtagatcaaccggaagaggtatgcataaaagtatttgcctcaaggaggaatcctagaattccgtctgttttctgggtttggaaaagtgcggattttcaagaacgagaatcttatgatatgttgggaatctcttatgataatcatccacgcctgaagcgtatcttaatgcctgaaagttggataggatggcccttacgtaaagattatattgcacctaatttttatgaaatacaagatgctcattgaatgataataaactaatcttcacttctacaactccagatattcaagaaatatctgtacgttttggtctagatcaaacagaataattgaagtcttattcgtattgtattatggatgggctaaataaataaaaaaaaaagaaaaggactcattgagattctcaaattttgaagatacttagagcctagccaataggatgaactaaaagaaaagagttctgcatcatgaactttgtaccgcgcacataacttagatgggctctagaaaatcacgtaggggggaatgaagaaatagaaaatagaatatgaaagaaaatacaaagaaatgaaaggggatcggattatatttgtactatatctgagatgaaccttgtctattcccatccttcaactactctagactatacttttgggtctttcaactaactaatttaatctttcgaatatgtatgtatgaagtattaacattctttttgaatgagagtagacaagacacaatatgaacaaaaaaaataaaaaagaagaggaaacataatcgaattcttttcttttacatattttatatactttttacttatctaaaagatggaggagtatatctccagacacctagagggataagtatatatcatgatctagactattaatgaatatgtatatcgattcatctaaacatcaatgaatttgtagaatagatactcagacaaattaatcatgtgccaggaaccagatttgaactggtgacacgaggattttcagtcctctgctctaccagctgagctatcccggctattcccgatacatcatcctcattttactagatgacttggtctatgtcaattaaaaataaaaagacgaaagggtattgtattacaaaacaaagtattatccaggacctggaatttcttggatcttcaaaaaaaaaaactttgtaagtttcagtacgaataatgatatgtactgtgaatcattcaaatggagattccttgctcaaagatgttcgtttgtacgcgtatcatatatatataccacaagacttgtgataagagaaaaaaaatttctgcaaagagaggataggataggataaatagttagggagtcaagtaggcttttttggggatagagggacttgaaccctcacgattttaaaagtcgacggattttcctcttactataaatttcattgttgtcggtattgacatgtagaatgggactctatctttattctcgtccgattaatcagttcttcaaaagatctatcggactatggagtgaatgatttgatcaatgaatattcgattcttttctttcttcaacttggaatcgatttacaacaattctttcatttttcatatcaaaaaatacagattcgagccatcattaatcatttgatataatatttcagtacctatgtatataggtttatccttcatcctttctggttctggagttttgatggaaggattcgtttaacaacgcaacatagtcaactccatttgtttttgttagaacagcttccattgagtctctgcacctatcctttttttattatcgttttctgaacccttggttgttttcggaaaacaggatttggctcaggattgcccattttttattccagggtttccctgaatttgaaagttatcacttagtaggtttccatattaaggctcaatccaattaagtccgtagcgtctaccaatttcgccatatccccccttattttgttttgagatttgaatctctttgtgatgccgctccccttttcctttcatttatgcttatgctggaacctttgaattcattagataccgattcctaaaaagtccttcctcctttttttcttgcctatcttctttcatctcatctctcttggggaccatatttgtatttggtccaatcagaaatgattctatcatttctgtatctgcaattcaatatacatgagatatataccacacatatatgcttcccttcttctcatctttctcatacaatttgagaatactcgaacggtcgattcttttttttgtcttagcttccacctttccgaatgaaagcagaggaatgtctcattatgatctgaattgcatttatctggattgcatctttctatttcatttttcttatcctttccttagtccttagagcagaccctctataactaaaatgggaattcattaatgattatttaatgatcactaagtattaatatattttaaaaatgaaaaaattatattatggaattctaatgtatatgtatattagaataataagattctaatctaataattagatagagaatttctatcttatatagaaaagtatatgatatatgatatgtaatcatatcctatatgtaataatattataatataaaacaataaaataaatttcaaattttatttgaattcaaaaagaaaaatgaaaaaaaaaaaagaaaaccttactatctaattaagatattgattatttttaaacatataattgataaatagatcgaaattatatattgctctattctattaatcgttaatattcaatatttttttttgaatctatattctttattcttttatatattcatattaattgtgactagctaagaaggaatagttaatagctaagataccagcagtttactgaatttctatgcatgtacaatttctggtgagcccgcttagctcagaggttagagcatcgcatttgtaatgcgatggtcatcggttcgattccgatagctggcttttctctatttgtttggttattgataatgtctctttaaaatcaaagaataaagattattctcctttctccaaaaccgatctattatgtcgtaggaacttacaactatgaatcaaaatagaaggagttagatctctgcagaacaaatcaagaacaatacaaaagggtctggatattgagacaattcatctcattattctttgtagtacaatacttcagtagatttcgcttcatttatcatttagttcagttttaatttaagtttttctgtaaaatgaaatttcaataaaataaggagtctttatgtcgcgttaccgagggcctcgtttcaaaaaaatacgccgtctgggggctttaccgggactaactagtaaaaggcctagagccggaagtgatcttagaaaccaatcgcgttccgggaaaagatctcaatatcgtattcgtctagaagaaaaacaaaaattgcgttttcattatggtcttacagaacgccaattacttaactatgttcgtatcgccggaaaagccaaaggggcaacaggtcgggttttactccaattacttgaaatgcgtttggataacatcctttttcgattgggtatggcttcgactattcctggagcccgccaattagttaatcatagacatattttagttaatggtcgtatagtagatataccaagttatcgctgcaaaccccgagatattattacggcggggaatgaacaaaaatccagagctctgattcaaaatgtttttgattcatcctcccatgaggaattgccaaaacatttgactcttcacccattccaatttaaaggattagtcaatcaaataatagatagtaactgggtcggtttgaaaataaatgaattgctagtcgtagaatattattcccgtcagacttaaacctaactaaaataacgagggttcggtcaatttgaccccccccctttttcgccgaagtaaattgacctacggtaaggggtcagagatttttctcccattcatatatcatagatcggcagggatatttttattccttgtcccccctttacagtacagtattttatgtaccacagcaattaggaatagagaatctatatcaaagaaaggtctaactgttggaatatttgttatttgatacagtgcggtcagtaacattggtgaattaggtgaaggtacggaaagagagggattcgaaccctcggtaaacaaaagcctacatagcagttccaatgctacgccttgaaccactcggccatctctcctacataatgattatgacccagaaaccgagtgaatagcgagtcatttagattattggataggtatgaccaatccaattctaactctaaatataaggattccctttttttagactatggttaatggatatttttagatcatgattctatttagactatgattccatttccataagaattttaaaattcctttccagttttagatttctcaacaacaaccccttacctcatagatctattacaaattcatgaatcatcccagggatttttatatttgtatatttgattgtatagtgtatacccactatgcacacaacacaaaatggacggttattccattttcataaaatgattattcgattctttttcctctttggatcacaattcaatcaaaactt

SEQ ID NO: 931 - DNA, 629 bp, Lotus japonicus
tctttatgtcacgttaccgagggcctcgaatcaaaaagatacgccgtctgggggctttaccgggactaaccagtaaaaggcctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatcgaaagctctgattcaaaattctcttgaatcagcccccccgtgaggaattgccaacccatttgactcttcagccattccaatataaaggattagtaaatcaaataatagatagtaaatgggttggtttgaaaattaatgaattgctagttgtagaatattattctcgtcagacttaaaccgaattaaaataaca

SEQ ID NO: 932 - DNA, 893 bp, Juglans hindsii x Juglans regia
  misc_feature (714)..(714): n is a, c, g, or t
tcataaaaaataaaataaggagtctttatgtcgcgttacagagggcctcgtttcaaaaaagtacgccgtctgggggctttaccgggactaactagtaaaaggcttaaagccggaagcgatgttagaaaccaatcacgttccagtaaaaaatctcaatatcgtattcgtttggaagaaaaacaaaaattgcgttttcattatggtcttacagaacgacaattacttaaatacgttcgtattgccggaaaagccaaagggtcaacaggtcaggttttactacaattacttgaaatgcgtttggataacatccttttcgattgggtatgacttcaactattccccaagcccgccaattagttaaccatagacatattttagttaatggtcgtatagtagatataccaagttatcgctgcaaaccccaagatattattacagcgagggatgaacaaaaatctagagctctgattcaaaattatcttgattcatccccccgtgaggaattgccaaaacatttgacccttcacccattccaatataaaggattagtcaatcaaataatagatagtaaatgggtcggtttgaaaataaatgaattgctagttgtagaatattattctcgtcagacttaaacctaattaaaataaaaataggggttcgaacaatatttttttttctgtactgcagaaattaggaataaagaatctatatcanaatcaaagaaaggtctaacttaactgttggaataacggtatccattgttatttgctttgatacattgctgtcaataagattggtgaattaggtgaaagatacggaaagagagggattcgaaccctcggtaaacaaaagcctacatagcaattccaatgctacgccttgaaccactcggc

SEQ ID NO: 933 - DNA, 3679 bp, Gossypium hirsutum
gactagaaaatcgaatttaataatttaaatagtaccgtaatttatttaattaaattaaatattaaataaatggatttaatagaaattaaatagaaatagaattaaatagaattctctaatttctaattcgaatttcgaatcctaaaactaaaataataataaataaacagagagctcttgttcttattcgaaacgccgcgtgatctttaaccaattctgcgcttcaatataattaccaggagtaagcgctatagcctgtttccaatactcagcggcttgatcgaaccaagcctccgctatttcagaatccccctgtcgaatggcctgttctccccggtcgaaataggcggttcaattccttcccttagaaccgtacttgagagtttcctacctcatacggctcggcagtcaattcttttggtatcccatttttttaccctaccatatatccaattgaatgagatttctcatagatctattgatttgtctcgggttaaccaaaaggggttaattacatgagtttcaaactctaatttggattaaattaataataagttttatcttttctcccaccttcagaaaaataaagcataggcatttcggggctgtcgtccgttagatttttctgaaaggtaactatctcggtttcatatcatatagaaatttatatagaatccttgaaaaagacttcttcctcataaaaaagacttactgtctttgggatctgatgctacaccgctgctcaataacttaggggatcggctctattacataagtcgattcctaatttttatctcatatcatgacataaataagcagttcttatttattgtatcggctcaaaacctcgctaattgatctttacggtgcttcctctatcaattagatctttatccatagaataaagtatctaggcatatatatttcttcatatttcgacttctatgaagtttctttttttgttacagctgataaaaatcgttttttggacgatgcaatatgtagaaagcctatttttttttctagtattttatttactagcgtgtttatttactagcgtatttatttactagcgtatttgctctttctttcctttttttatttctatagtggagatagtcgcacgtaatgacagatcacagccatattattaaaagcttgtggtaagaacgggtttcgttctagtgctcgaaaataatattctaaagcttttgtatgctctccattacttgtgtggataaggcctatgttatatagtatataacttcgatcatagggatcaatttctagtcgcatagcttcataataattctgtaaggcctccgcataatttccttcggattgagccgacatccgttacggtcgtcattcgattcaaagaattctccgttccaaaaccgtacatgagattttcacctcatacggctcctcctttatgtgcataatgagaataatccatggaattaaaaaaaaggtcgaaatattgtcattatgaactgagcggggctaatgtttttacaagaaatctctagccaaccctcttgcaaaagatcttttcttaccatcaagcgtgttcgtactagataaaaaagtaaactccaacaatttctttgttctcaacgctccttaatttccaggaattagtcacttcaacaatcttcgatggttatatgggtatccaaagtacgaacaagatggatgtttgttgtcccaaccatttctcttagttccgatcccgataaagaaagggaatcattaataacaaagttttcgtgttgttgattcctaggcgtagtgcttcttcctctatgccgcctattggtactagtgtagtagggttgacccacaatacagacccataggtgtaacctttcgctcaatactcgaatcaacaattgaagcatctgaggttgcattaatcggggatacacgacagaaggaattgctttatttataaacttcaccttcaacaagcgtagatttcttttttgttttcaatagccttttttctattctgaataatgtgtctttttcctaagactgagagtggtaaagtaaataaaaaagtaaataataaataaagaataaagagaataaagtaaaatatatatataataataatcaaatcgcaccatctctgtaataagtaaatgcctctttttctcctgaagttgtcggaattattcgtaataagatattggctacaattgaaaaggtcttatcaataaaatttccatttatctgcgatctaggcataggtagcaatccattctataactcttttcattacccctcgtgagaaaataaaatgatctcacaaacaaaggaagtgtacagtacgaaataacataaaagtagacccattccattttttaaaaattcttcgagcccggaggctaaagaaaaagtgataaaaaaaaagtgatgaaaagttttctatttttatagcaagtttcctagttagaattgatattgttcgtacctatcgaacaatctaatatgagtaactcgctattcgctcggggtatcggccataataattatgtaggagagatggccgagtggttcaaggcgtagcattggaactgctatgtagactcttgtttaccgagggttcgaatccctctctttccgcaccttcacctaattcgccaatgtaactgactacaatgtatcaaataagaacatatactaaagaattagacccttctttagtatagattctctattcccaattcctttttaatatggaatacgtaaaatagcatacaggggatgaaaatctccttacgtatctatcatacatgaataggagaaaaatctccgaatcaaacccattcccctgtcttcctttacttaaccttaactcaggtgaaaagggggcagaacccttgttttgttattttagttaggtttaagtctgacgagaataatattctacgacaagcaattcatttattttcaaaccaacccatttcctatctattatttgattgactaatcctttatattgtaatgtgtgaaaggtcaaatgttttggtaattcctcattggtggatgaatcaagataattttgaatcagagttctagatttttgttcatccctcgctgaaataatatctcggggtttgcagcgataacttggtatatctactgtacgcccattaactaaaatatgtctatggttaactaattgacgggcttgaggaatagtcgaagccatacccaatcgaaaaaggatgttatccaaccgcatttcaagtaattgtagtaaaacctgacctgttgaccctttggcttttctggcaatacgaacgtatttaagtaattgtcgttctgtaaggccataatgaaaacgcaatttttgtttttcttctaaacgaatacggtattgagattttttaccggggcgcgattggtttctaagatcgcttccggctctaggccttttactagttagtcccggtaaagcccccagacggcgtatttttttgaaacgaggccctcggtaacgtgacataaggactccttattaatttgaattttattgaaatttcataaaccgaaattaaaactgaactaaatgaagcgaaatcgactgaaggattgtactacaaatattaatgagatgaattggatcaatatccatactttactttttgttttttgtattgcccat

SEQ ID NO: 934 - DNA, 834 bp, Gossypium hirsutum
atgggcaatacaaaaaacaaaaagtaaagtatggatattgatccaattcatctcattaatatttgtagtacaatccttcagtcgatttcgcttcatttagttcagttttaatttcggtttatgaaatttcaataaaattcaaattaataaggagtccttatgtcacgttaccgagggcctcgtttcaaaaaaatacgccgtctgggggctttaccgggactaactagtaaaaggcctagagccggaagcgatcttagaaaccaatcgcgccccggtaaaaaatctcaataccgtattcgtttagaagaaaaacaaaaattgcgttttcattatggccttacagaacgacaattacttaaatacgttcgtattgccagaaaagccaaagggtcaacaggtcaggttttactacaattacttgaaatgcggttggataacatcctttttcgattgggtatggcttcgactattcctcaagcccgtcaattagttaaccatagacatattttagttaatgggcgtacagtagatataccaagttatcgctgcaaaccccgagatattatttcagcgagggatgaacaaaaatctagaactctgattcaaaattatcttgattcatccaccaatgaggaattaccaaaacatttgacctttcacacattacaatataaaggattagtcaatcaaataatagataggaaatgggttggtttgaaaataaatgaattgcttgtcgtagaatattattctcgtcagacttaaacctaactaaaataacaaaacaagggttctgcccccttttcacctgagttaaggttaagtaaaggaaga

SEQ ID NO: 935 - DNA, 970 bp, Vitis vinifera
gtttttctgtaaaatgaaatttcaataaaataaggagtctttatgtcgcgttaccgagggcctcgtttcaaaaaaatacgccgtctgggggctttaccgggactaactagtaaaaggcctagagccggaagtgatcttagaaaccaatcgcgttccgggaaaagatctcaatatcgtattcgtctagaagaaaaacaaaaattgcgttttcattatggtcttacagaacgccaattacttaactatgttcgtatcgccggaaaagccaaaggggcaacaggtcgggttttactccaattacttgaaatgcgtttggataacatcctttttcgattgggtatggcttcgactattcctggagcccgccaattagttaatcatagacatattttagttaatggtcgtatagtagatataccaagttatcgctgcaaaccccgagatattattacggcggggaatgaacaaaaatccagagctctgattcaaaatgtttttgattcatcctcccatgaggaattgccaaaacatttgactcttcacccattccaatttaaaggattagtcaatcaaataatagatagtaactgggtcggtttgaaaataaatgaattgctagtcgtagaatattattcccgtcagacttaaacctaactaaaataacgagggttcggtcaatttgaccccccccctttttcgccgaagtaaattgacctacggtaaggggtcagagatttttctcccattcatatatcatagatcggcagggatatttttattccttgtcccccctttacagtacagtattttatgtaccacagcaattaggaatagagaatctatatcaaagaaaggtctaactgttggaatatttgttatttgatacagtgcggtcagtaacattggtgaattaggtgaaggtacggaaagagagggattcgaaccctcggtaaacaaaagcctacatagc

SEQ ID NO: 936 - DNA, 628 bp, Lotus japonicus
tctttatgtcacgttaccgagggcctcgtttcaaaaagatacgccgtctgggggctttaccgggactaaccagtaaaaggcctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatctaaaactctgattcaaaattctcttgaatcagccccccgcgaggaattgccaacccatttgactcttcagccattccaatataaaggattagtaaatcaaataatagatagtaaatgggttggtttgaaaattaatgaattgctagttgtagaatattattctcgtcagacttaaaccgaataaaataacaa

SEQ ID NO: 937 - DNA, 1791 bp, Medicago truncatula
gttatttagtttagttttaatttagctttatgagattttccattttaaattaaaaaggagtgtttatgtcacgttacagagggcctcgtttcaaaaaaatacgtcgtctgggggctttaccaggactaactagtaaagggcctacagttggaagcgaacttaaaaaccaatcgcgctcgagtaaaaagtctcaatatcgtattcgtttagaagaaaaacaaaaattgcgttttcattatggtcttacagaacgacaattgcttaaatacgttcgtatcgctggaaaagcgaaaggttcaaccggtcaagttttactacaattacttgaaatgcgtttggataacatactttttcgattgggtatggcttcgactattcctcaagcccgtcaattagttaaccacagacatgttttagttaatggtcgtatagtagatataccaagttatcgttgcaaacccgaagatattattacagcgaaggatgaacaaaaatctagaactctgattcaaaattctcttgaatcagccccccgcgaaaaattgccaatccatttgactcttgatccattccaatataaaggattagtcaatcaaataatagatagtaaatgggttggtttgaaaattaatgaattgctggttgtagaatattattctcgtcagacttaaacctaattaaaataagaataattttgatccgaggatttccccccattcatgtatagacgtgggtgggtataggaaatttgttattccttgcccactttattccacgattttttttattacagaaaacagaaataaattaggaatagagaatccacatcaaagttggaataatgatatctatttgcaaacattgaggtcagtaacattgatgaacttgataagggtgcggaaagagagggattcgaaccctcggtaaacaaaaagcctacatagcagttccagtgctacgccttcaaccactcggccatctctcctacataatgattatgtccctcgagtgaatagtgaggcatagatattccatttgggtaggcgcacataatcaattgaaacgaacaaaaaaaaacttacttcgaggcctgccgtaggataaaattatttgattaataagtccatttttacgttatttcgtactgtattgtacaattcctttgtttgggggattcttttatcacgcgataaaaaatgaaattttagaatggattgctacctatgactagatctcggataaatggaaattttattgataagacctttaccattgtagccaatatcttattacgaataattccgacaacttctggagaaaaagaggcattcacttattacagagatgattctttgaaccgaatgacgaccgtaacggatgtcggctcaatctgaaggaaattatgcggaagctttacagaattattatgaggctatgcgactggaaattgatccctatgatcgaagttatatactttataacataggccttatacacacaagtaacggagaacatacgaaagctttggaatactattttagggcactcgaacgaaaccctttcttacctcaagcttttaacaatatggccgtgatctgtcattacggaaggaatttactcacctattccgaccgcggagaacaggccattcgacagggagattctgaaattgcggaatcttggtttgatcaagccgctgaatattggaaacaagctatagcccttacccctgggaattatattgaagcacagaattggttgaagatcacagggcgttttgaataagaacac

SEQ ID NO: 938 - DNA, 628 bp, Lotus japonicus
tctttatgtcacgttaccgagggcctcgtttcaaaaagatacgccgtctgggggctttaccgggactacccagtaaaaggcctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatctaaaactctgattcaaaattctcttgaatcagccccccgcgaggaattgccaacccatttgactcttcagccattccaatataaaggattagtaaatcaaataatagatagtaaatgggttggtttgaaaattaatgaattgctagttgtagaatattattctcgtcagacttaaaccgaattaaaataaca

SEQ ID NO: 939 - DNA, 9486 bp, Quercus alba
taagtctgacgagaataatattctacaactagcaattcatttattttcaaaccgacccatttactatctattatttgattgactaatcctttatattggaatgggtgaaaagtcaaatgttttggtaattcctcatcacgaggggatgaatcaagacaatttttaatcagagctctatatttttgttcatccctcgctgtaataatatcttggggtttgcagcgataacttggtatatctactatacgaccattaactaaaatatgtctatggttaactaattggcgggcttggggaatagtcgaggccatacccaatcgaaaaaggatgttatccaaacgcatttcaagtaattgtagtaaaacccgacccgttgaccctttggcttttccggcaatacgaacgtatttaagtaattgtcgttctgtaagaccataatgaaaacgcaatttttgtttttcttctaaacgaatacgatattgagattttttactggaacgtgattggtttctaagatcgcctccggctttaggccttttactagttagtcccggtaaagcccccagacgtcgtatttttttgaaacgaggccctctgtaacgcgacataaagactccttattttattgaaatttcataaacttaaattaaaactaaactaaatgataaatgaagcgacatcccctagagtatttaccacaaagaataattagatgaattggataaatatccggaccgtattggatttgtatatttaaaaaaaaaaatagaaaggttcttttcgtgatttgttatacagggatctagctcctataattttttatttagaatttgaagttcctacgacatagtagatcggtgactcttggaaaaaggggtacgaagctttttcaatattctttgatttcacaatatcaattatgtaaaaaaatcaaaaaataaagaaaagcctgctatcggaatcgaaccgatgaccatcgcattacaaatgcgatgctctaacctctgagctaagcgggctcgcataacaaaaattgtacatacataggaatttagtaaactaccgggatcttagctattaattgttcattcttagttttcataccataattaatatgaatatagaatagaatttcaaataaatattaaatagttgaatgaatatattctcgaacataacgattactattcgaaatggaatctaattagattagaatcttattctatacattataatcttacttatttattctaattctagatagattctaatttgaaataattctaattctaaatagttagatcaattagaaattaatagaataatataataagaaatttacattaataaatttcttttttttagtcatttttagttatgttatagagggtccgccttaacttaaggaaattaaaaaagtaaaggctacgaataaaaaaaatgaaaaagagaaggccgtaatccagatcataatgaaagattcctccgctttcgttcggaaagataaaacaaaaaaaaagaatcgaccgttcgagtatctcaaattacacgataaaaatgatataaaagaaagaggggcatacataatctatattggtatagataatatctatctatattgaattgcagatacagaaatgatagaatcatttctgattggatcaactctggatcttcgatagagatgaaatgagataaacaataaaaaataggagtaaacacttttcgatataggaattggtatctaataaattcaaagattccggcataaatgaaagaaaaaggaaaaagcgaggaaggacatcataatgagatcctaatcttaaaacaacaaaacaaaaatgggggatatggcgaaattggtagacgctacggacttaattggattgagccttggtatggaaacttaccaagtgataactttcaaattcagagaaaccctggaattaaaaatgggcaatcctgagccaaatcctattttacgaaaacaaataagggttcagaagaaagcaagaataaaaaaaggataggtgcagagactcaatggaagctgttctaacaagtggggttgacttctttacgttattacattaacgtaatccttatatcaaaactacagaaaggataaacctatatacatacgtatatgtacttaatgacgacccgaatctttatttatttatatttctataaataataaataaaaatcgaaagagttgttgtgaatcgatccaaattgaagaaagaatcgaatatttattaataaaatttatcgtacgagaataaagatagagtcccattccacacgtcaataccgacaagaatgaaatttataggaagaggaaaatccgtcgactttagaaatcgtgagggttcgagtccctctatccccaaaaaggcccgtttgattccccaattatttatccgatccgctcttttcgtttcgttagcggtttaaaattcgttatgtttttcaatcattctactcttttacaaatggatctgattggaaaatttttttttcttattacaatatttgtgatatatatgatacgcgtacaaatgaacatctttgaggaaggtatccccacttccaatttgaatgattaacaatacatatcatttcttgtactgtattaaaacttataaagttttctttttgaagatccaagaaattacagggtctggataaagctttgtaagactttttttgtctttttaattgacataaactcaagttatctattaaaataaggacgatgcacggataatggtcgggatagctcagctggtagagcagaggactgaaaaatcctcgtgtcaccagttcaaatctggttcctggcacatgatttatttgtatgagtatccgttttacaaatgaattgatatgggtcaacatacatattcattactagtctatatcatgatagatacttatctatctaggtgtctgagaatataccctttctagaattatagaatagatgagtaaagagtatgtctataaaatctgtaaaataaaaaaaattagatttgacttccttttcttttttatttgttcatacggtgtctcttaccgttcaaaaacaatgttaatactttagatatttaatacttcatacatattaaaatagaaaggttaaattaattggttgaaagactcaaaggtatagtctcgcggagttgaaaggtgggaataaccaagattcatttcagatacagtacaaataaaatccaagccctcctctcatttcgttgtcttttcttttcatattctatttcttcatttcctcctatgtgactttgtcgaactcatttaagttttgtgcgtggtacatagttcatgatgcgaaactcttttaggtcatcctaatactaattgtattttttaattgtcttgtttttatttatcctttttatttctattttttattgtttctattcaaataaataaatatataatatataaaaatagaaacaatttttttttattctatttattttgtattatttatttgtatttgatttatattttatttcgttttatttagcccatttagaatagaatgcgaatgagacttccattacgctctttggtctataagagaacgtacaaacattatttgaatacctggagttgtagaagtgaaaattagtttcttattttattatttatatttaatgagcatcctgtatttcataaaaattcggggcaatataatccttacgtaagggccatcctatccaactttcgggcattaagatacgtttcagacgtggatgattatcataaaagattcccaacatatcataagattccctttcttgaaaatccacactttttaggattccaccttggggcaaatacttttatacatacctcttctggttgatctataccataagctattctcgtaagatgatacacactagctaacagtccgcccggtgctacatcataggcacattgggaacgtaaataattgtaaccatatacatataaaatgacagcaatggaatgccaatccccaggctttatttgtaaagtctctattccttggtagtcgaagcccaaagatctatgaactaacccatgtttggctagccaagcagacaaacgaccttgcatcttttttatctctcccacattttgatttgtataaaacttttatttgtctctataagttaagtatttcacatttacgatgaaatttatgaaaattattgtttgttattatgtaaaaaaatgtgaaaaaaaaaaaatcctgcctaattcactaattcgggggaagatactgaactcttgttgtatttgaaaaatatttcaagagggatctccgaagtcgatgtagatggtggttgatcgagtaatcctcgatcataatttccagtatgagtacttcgtccaatataaaacttgtggttgatagtaaaacaccgactcccctgttgagacctaattcgatcttcatagatttctcgagatagttttttacgaagttttgttatagcatctataactgcctccggtttaggtggacaacctggcaaatagacatctacaggaattagcttatcgaccccccgaacagtagtataagaatcggtactgaacataccccctgtaattgtacatgctcccatagcaataacatattttggttcaggcatttgttcatataatctcactaaagaaggagccattttcattgttactgtacccgcagttaaaattaggtctgcctgtctaggactcgatcttggtaccagcccataacggtcaaagtcgaatcgtgagcctattaatgaagcaaattcaatgaaacaacaactggtaccatatagaagcggccacaaactggacagtcttgaccaatttgaaagatcatttaatgtagttgaaataactgaattttttgggggggctgttcgatcaagtaagggaaactcaatggaattcataaccgtttcaatgtttttttttactttctttatctttatttttattgtctgaatattcaagagctaagaccattccaatgctccttttcgccatgcataaactaaaccaacaattaggataagcacgaaaatgaaagcttctataaatacagatatacccaatacatcaaaactcattgcccatggataaagaaaaaccgtttcaacatcaaaaacaacaaaaactagagcaaacatataataccgaattcgaaattggagccaagcatcacccattggttctattcccgattcataactagaaagtttctctggccctttgcgaatcggggctaaaactcccgaaatcaaaaatgccaaaataggaatagcacttgctattattagaaatgcatatcatattcgtaaagtagaaacatagacggactccttgcatgcggaaaatatgccggattagttgattggaattggaatgaattgtcaagccatccataactctttagtcaaaacaaaacttcatttggatcgaactgcttagtttcgcctgtttgtttcggcacgtgtcaaccttccgctcacgattcatccactcgaatcccgtttctaatatatatattacttttatactatttctatttatactataaaactaagctataaaactaagagtctcgcggtttcacttcacttcggatttgaattttatataaattgattagaaggaactaaagagctaaagaaaaggaattttaatttaaatagcattctaattgttttgtttagaattctattattattaaaaatgaaatttctattagaaattcatattctaaattgaaataaaatctatttcttttttattctagttagattatagggctatacggactcgaaccgtagaccttctcggtaaaacagatcaaactaattattatcaaaatgatttgaaccgtttcaaagacccaacatgcatttttttgtgcattgggctctttcataaactgaaagaaatatcggctagtctaccatattttttcttgacataaagataaagagatggctccgtgtgctcggattcattattttgattccaataaaaaggagcactaccaaggtgtttcaaagaaggattatcctgacgtaggtctgcttttggcctagattaacttaagttaaatggagtatgtctctatcgacccgcttccgcttaacttaaagaagcaaatatgaaacttcatacaccttaaagatcataagataggacgaaaaaagaatttttttgaggtcttgatactcattatgcctagcattgaatagatgggatattcaccttatcaatatctcaaaccaacgcaaaggtgggttccatttatttggtaccgaacctaaatggaaatggacgcccggattggaccgaaccttttgtcaggctgttgttctcttgttttattcccgaaaacatagagtaagacatctatttatcaataaaatcaaatattttgattccatgacggacttctctgaaaaacattggcgcgcgtgtaaacgaggtgctctaccaactgagctatagcccttgtgcttgttctagttatacatattttatcatgtagataatttattgtcaagatgaatattacatgatccaacagccgattttttgtgatctctttgattggtattgcctatgagtaatatttcatttataatccatcgatgtcataggccccatttttttctctttgtgatgataaatgacctacttaactcagtggttagagtattgctttcatacggcgggagtcattggttcaaatccaatagtaggtatatcttattagataccatacccttgactctggtatctaataagtttttctactcatcttcttttattgattttgtatcttttccatcctactttatttctctatttttttattgaaattggtttgtcgttgcattagaattcaattacacttgattgcatttgattctatccaataggcataatcaccaaaacaaactagttacgaaatcatattaagagcctccactcgtgtcctagctcgtctgagagctagatttgcctcaattgttagctttactcaagttagcttccgctacttcaagagtttgctgagcttcttgtggatcaatgtcactacccttttccgcatcatttactaaaacagtgatctcattattacctattcgagcgaaaccgcccatcagagccatcgttagccattggtcagtaaggcgtattctcaaaatacctatatctacagccgtggcaataggcgcgtgattgggtaatatgccaatttgtccactattagtagataaaatgatttctttaacttctgaatcccaaacaattcgattcggggtcaatacacaaagatttaaggtcattgcttcaatttgctctccatttctaagtttgtagccttcgcagtagcttcatcgatgttacctaccaaataaaaagcctgttcaggaagaccatctaattctccggaaaggatcaatttaaaccctctaatggtttctgatagaccaacatattttcccggggaccccgtaaatacttctgctacgaaaaaaggttgtgataagaaacgctcaatttttcgtgctcttgctacggttaagcgatcctcttcggataattcgtccaatccaaggatagctataatgtcctgaagttctttgtaccgctgtaaagtttgtttaactctttgcgcagtttcataatgttcttcaccaacgatccgaggttggagcatagttgaagttgaatctaaaggatcgactgctggatagatacctttggcagctaatcctcttgatagtacggtagtagcatctaaatgtgcaaatgtcgtggcaggagcaggatcggtcaaatcgtccgcaggcacataaactgcttgaatagaagttatggatccttctttggtagaagtaattctttcttgtaaagaacccatttcggtactaagggtgggttgataacccacagcggaaggcattctacccaataaggcagatacttcggatcctgcttgaacgaaacggaagatattgtcgataaatagaagtacgtcttgttcattaacatctcggaaatattctgccatggttagggcagttaaaccaactctcatacgagctccaggcggttcattcatctgaccatatactagagctactttcgattctgcaatattttgttcattaattactccagattctttcatttccatgtaaagatcatttccttcacgagtacgttcacctactccgccaaatacagatacacccccatgagctttggcaatgttgttgatcaattccataatgagtactgttttacccactccagctcccccgaatagtcctatttttcctccacggcgataaggggctaaaagatctactactttaattcctgtttcaaaaatagataattttgtatctaactgtataaaagcaggcgcagatctatgaataggagatgttgtgcgagtatctacaggacctaaattgtcaacgggctctccaagcacgttgaaaattcgtcctaaagtcgctccgccgaccggaacgcttaaaggagctcccgtgtcaatcacttccattcctctcattagaccatctgtagcactcatagctacagctctaactcgattatttcctaataattgttgtacttcacaagtcacattaatttgttgaccggcagtatctcgacccttaactaccagagcgttgtaaatattaggcattttccggggggggaaagttacatccagtaccggaccgatgatttgagctatacgtcccaagtttttttttcaagcgcggaaaccccaggatcagaagtagtaggatttattctcataataaaatataatatgtcgaaatttttttttgcgaaaattattgaaataaaaaaaatgttcgatagaaaagcaagttgatcggttaattcaataataattccataataaatggggtttcgcactgcactagatttcgttggtaccatccaatcgaatccaattcgattgtttatttattcaatttcaatgagttaattttcaagttcaaccaactcattttcaaaatctcaggcggatcaataaaagtctttcatttgactatcattatagacaatatcatccatattatttatcgaattcgaaccggaactctatttctatttacgattcattttttctatcttattggtgcccttatctcatttcttagttaatatttaagcctatcgatttatgcctagccttttttttttacctataccctttagttttagagttttagtttcatgctttgcttttcatgggcgaactcctcctattttcacatctaggatttacatatacaacatatatcactgtcaagagttaatttcttattatttagatattccaatgggggcggggtaagagattagaaacttgagaaaacaaggattgggttgcgccatac

SEQ ID NO: 940 - DNA, 627 bp, Medicago truncatula
tgtttatgtcacgttacagagggcctcgtttcaaaaaaatacgtcgtctgggggctttaccaggactaactagtaaagggcctacagttggaagcgaacttaaaaaccaatctcgctcgagtaaaaagtctcaatatcgtattcgtttagaagaaaacaaaaattgcgttttcattatggtcttacagaacgacaattgcttaaatacgttcgtatcgctggaaaagcgaaaggttcaaccggtcaagttttactacaattacttgaaatgcgtttggataacatactttttcgattgggtatggcttcgactattcctcaagcccgtcaattagttaaccacagacatgttttagttaatggtcgtatagtagatataccaagttatcgttgcaaacccgaagatattattacagcgaaggatgaacaaaaatctagaactctgattcaaaattctcttgaatcagccccccgcgaaaaattgccaatccatttgactcttgatccattccaatataaaggattagtcaatcaaataatagatagtaaatgggttggtttgaaaattaatgaattgctggttgtagaatattattctcgtcagacttaaacctaattaaaataaga

SEQ ID NO: 941 - DNA, 5720 bp, Brassica napus
tttttattcattcattttcatagtcgtaagtggattttttgatacgtcataattttaaaaacgaagatatttttatcaatttgttttatttttaaataaaacataaagcaaatttaagaaacagaaataaaaaaaattactagttattaatcatattaatattatattattaatatgagaaactattagtaatagaaacatggaaatattaagtaataagtgtactgaaaataagattacaatcaataaatcttaaaaggagacgtctaccacagcaaccaaacgaaaataaatgattcgattaacctgaatttttgttttgacgcaagagttatatataccttgcccaatccactccgattggaattgactaagcgggtattttttccacattcataggagttcgtctatgtttctgctttacgaatatgatattttctgggcatttttaataatatcaagtgctattcctgttttggcatttctaatttccggggttttatctccaattacgaaggggccggagaaactttctagttatgaatcaggtatagaaccgatcggggatgcttggttacaatttagaatccgttattatatgtttgctctagtttttgttgtttttgatgttgaaaccgtttttctgtatccgtgggcaatgagtttcgatgtactaggggtatccgcttttatagaagctttcattttcgtgcttatcctaattcttggtttagtttatgcatggcgaaaaggagcgttggaatggtcttagttcgtttcctgaatacttgtacaataacaataaaaaaaaagtaaaaaaaaaccattgaaacaattatgaattccattaagtttcccgtacttgatcgaacaacaaaaaactcagttatttcaactacgttaaatgatctttcaaattggtcaagactttccagcctatggccgcttctttatggtaccagttgttgttttattgaatttgcctcattaataggctcccgatttgactttgatcgttatgggctagtaccaagatcaagtcctagacaggcggaccttattttaacagcaggtacagtaacaatgaaaatggctccttctttagtgagattatatgaacaaatgcctgaaccaaagtatgttattgctatgggagcgtgtacaattacaggggggatgttcagtaccgattcttatagtactgttcgaggggttgataagctaattcctgtagatgtctatttgccgggttgtccacctaaaccagaggctgttatagacgctataacaaagcttcgtaagaaaatagctagagaaatctataaggatcgaattagacctcaacggggtaatcggtgttttactaccaatcacaagttttttgttgtacgcagtacacagactggaaattatgatcaagaattactctatccaccatcatctacttcagagatctctactgaaacattttttaaatacaaaagcccagtatcttcccacgaattagtgaattagggaggatttgagagaataagaaaaaaatcttcataaattagaactcatggtaaatgtgaaatacttaaatttatataaaaaaggtgtgggggaaataaaaaagatgcagggcactttgtccgtttggctagccaaacgcgggctggttcatagatcgttgggcttcgattaccaaggaatagagactttacaaataaagcccgaagattggcattctattgctgtaattttatatgtatatggttacaattatttacgttcccaatgtgcctatgatgtggcaccaggtggcctcttagccagtgtgtatcatcttacgagaatagaatatggtgtcaatcaagcggaagaagtttgcataaaagtatttactcacaggagtaatcccagaattccatctgttttctgggtttggaaaagtacggattttcaagaacgggaatcttatgatatgttaggaatcacttatgatagccatccgcggctgaaacggatcttaatgcccgaaagttggatagggtggcctttacgtaaggattatattgcccccaatttttatgaaatacaagatgcttattgaatgataaaaaatttgaatgataaaaatgagtcttagtttctacaactacggaccttcgcggaatattttgaattcgagtcgtttttagatcaaacaaacagaagaattaaggtcttattcatattattatagatagcttaatctccaatttgaaagatacttttttcctaaaagccgagccaataggatgaactaaaaaaaaaaaaaagagttctgcattatgaactttgtatcgcgcacataacttagtcaactttagtcacataactgggaatgaataaataagattggaaagcaatacaataaatgggggggttaaaattctatttctattgtatctaatctaatgaatcttgggggtatttctgcccttcaacgatagatactatagatagatatagatagatagatatagatctttttttttttacttttttttattctttcaaccagaactttcctttcgaatatgtattaggtataaagtcttatacattttttttgaacggatggatccacaacatgaacaaaaaagagagggggataaaggattattgcactttttttactaaagatacgtttaatttgaagactataaacttatcaaaattaatcaatcctatgccaagaaccagatttgaactggtgacacgaggattttcagtcctctgctctaccaactgagctatcccggccattaccgaagtatcattctcattttatgagatgacttaggtctatgtcaattaaaagaaacgcaaaagtagtaaatgaaaaaagttttggaccgggaatttattggatcttcgaaaagaagactttctaagttttagaatgaaaaattatttagattcgaaataattcaaatcgatagttctttctcatttgtatatgtatgatatatcccacaagacttgtatataataagaaaagaaattcgagtttgtaaaagtgtcggatgaatgaaaaaagatcaatgaattcttgaataactaaaaaaagggtaaggtgtcaaacagacttttttagggagtagggttggggatagagggacttgaaccctcacgattttaaaagtcaacggattttcatcttactataaatttcattgttgtcagtattgacatgtagaatgggactctatctttattctcgtccgattaataagttccaccaaggatctatcagactatgaagtgaatcgtttgattcaacacaagggattgaactccatttgttagaacagcttccattgagtctctgcacctatcccgctttctaaactctggtttgttcgcgtaacccaggatttggctcaggattgcccattgttaattccagggtttctctgaatttgaaagttatcacttagtaggtttccataccaaggctcaatccaattaagtccgtagcgtctaccaattccgccatatccccctttttgctttgagattaggatctcattatgatgtctttccactttttcttatgacgaaaccttggaattcattacatacagatacttattttatttctttggtatcttcttgcattttttttagccccatccatattgatttagtttaatcaacaaagattctatcatttttgtatttgcaattcaatatggttatatattagagaacatatatatgttcttccttttctcatcgttgtcttcaattttaagaaatagtcgaacggtcgattcgttttttttacttccatgaaaagaaatttatgatcattattgaaacttagaattctacaatgtgcaatgtaaaaagattataagtctacttcgtagatttgaaattcgaataattctaaaaaagtatattcgaaatgaatattcgaatattcattctaataatttaattctataaaataataaagaatataaaaagagaaaaagtatcaaataataataattgcatgaggttagaacaaaaaaaccaagaatttcaaatcagatatcatttaactttaaaaaaaaagctttccggtctaattaaaattttcttatttagaaactcatgaaatcaaaattagaaagtcgatatattgctatattatattaattcattaaggttttgttttatttatttaatgatagtcactatttatttgagctatattctgttctagaatatcgaaaatatgatgaattctaaatagataaggaaaaatatgaatagaatagttaattaatacgatctagtagtttagtgaatttgtatacactattttagttgagcccgcttagctcagaggttagagcatcgcatttgtaatgcgatggtcatcggttcgattccgatagccggcttttacatagtttttcattttttttacatgatttttaatgtactttcaaaaaaaaataagattgaaaagacttctttcacctttttccaagagttaccacgccatttatattatgtcatataaacttccatataggaatatatattggggtaaaagggttagatcttggcaaaataaatgaagaaaataaaggaaaatttttgtgatttattgatttatatatattgtatatacaataaaaaaaatctgtatattgagagaatatatcttctgactctttgtattccaatagtttattggagtggattttacgttatttatcattatcatttagttcagttttaattttgtttagtttttgtacaatttcaataaaaaaaggagtctttatgtcacgttaccgagggcctcgttttaaaaaaatacgccgtctgggggctttaccgggactaactagtaaaaggcctagggcaggaagcgatcttagaaaccaatcacgctccggaaaaaaatctcaatatcgtattcgtttagaagaaaaacaaaaattgcgttttcattatggtcttacagaacgccaattacttaaatatgttcgtatcgccggaaaagctaaggggtcaacgggtcaagttttattacaattacttgaaatgcgtttggataacatcctttttcggttgggtatggctttgactattcctcaagcgcgccaattagttaaccatgggcatattttagttaatggtcgtatagttgatataccaagttatcgatgcaaaccccgagatattattacagtgaaggatgaacaaaactctagaactttggttcaaaatcttcttgagtcatctgcccccgaggaattgccaaaccatctgactcttcacacattccaatatgaagggttagtcaatcaaataatagataggaaatgcgtcggtttgaaaataaatgaattgcttgtcgtagaatattactctcgccagacttaaaaaacctaagtgaagtaaaaaaaaatcactaaaaacaagagttcggacaactcccctttgcccgcttttttgattaaaactaaaaagggacaaggtaagggattttgtcggggaatctttttcctattcatgtatcatagattggtagggaggtttggatcccttgtttgctcttcccagcattttccatagcaaagaaatgtagattttatatctattttttttatttgatttgatacgttgtggtcaatcacgtaagattggttatttagttgaaagtacggaaagagagggattcgaac

SEQ ID NO: 942 - DNA, 7553 bp, Citrus sinensis
gtatcacaaggacaagggctatagctcagttaggtagagcacctcgtttacacgtgcgccaatgtttttcagaggagtccatcatgcaatcaaaagaattgatctttttgagaaattaatgtctgactccgtggcttgtagggaacaaaacaagagaacaatagcctgacaaatggatcggtccgattcgggtgcccttttaggaaccaaatagaatccatcatcgatttgagagattgataaggtaaatacctagtctattcaatgctaggcataatgagtataaggacctcaaaaattctcttttcgttctatgaaccttaaggcgtatgaagtttcatatgtgattctttaatcaggatgatagagactccatttcgtttaggttgatctaggccataagcagacctacgtcaagataacccttctttgaaacactttgggagtgctcctatatccgaatccaaataatgaattagagcacatggagccatttccttagttgtctgtcaagaaaaaaatatggtagactaactgatatttctatcagttaatgaaagagcccaatgcaaaaaaaaaaaaatgcatgttgggtctttgaaagagttcgaatcattttgataagaattagttcgatctgttttaccgagaaggtctacggttcgagtccgtatagccctatactaatctcaaataataataatcaaaatggaaatacagaaacacaaaaattgtatagttttcatttcctcattcattgtatttttgttgtttgtaactggtcgctgggggttgcttgtggttcatcgaaatcaaatcattcccaaaagctcgctcggagggagctcgttccgagcagaacatcaaactgaaatgaaaactaaagcgcatttcaatggatttaatcgctattttttttttagaatctcggattcggctaaacaaacccatttttctttcttcaataattaataataataatcttcgtatgggaattccatatggatttgcctcttttcctgttcccatcacaatcaaagagttattgatacttcctttctttggtatactcacctacttttggtgaatttgcggagtcaaaatcatgacacgaatccggggagacgccgacgtaacccaactcaaatggaatagtaagtcgcatggatataggaacggattacggtatttgttgacacctcagcgtttgaaaaacgaatagcttttcataaacataattcagaaacagaaaatattctatatattgagaatagaatcaaaatcgattgaatttcgaagattcgaattcgaaattcgaaacaaaaattcgaattttcttttgacttcctttgatttagacaagtccgaagcgcggtgaacgcaaaagggttttgtttgttttgtttgtataagagatttatactatattgaaataaaatcgaaggaagtgtaatgaaaataggattccaatcgataaatcttaaaacgagacatcacaacaaacaaacgaaactttgcggttcgatcaaaatgaattgttgttttgattaaccaattatcgatgacttgacaatgaattccaatttgcatcgacaaatttggtctattttccacattcataggagtttggctatgtttctgctttacaaatatgatattttctgggcatttctaataatatcaagcgttattcctattttggcatttctaatttccgcagttttagccccgattaacaaagggccagagaaactttctagttatgaatcgggtatcgaaccaatgggcgatgcttggttacaatttcgaatccggtattatatgtttgctctagtttttgttgtttttgatgttgaaaccgtttttctttatccatgggcaatgagttttgatgtattgggggtacccgtatttatagaagctttcattttcatgcttatcctaattgttggtttagtttatgcgtggcgaaaaggagcattagagtggtcttagtttctgaatattcagacaataacaaaaaagtaaaaaaaaaaaaaaaaacaaaaaataacattgagagaattatgaattctattgaattttccttacttgatcgaacaaccccaaattcatttatttcaactacatcaaacgatctttcaaattggtcaagactctccagcttatggccgcttctttatggtaccagttgttgtttcattgaatttgcttcattaatcggctcgcggttcgattttgaccgttatgggctggtaccaagatcgagccctagacaggcggacctaattttaacagctggtacagtaacaatgaaaatggctccttctttagtgagattatatgaacaaatgcctgaaccaaaatatgttattgctatgggagcatgtacaattacaggggggatgttcagtaccgattcgtatagtactgttcgaggagttgataagctaattcccgtggatgtttatttgccgggttgcccgcctaaaccagaggccgttatagatgccataacaaaacttcgtaagaaaatatctcgagaaatctatgaagatcgaattcgattgcaacgggagaatcgctcgtttacttttactaccaatcacaagtttcgtgttgtatgcagtactaatactggaaattatgatcaaggattactttatcaaccaccatctacgtcagaaatcccgcctgaaacctttttcaaatacaaaagttcagtatcttcccccgaattcattaattaggcaggaggattcatttgtacagaataagaaagagcgaattaatcttcataaattccaaaaattcatcgtaaatgtgaaatatttatcgaaatcaaaatgtgggagagataaaaaagatgcagggtcgtttgtctgcttggctggtcaagcatgggctagttcatagatctttgggctttgattaccaaggaatagaaactttacaaataaagcccgaggattggcactccgttgctgtcattttgtatatatatggctacaattatctacggtcccaatgtgcctatgatgtagcaccgggcggactgttagccagtgtgtatcatcttacgcgaatagagtatggtgtagatcaaccagaagaggtatgcataaaagtatttgctccaaggagtaatcctaaaattccatcggttttctgggtttggaaaagtgcgaattttcaagaacgggaatcttatgatatgctgggaatcctttatgataatcatccacgactgaaacgtatcttaatgcctgaaagttggatagggtggcccttacgtaaggattatattgcccccaatttttatgaaatacaagatgcttattgaattctaagaaattaatcttcattttgacccaatattcaagaaatatttgtacgttctttctctagatcaaacggaggaattgaagtctcattcgtattattattgtgaatgggataaagaaattaaagagttctgtatcatgaactttgtatcgcgcacaccacttcgacgggctctagcgggtcacagagaggggaaggaagaaataaaataaaaaaaaataaaagaaaaaaaggcctattcccagacatcgagctagatggataagtatgtatgtatcatgatctataaatgaatatgtatggcgagccatatcactgaatttgtagtgatagatactcatagatattaatcatatgccaggaaccagatttgaactggtgacacgaggattttcagtcctctgctctaccagctgagctatcccgaccatttccgacacaccgttctcatcttactagatgacttgggtctatgtcaattaaaaaataaacagggattaaaagtcttgggaggggaatttcatttcttgaatcatcaaaaagaagactttgtaagtttcagtatgagcaataatatggattgggaatcattaaaacggggattccttgctcaaaggtgttcatttctacatatatcgtatagaccatacggcttgtgataagagaaaaaaattctgcccatatccttttggaaatggaaaagagtaggatagatgagaaacctaccgacttttgaaccactaacaaaaaaaggagaaggtaggagaaatggttagggagtcaataggccttttttggggtggggatagagggacttgaaccctcacgatttctaaagtcgacggattttccttttactctaaatttcattgttgcccgtattgatattgacatgtagaatgggactctatctttattctcgtccgattaatcagttcttcaaaagtcaaaagaaaggatcgatcagaccatggaggtggagtgaatgatttgagccgggaatattcgattctttcttcaacttagaatcgattcataacaataacaattcttttctttttcataaaaagaaatacgtatttggttgtgatttttgagttagtttttcgctgcgtatacatagtctatatacccttatccttcatcctttatcgagtttcgatattcgatagaagcattcatttgactttcttttttctttaccaaaaagggcagtcaactccatttgttagaacagcttccattgagtctctgcacctatccccctttttcgctttctgaacccctgtttgttcttggaaaagagaagaggatttggctcaggattacccatttttaattcctgggtttctctgaatttgaaagttatcacttagtaagtttccatactaaggctcaatccaattaagtccgtagcgtctaccaatttcgccatatcccctttgtgttttaggaactcaatgctgttccccctttctttcatttctgcggaaacagtagaattccgtagatatggatttatatatatcgaaaggtgttttgctttcttgtcagaaatgattctatcttttctgtatccgcaattcaatatagatggatataaactaccataaaatatatatgccccccttactctcatttttttcgtgcaatccggcggaatactcgaacggtcgatttattttttcgttttttcttacgccccttttcgaatgaaaacaaaaatgtctcattctaatccagattccatttagcgggattgtatctttctctttcatttcattttctatttatacttgccctttccttaaggaagaacctatataacataaccaaaaataactcaaattccaatttcaatttattaaataaaaataaatcatttttattaatcatttagaatataatagctagacctaatcaatagaatagctataactactcagtcaattaaattagaattcgaagataattctaattatttagtctaaagcctaattatttcgaattagaatagagcaaatttagaatttcgaaaatggataataagaatcgaatataatattcgatttagactaactaaatatatatagaatatagaataataatcgaatattatgtatattctataatatagaataatcgaatagaatatattaagaatcttaggttagaaacaaaaaaataattttaaatgtcttgaattcaaaaatgaaaaaaaaaaaataataaataaatcaaatcgtattttattatctaattaagagtaagatatttattgttgatcaatatagaattgataaaaaaatccaaattcgctaatatatatcatcactagattctcgtaattgttagattaatcgttatgttctatatctatagtattcaacatttatttgaaattcgattctctattttattctttatgaatagctaagaataaaaggttaatagataagatcctaggatccctacgcatgtacaatttctcttatttaagcccgcttagctcagaggttagagcatcgcatttgtaatgcgatggtcatcggttcgattccgatagccggcttttctctatttgtttgattttttacatgattgataatgtctttttgaaagaaaagaacattgaaaaggcttcttccaaggatcatcgatccagtatgttgtaggagcttccaattatgaataaaagtgggaggaagttcgatttcggcagaataaatcaagaaaaggaaccctcttttgatttatatttctatatgcgtatacaatacaaaaaggggtctggaatttgatacaaatcatcttagtattctttgtagtacaatacttcagcggattttgcttcatttatcatgtagctcagttttaatttaggtttatgaaattcaataaaataaggagtctttatgtcacgttaccgagggcctcgtttcaaaaaaatacgccgtctgggggctttgccgggactaacgagtaaaaggcctagagccggaagcgattttagaaaccaattgcgctccgtaaaaaaatctcaatatcgaattcgtttagaagaaaaacaaaaattgcgttttcattatggtcttacagaacgacaattacttaaatatgttcgtatcgccagaaaagccaaagggtcaaccggtctggttttactacaattacttgaaatgcgtttggataacattctttttcgattgggtatggcttcaactattcctcaagcccgccaattggttaaccatcgacatattttagttaatggtcgtatagtcgatataccaagttatcgttgcaaaccccgagatattattacagtaagggatgacccaaaatctagatctctggttcaaaattatcttgattcatcccaccatgaggaattgccaaagcatttgactcttcgcgcattccaatataaaggattagtcaatcaaataatagatagtcaatgggtcggtttgaaaataaatgaattgcttgtcgtagaatattattctcgtcaaacttaaacctaactaaaataacgggctcgtacaaatttaccctttcacctaacttaaggaaagggatacaaggtaaggagtttgatccgtggagtttttttttatcccattcatgtatcatagatccgagggtagatttttatcccctgcctgccccttccctttctttcccgtaggaattgagaatctagctcaaaaaaaggtctgactgcttcggtattcattcttttttgcttggatacattccggtcagtaacattgatgaattagttcaaggtacggaaagagagggattcgaacccccggtaaacaaaagtctacatagcagttccaatgctacgccttgaaccactcggccatctctcctacacaatgattatgaccgagaacccgcgtgaatagcgagttgttcaaattcgattggtagatgggtacggacaatcgaatccgttctaactagaaaaatagaaaccctttcagcaaagaaaaaattcttcctttgagtctggggaaaaggataacttttttgtttgtgaaaaactgttcaaaacaaaaaacaataaggctatatatcttgtttgcaaagatggcgctcctttttttttttttttctgatatttctacctgagattaaacacatgagttgagaacaaaaacaacggatcggtctatttttttttttttattttattt

SEQ ID NO: 943 - DNA, 5520 bp, Raphanus sativus
gatatacaataaaaaaaatctgtatattgagagaatatatcttctgactctttgtattccaatagtttattggagtggattttacgttatttatcattatcatttagttcagttttaattttgtttagttttcgtacaatttcaataaaaaaaggagtctttatgtcacgttaccgagggcctcgttttaaaaaaatacgccgtctgggggctttaccgggactaactagtaaaaggcctagggcaggaagcgatcttagaaaccaatcacgctccggaaaaaaatctcaatatcgtattcgtttagaagaaaaacaaaaattgcgttttcattatggtcttacagaacgccaattacttaaatatgttcgtatcgccggaaaagccaaggggtcaacgggtcaagttttattacaattacttgaaatgcgtttggataacatcctttttcggttgggtatggctttgactattcctcaagcgcgccaattagttaaccatggacatattttagttaatggtcgtatagttgatataccaagttatcgatgcaaaccccgagatattattacagtgaaggatgaacaaaactctagaactttggttcaaaatcttcttgagtcatctgcccccgaggaattgccaaaccatctgactcttcacacattccaatatgaagggttagtcaatcaaataatagataggaagtgcgtcggtttgaaaataaatgaattgcttgtcgtagaatattactctcgccagacttaaaaaacctaagtgaagtaaaaaaaaatcactaaaaacaagagttcggacaactcccctttgcccgcttttttgattaaaactaaaaaggcacaagggaagggattttgtcggggaatctttttcctattcatgtatcatagattggtagggaggtttggatcccttgtttgctcttcccagcattttccatagcaaagaaatgtagattttatatcgattttttttatttgatttgatacgttgtggtcaatcacgtaagattggttatttagttgaaagtacggaaagagagggattcgaaccctcggtaaacaaaagcctacataacagttccaatgttacgccttcaaccactcggccatctctccgacatcaggattatgactgagtacctgggtgaatagcgagttattcatcgttttttagattatggttaatagataccttttttgatcggaaaaattggaagtagatagaatatttttttataaaaaacgagtccgcttttatgttagttcgtactataaaattcctttgtttgtgagaaaattttctcacaaaagaaaagttaaaggaaataaaaagagttatagaatggattactacctatgccaagatcgcgtataaatggaaattttattgataaaacctttacaattgtagccgatatcttattacgagtcattccgacaacttccggagaaaaagaggcatttacttattacagagatggtgcgatttgattatcattatcatttttttttatttctcaccgatttggaataaaaaaaacgagtattgaaaaaaatctacgcttttgaaggtgaagtttataatataaaaaagcaatcccttctgtcatgtatccacgattagtgcagccttagatgcttcaattatgaattcgagtattgagcaaaaggtttttacctacggttcccgtattacagatcaatcctactagactaatacaatatacgaataggaggcacaggggaagaagcactacgccgagaaatcaacaacacgaaaactttcttcaaaacgattccttttctttcttcttctttgggattgggactaattaaaatggttggaacaataaacatccatctcgtccgtactttggatacccgtataaccattgaagactgttgaagtgactaattcctggaaatttaggggcgttgagaacaaagaaatttttagagtttccttttttatttttatctagtatgaatccacttggtagtaagaaaagatcttttacaagaaggttggctagggatttcttgtaaaaacattagccccgcttagttcataatgacatcaaatttttccatatccatatatttattattttcattatgcacctaaaggaggagccgtatgagatgaaaatctcacatacggttctgaaacggagaattcgttaaagcgaatgacgaccgtaacggatgtcggctcaatctgaaggaaattatgcggaagcattacagaattattatgaagctatgcgactagaaattgacccctatgatcgaagttatatactctataatataggccttatccacacaagtaatggggaacataccaaagctttagaatattattttcgggcattagaacgaaacccctttttaccacaagcttttaataatatggctgtgatctgtcattacgtgcgactatctccactatagaaaaaaagaacgaacagctagtcaatgaaatactagaaacaaaaaaaaaaggctttctacataagcatcgtccaaaacgattttttatcagctgtagcaaataaataaacttcatggatagaaatatgaagtgaagactagatatgcctaaatactttatttctatggataaaaaaagattgaattgatagaggaagcaccgtaaagatcaactggaaaggttttggaccgatacaacaagagctgtttatttatatcataatatgagataaatcttaggaatctacttatgtaatagagtggatcccctaaggtattgagcagcggtgtagcatcagatcctaaagacagtaagtctttttcttttttatgaagtatgaaaaaaagtctttttcaacgattctatataaatttatatatgaaagcgggatagttacctttcagaaaattctaatatctaataacagtggacatgccttttttttctgaaggtaggagaaaagataaaacttattagattaattaatatattaattaaatcaaaacgaaagtttgaaactcatgtaattactctcttttgtttaatccaagaaaaaccgaatgaatatctataagaaatctcattcaattagacattcaattagatataaagttaaagtaggttaaagtgaaaaaactggtacaccaaaacaaaagagttggttgtcgagccgtatgaggtaggaaactctcaagtacggttctcagggagggaattgacccgcctattccgaccgtggagaacaggccattcaacaaggagattctgaaatggcggaggcttggtttgctcaagccgccgagtattggaaacaggctataacgcttactcctggtaattatattgaagcacagaattggttgacgatcacgaggcgcttcgaataagaaatttttctttgtttctttttttttttattctataatatatctttatttgtttttacaattaattgttttttagtttcttggccctctcggtcaaataaaacagattcttttttctatcagaagaaccaatcacagaaaaaaatttcattatatccttttctcaaatcgttctatttcatctggtattctctaaggataagtagtacatgaatatgagaatatctatatatctatatctagttttttctattttttttttcgactattaaaacgaataaaagggatttgaaaatgactaaatatcaatactagagtgtttcttagtaatgactaataagtggttattgaaataggataatatcctctatttaaaacataaaaaataggctatatttcggaacttataattgaaatatgaatacactaggttaggttataaaaaaaaaattctttgtgtaccaataccaatgtaaaggtgcgaaaacgttttttaataaaaaaaaaaagggaggtccgttgagcgccctatggatatgtcataatagatccgaacacttgccccagatcgacttccagatcataattgctctagtgaataactaaagaaaatggatgaatagatgggagatagaagagaaagaaaaaaattctaagcatctatcatcggttcactaattatttgagtgactgttggcgggtttctttgtatgtgttgtccggaaagaggaggactcaatgattattcgttcgccggaaccagaagtcaaaattttggtagatagggatcccataaaaacttctttcgaggaatgggctaaacccggtcatttctcaagaacaatagctaagggacctgatactaccacttggatctggaacctacatgctgatgctcacgattttgatagtcataccagtgatttggaggaaatctctcgaaaagtatttagtgcccattttggccaactctctatcatctttctttggctgagtggcatgtatttccacggtgctcgtttttccaattatgaagcatggctgagtgatcctactcacattggacctagtgctcaggtggtttggccaatagtgggccaagaaatcctgaatggagatgtgggcggaggcttccgaggaatacaaataacctccggcttttttcagctttggcgagcatctggaataactagtgaattacaactttattgtaccgcaattggcgcattggtcttcgcagccttaatgctttttgctggttggttccattatcacaaagcagctccaaaattggcttggttccaagatgtagaatctatgttgaatcaccatttagcagggctactaggacttgggtccctttcgtgggcaggacatcaagtacatgtatctttaccgattaaccaatttctaaatgctggagtagatcctaaagaaataccacttcctcatgaatttatcttgaatcgggatcttttggctcaactttatccaagttttgctgaaggagcaacccccttttttactttgaattggtcaaaatactcagactttcttacttttcgtggtggattagatccagtgaccgggggtctatggttaaccgatacagcacatcatcatttagctatcgcaattcttttcctcattgcgggtcatatgtataggaccaactggggtattggtcatggtctaaaagatattttagaggctcataaaggtccatttacaggccaaggccataaaggtctatatgaaattctaacaacatcatggcatgctcaattatctcttaacctggctatgttaggctctttaactattgttgtagctcaccatatgtattccatgcccccttatccatatctagctactgactatgctacacaactatcattgttcacacatcacatgtggattggtggatttctcatagttggtgctgctgcgcatgcagccatttttatggtaagagactatgatccaactaatcgatacaacgatttattagatcgtgtcctgaggcatcgcgatgcaatcatatcacacctcaactgggtatgtatatttctaggcttccacagttttggtttgtatattcataatgataccatgagtg

SEQ ID NO: 944 - DNA, 1201 bp, Acacia harpophylla
ctagttaaatttgattggatgtggctatccaaaaagtagaatatgaatgactcactattcactcggtttctgtgacataatcattatgtaggagagatggccgagtggttcaaggcgtagcattggaactgctatgtaggctttttgtttaccgagggttcgaatccctctctttccgcacctttacctaattcatcaatattcctttacctaattcatcaatattattgaccgcaatctttcaaataacaaagggtaccattattccaactttctttgatgtggattctgtattcctaatttctggaatactgcaaatactggaaagagggggcaaggaatgaaaatcttcctacctgatccatgtctatgatagatgaatggtagtgaaaattcccgaatcaaacaccttaccccctttttttgtttttttgtcggtccccttacttagacgcgaagggagtaaaaatctcttgttattgtagttaggtttaagtctgacgagaataatattctacaaccagcaattcatttattttcaaaccaatccatttactatctattatttgattgactaatcctttatattggaatgggtgaagagtcaaatgttttggcaattcctcacggggggatgaatcaagataattttgaatcagagttctagacttttgttcatccctcgctgtaataatatcttggggtttgcagcgataacttggtatatctactatacgaccattaactaaaacatgtctatggttaactaattggcgagcttgaggaatagttgaagccatacccaatcggaaaagtatgttatccaaacgcatttcgagtaattgtagtaaaacctgaccggttgaccctttcgcttttctggcgataccaacgtatttaagcaattgtcgttctgtaagaccataatgaaaacgcaatttttgtttttcttctaaacgaatacaatattgagattttttatccaagcgcgcttggttttggtttctaagttcgcttccgactataggctttttactagttagtcctggtaaagcccccagacggcgtatttttttgaaacgaggccctctgtaacgcgacataaagactcctttttaaaaatttcataaacctaaattcaaactaaactaaatgggaaatatgataaatcaagtgaaatctactaattatatcaatatcc

SEQ ID NO: 945 - DNA, 8274 bp, Arabidopsis lyrata
aaaagaatattggaaaaggaatattcgaaatatacattctaattaatttaattctataaaataataaagaattaaaaaagagaaaaagtttcaaataataataattgcatgaaggttttgaacaaaaaaaaccaagaattcaaaatcagatatcatttaaccttaaaaaaaaagatttctgatctaattaagattttcttatttagaaactaatgaaatcaaaattcgaaagtcaatatactgctatattctattaattaaggttatgttttatttatttaatgatagtcactatttatttgagctatattctgttctagaatatatagaatatgattaattctaaatagataaggaaaaatattaatagaatagttaattgatacgatctagtagtttagtgaatttgtatgcatgcgctattttatttgagcccgcttagctcagaggttagagcatcgcatttgtaatgcgatggtcatcggttcgattccgatagccggcttttccatattttttcgtttttttacatgatttttaatgtactttcaaaatcaaagaagattgaaaagacttctttgacctttttccaagagttaccactccatttatattatgtcatataaacttccatataggaatatatattggctaaaagagttcgatctttgcaaaataaataaagaaaataaaggaaaatttttgtgatttatttgatttatatatattgtatatacaataaaaaaaatctgtatattgagagaatatatcttcttactctttgtattccaatagtttattggagtgtatttcacgtcatttatcattatcatttagttcagttttaattttatttagttttgtacaatttcaataaaaaaaaggagtctttatgtcacgttaccgagggcctcgttttaaaaaaatacgccgtctgggggctttaccgggactaactagtaaaaggcctaaggcaggaagcgatcttagaaaccaatcacgctccgtaaaaaaatctcaatatcgtattcgtttagaagaaaaacaaaaattgcgttttcattatggtcttacagaacgccaattacttaaatatgtgcgtatcgccggaaaagccaaggggtcaacaggtcaagttttactacaattacttgaaatgcgtttggataacatcctttttcgattgggtatggctttgactattcctcaagcgcgccaattagttaatcatggacatattttagttaatggtcgtatagttgatataccaagttatcgctgcaaaccccgagatattattacagtgaaggatgaacaaaactctagaactttggttcaaaatcttcttgattcatctgcccctgaggaattgccaaaccatctgactcttcacacattccaatatgaagggttagtcaatcaaataatagataggaaatgcgtcggtttgaaaataaatgaattgcttgtcgtagaatattactctcgacagacttaataaacctaacttaagtaaaaaaaattactaaaaacaagagttcggacaactcccctttgccattaaaaataaaaaggcacaaggtaagggattttgtcgaggaatctttttcctattcatgtatcatagattggtagggagatttggatcccttgtttgctcttcccagcatttttcatatgaaagaaagtagattttatatctattcttttttattggatttgatacattggggtcaatcacgtaagattggtgaattagttgaaagtacggaaagagagggattcgaaccctcggtaaacaaaagtctacataacagttccaatgttacgccttcaaccactcggccatctctccgacatcaggattatgactgagtatctgggtgaatagcgagttattcatcgttttttagattatgcttaatagatacctttttgaccggaaaaattgtaagtagatagaaggttttttttaatgagtccgcttttatgttagttcgtactatacaattcctttgtttgtgagaaaattttctcacaaaagaaaaggtaaaggaaataaaaagagttagagagtggattactacctatgccaagatcgcgtataaatggaaattttattgataaaacctttacaattgtagccgatatcttattacgagtcattccgacaacttccggagaaaaagaggcatttacttattacagagatgcgaatgacgaccgtaacggatgtcggctcaatctgaaggaaattatgcggaagcattacagaattattatgaagctatgcgactagaaattgacccctatgatcgaagttatatactctataatataggccttatccatacaagtaatggggaacataccaaagctttagaatattattttcgggcattagaacgaaacccctttttaccacaagcttttaataatatggctgtgatctgtcattacgccattcaacaaggagattctgaaatggcggaggcttggttcgctcaagccgctgagtattggaaacaggctataacgcttactcctggtaattatattgaagcacagaattggttgacgatcacgaggcgcttcgaataagaactttccctttgtttctttttttttttttctatatatttgatatttgtttttataattaatcgtttttttatttcttggccctctcggtcaaataaaacggatccttttttctatcagaagaaccaatcaaagaaaaaaaatttcattatatccttttctcaaatcgttctatttcatctggtagtctctaggggtaagtagtacatgaatatgagaatatctatatattgagttttttctattttttcttttcgactattaaaaccaataaaagatatttgaaaatgactaaatatccataatcaatactagactgtttcttagtaatgactaataggcgtttattgaaaaagaataatattctctaaaaaaaaaataggctacatttcggaacttaataattgaaatatgaatacactcgattaggttataaaaaaagctctttgggtaccaatgtaaaggcgcgaaaactttttttaattataaaaaagggtccgttgagcaccctatggatatgtcataatagatccgaacacttgccccagatcgacttccagatcataattgctctagtgaataactaaagaaaatagatgaatagatggcagatagaagagaaataaaaaaattctaagtatctatcatcggttcactaattacttgagtgactgttggcgggtttctttgtatgtgttgtccggaaagaggaggactcaatgattattcgttcgccggaaccagaagtcaaaattttggtagatagggatcccataaaaacttctttcgaggaatgggctaaacccggtcatttctcaagaacaatagctaagggacctgatactaccacttggatctggaacctacatgctgatgctcacgattttgatagtcataccagtgatttggaggaaatctctcgaaaagtatttagtgcccatttcggccaactctctatcatctttctttggctgagtggcatgtatttccatggtgctcgtttttccaattatgaagcatggctgagtgatcctactcacattggacctagtgctcaggtggtttggccaatagtgggccaagaaatcctgaatggagatgtgggcggaggcttccgaggaatacaaataacctcaggcttttttcagatttggcgagcatccggaataactagtgaattacaactttattgtaccgcaataggcgcattggtcttcgcagccttaatgctttttgctggttggttccattatcacaaagcagctccaaaattggcttggttccaagatgtagaatctatgttgaatcaccatttagcagggctactaggacttgggtccctttcttgggcaggacatcaagtacatgtatctttaccgattaaccaatttctaaacgctggagtagatcctaaagaaataccgcttcctcatgaatttatcttgaatcgggatcttttggctcaactttatccaagttttgctgaaggagcaactcctttttttaccttaaattggtcaaaatactcggaatttcttacttttcgtggcggattagatccagtgactgggggtctatggttaaccgatatagcacatcatcatttagctatcgcaattcttttcctaatagcgggtcatatgtataggaccaactggggtattggtcatggtataaaagatattttagaggctcataaaggtccatttacaggccaaggccataaaggcctatatgaaattctaacaacatcatggcatgctcaattatctcttaacctagctatgttaggctctttaaccattattgtagctcaccatatgtattccatgcccccttatccatatctcgctactgactatgctacacaactgtcattgttcacacatcacatgtggattggtggatttctcatagttggtgctgctgcgcatgcagccatttttatggtaagagactatgatccaactaatcgatataacgatttattagatcgtgtcctgaggcatcgcgatgcaatcatatcacatctcaactgggtatgtatatttctaggcttccacagttttggtttggcgtccacaagatatgttttcagatactgctatacaattacaaccagtctttgctcaatggatacaaaatacccatgctttagcaccagtttgacttgggggggcggtgagttagtagcagtgggtggcaaagtagctttgttacctattccattaggaacggcagattttttggtacatcatattcatgcatttacaattcatgtaacggtattgatactgttgaaaggtgttctatttgctcgtagctcccgtttaataccagataaagcaaatcttggttttcgtttcccttgtgatgggccgggaagaggaggaacatgtcaagtatctgcttgggatcatgtcttcttaggactattctggatgtacaatgctatttccgtagtaatattccatttcagttggaaaatgcagtcagatgtttggggtagtataagtgatcaaggggtggtaactcatattactggaggaaactttgcacagagttccattactattaatgggtggctccgcgatttcttatgggcacaagcatctcaggtaattcagtcttatggttcttcgttatctgcatatggtctttttttcctaggtgctcattttgtatgggctttcagtttaatgtttctattcagcgggcgtggttattggcaagaacttattgaatccattgtttgggctcataataaattaaaagttgctcctgctactcagcctagagccttgagcattgtacaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttggtattgctaccgcacatgacttcgagagtcatgatgatattactgaagaacgtctttatcagaatatttttgcttctcatttcgggcaattagcaataatttttctgtggacttccggaaatttgtttcatgtagcttggcaaggcaattttgagacatgggtacaagaccctttacatgtaagaccgattgctcatgctatttgggatcctcattttggtcaaccggctgtggaagcgtttactcgaggaggtgctcttggcccggtgaatatagcttattctggtgtttatcagtggtggtatacaatcggtttacgtactaatgaagatctttatactggagctctttttctattatttctttctgccctatccttaatagggggttggttacacctacaaccaaaatggaaaccaagagtttcgtggttcaaaaatgctgaatctcgtctgaatcatcatttgtcaggattattcggggtaagctccttggcttggacaggtcatttagtccatgtcgctattcctgcatccaggggggaatatgttcgatggaataatttcttaaatgtattaccgcatccccaagggttaggcccactttttacgggtcagtggaatctttatgctcaaaaccccgactcaagtagtcatttatttggtacctcccaaggatccggaactgccattctaacccttcttgggggattccatccacaaacgcaaagtttatggctaaccgatatggcacatcatcatttagctatcgcaattcttttcctcattgcgggtcatatgtatagaacgaactttggaatcggacacagtataaaagatcttttagaagcacatattcctccgggaggacgattggggcgtgggcataagggtctttatgacacaatcaataattcgattcattttcaattaggccttgctctagcctccttaggagttattacttccttggtagctcaacacatgtactctttacctgcttatgcgttcatagcgcaagattttacgactcaagctgcgttatatacccatcaccaatatattgcaggattcatcatgacaggagcttttgctcatggagctatcttttttattagagattacaatccagaacagaatgaggataacgtattagcaagaatgttagaccataaagaagctatcatatcccatttaagttgggccagcctctttctagggttccatactttgggactttatgttcataatgacgtcatgcttgcttttggtactcccgaaaaacaaatcttgatcgaacccatatttgcccaatggatacaatccgctcatgggaaaacttcatatggatttgatgtacttttatcttcgacaagtggcccagcatttaatgcgggtcgaagcatatggttgcctggctggttaaatgctattaatgagaatagtaattcattattcttaacaataggtcctggagatttcttggttcatcatgctattgctttaggtttacatacaactacattgatcttagtaaaaggtgctttagatgcacgtggttccaagttaatgccagataaaaaggatttcgggtatagttttccttgcgatggtccgggacgaggtggtacttgtgatatttcggcttgggacgcattttatttggcagttttctggatgttaaatactattggatgggttactttttattggcattggaaacacatcacattatggcagggtaacgtttcacagtttaatgaatcttccacttatttgatgggatggttaagagattatctatggttaaactcttcacaacttatcaatggatataacccttttggtatgaatagtttatcagtctgggcatggatgttcttatttgggcatcttgtttgggctacaggatttatgttcttaatttcctggcgtggttattggcaggaattgattgaaactttagcatgggctcatgaacgcacacctttggcaaatttgattcgctggaaagataaaccagtagctctttcaatcgtgcaagcaagattggttggattagctcacttttctgtaggttatatattcacttatgcggctttcttgattgcctccacatcgggcaaattcggttaattatttatgtattctatccgcaatcatatattttttttaataaaaaaaatataggtatgcactcttatatttatttctacatctaggatccgatttgtatcattatcattgataataagaggaactgaagcattatggcaaagaaaagtttgatttatagggagaagaagaggcaaaaattggaaaaaaaatatcatttgattcgtcgatcctcaaaaaaggaaataagtaagattccgtcgctaagtgagaaatggaaaattcatggaaaattacaatccccaccgcgtaatagtgcacctacacgtcttcatcgacgttgcttttcgaccggaagaccgagagctaactatcgagactttggactatctggacacatccttcgggaaatggttcaggcttgtttgttgccaggggcaacaagatcaagctggtaaggatttaagtatcccttaatttttctatttttttatatgatcgatgaggcccctttaccattctgtctaaataggctattctatttgtacagatatggaa

SEQ ID NO: 946 - DNA, 817 bp, Arabidopsis thaliana
tatatatattgtatatacaataaaaaaaatctgtatattgagagaatatatcttcttactctttgtattccaatagtggagtgtatttcacgtcatttatcattatcatttagttcagttttaattttatttagttttgtacaatttcaatcaaaaaaggagtctttatgtcacgttaccgagggcctcgttttaaaaaaatacgccgtctgggggctttaccgggactaactagtaaaaggcctaaggcaggaagcgatcttagaaaccaatcacgctccgtaaaaaaatctcaatatcgtattcgtttagaagaaaaacaaaaattgcgttttcattatggtcttacagaacaccaattacttaaatatgtgcgtatagccggaaaagccaaggggtcaacaggtcaagttttactacaattacttgaaatgcgtttggataacatcctttttcgattgggtatggctttgactattcctcaagcgcgccaattagttaatcatggacatattttagttaatggtcgtatagttgatataccaagttatcgctgcaaaccccgagatattattacagtgaaggatgaacaaaactctagaactttggttcaaaatcttcttgattcatctgcccctgaggaattgccaaaccatctgactcttcacacattccaatatgaagggttagtcaatcaaataatagataggaaatgcgtcggtttgaaaataaatgaattgcttgtcgtagaatattactctcgacagacttaataaacctaacttaagtaaaaaaaaaaattactaaaaacaagagt

SEQ ID NO: 947 - DNA, 670 bp, Fragaria vesca
agtctttatgtcgcgttacagaggacctcgtttcaaaaaaattcgctgtctgggggctttaccggggctaactagtaaaaagcctagagccggaagcgatcttcgaacccaatcacgccccggcaaaaaatcgcaatatcgtattcgcttagaagaaaaacaaaaatttcactttcattatggtcttacggaacaataattacttaaatacgttcgtatcgccggaaaagccaaagggtcaacaggtcaggttttactacaattacttgaaatgcgtttagataacatccttcttcgattgggtatggcttcgactattcctcaagcccgccaattagttaaccacagacatattttagttaatggtcgtatagtagatataccaagttatcgatgcaaacccagagatattattacggtgagagatgagcaaaaatctaaggctctgattcaaaattatcttggttcatctccccctgaggaattaccaaaacatttgactcttgacctattccaatataaaggattagtcaatcaaataatagatagtaagtcggtcggtttgaaaataaatgaattgctagttgtagaatattactctcgtcaaacttaatcctaactaaaataccaagggttcggcaaattttgcccccgcttgcttaagtaaagg

SEQ ID NO: 948 - DNA, 36555 bp, Aristolochia fimbriata
ctaagtcccagtggtttccagaaatcctaggcactacttctgttatgtgagcccgcttagctcaggggttagagcatcgcatttgtaatgcgatggtcatcggttcgattccgatagccggcttttccatttattctatttttttccatgattgataatgtcttcttgagatcaagagaaattgaaaagacagaaattgaaaagactcttccattttctccaaatgtcgggtcaacatagtatgttatgggaactcccaactatgaataaaaaagaataaaaaaaggattcaagcccttagatctctacagaacaagaaggggatacttaacttcctatatataactctataaaataatccggttattgagacaatttttcccattcttctttatagtacttcagcgagtttagcttcgtttatcgtttagttcagtctaaatttttttattctgtgaaatagaatttcaataaaattaaggagtctttatgtctcgttaccgagggcctcgtttcaaaaaaatacgccgtctgggggctttaccgggactcactagtaaaagacctagatccgtaagggatcttagaaaccaaccgcgttccgcgaaaagatctcaatatcgtattcgtctagaagaaaaacaaaaattgcgttttcattatggtctgacagagcggcaattacttagatatgttcgtatcgctgggaaagccaaagggtcaacaggtcaagttttactacaactacttgaaatgcgtttggataacatcctttttcgattgggtatggcttcgaccattcctggagctagacaattagttaaccatagacatattttagttaatggtcatatagtagatatcccaagttatcggtgtaaaccccgagatattattactacgagggatgaacaaagatcaagagctctgattcaaaattatgtggatttatccccccacgaggaattgccaaaacatttgactcttgacccattacactataaaggaatagtaaatcaaataatagatagtaaatggatcggcttaaaaatcaatgaattactagtcgtggaatattattcccgtcagacttaaacttaattaaaataattaagctttggacaattttgtccacccggtttcaccaaacaaagtaaatagaactaagctaagggatttaatctggattttccccatttgtatatcgcaagtggatccgcggttagattctcattccttgtctaccctttccgatattttatctaccacagtaattggcaatagagaatcactagaaaagaaaggccctactcttggggtatccattgttatttgatacattgtggttggtaacgttggtgaatttggtgtaagtcaaggtacggaaagagagggattcgaaccctcggtaagcaaaagcctacatagcagttccagtgctacgccttgaaccactcggccacctttcctgcggaatcttaggattattgcccggaaacccagtgaatagcgagtcattcatattattgaattgtattattgcaataacaataaaggtacgaccgatcgattataaatcgaaaactttccgtcaaagatcttccttggaggctcgagggataaaacacatttttttttattgaatattaacttaatattatattaaaaaaatgatctattcatctttatctattcatctttgtcaagacgatggtcctctccatcttattcggatatttataccggattaaacaaccaatgaattgggacgaatccactaactctatagtattttatactatggttatatttagaggtcggtaggaattacaaaatgcatttctagtttattcagatttatcaacagcaactcttctcatgagccaccccatggatccattataaaaaaattcacggtcgccctatgatttttatattatatttccattgtattgtttgtgtatacgcgctattcaccaaaaatggatgggttggttattctattttcatcatggaatgattatttgattctttttactctttggatcataatataataaaataaaaaaataaataaataaaataaaaactcctcgagttagatcagaatctgtaggaaaaattctttgattccttaacttcgctaaaatgaggagtaagagttctgttcattggcataaataccacattgggctgaaatccaatctgattccaatatttcctatctatccctgtcttaacttaaaagggacaatttttggggtcttttttttttttacaattactccgtttttatgtgatttcgtactgtacaattcctttgtttatgggagcattttccctcaagggagaggataatgagaagaattatggaatgggttgtaaactatgcctagatctcggataagtggaaattttattgataagacctcctcaattgtagccaatatcttattacgaataattccgacaacttcaggagaaaaagaggcatttacctattacagagatggtgtgatttgatttgattcgttttttttttatttatattaatattaattaaatattagattcgatttgtttggcctctttcagtcttatgagaaggggacatggttcaggacacaaaaaaaaaaaaaaaaaaattcttgaaataaacttccgcttggtgaaggtgaagtttgggttagtagagatcgaacaattccttctgtcgtgtatccccgattgatgcaacctcagatgcttcaattattgattttagcattgagcgaaaggttacacctataggttctgtattgcaggttaatcctactccaccagtaccaataggcggcgcatagggaaagaagcactacacctaggaatcaacaacacgaaaactttgttatatattatactattataccccttttccttattgggatcgggactaacaagaatggttgggacaacaaacatccatctcgtttgtgcttttggatacccgtataaccatcgaagatcgttgaagtgactaattcctgcaaagcaaatagagggcgttgaggacaaagaaattgttggagtgagcatttctatctagcatcaacacgtttggtgttaagaaaaagacctcttacaggaaggttggctagagatttcttgtaaaaacactagcccccatcagttcataatgagaatatttcaatcttttttgattccacggattattccctttattactatgcacagaagggaggagccgtatgagatgaaagtctcacgtacggttctgaaacggagattctttgaatataatgaacgaccgtaacggatgtcagctcaatccgaaggaaattatgcggaagctttacaaaattattatgaagctacgcgactagaaattgatccctatgatcgaagttatatactctataacataggccttatccacacaagcaatggggaacatacgaaggctttggaatattatttccgggcactagagcgaaacccattcttaccacaagcttttaataatatggccgtgatctgtcattacgtgcgactatctccactatagaaagaaggaaagaaagatcaaatacgctagtcaatactagaaaaaaaatgggctttctacatatgcatcgtccaaagcaacgatttttatcagctgtagcaaagaaagacttcatggaggccaaaatatgaagaaatgggtatggcctatatactagattccatggataaaggatctaatttaattgatagggtaagcgccgtaaagatcaattagagaggtattagagaggttttggggccgatagaataagaactgcttacataacatatcttttgatatgagataaaataaaagttaggaatcaacttatgtaatagagtcgatctactaaggtattgagcagcggtgtagcatcagatcccaaagatagtaagtcctttctttcttatggaggaaagtctttttcaaagattctatatcaatttctatatgaaaccgagatagttacctttcagaggattctaatgatatagggggtacggtacctatgctttattcttctgaaggtgggagaaaagataaaacgaattattgatcaaaataagagtttgaaacttatgtaattaacctcttctggttaacccgggatagatttacgagaaatctcattcaattatggatatggtagattaagatgggacaccaaaagaattggcggcggagccgtatgaggtaggaaactctcaagtacggttctaagggaaggaagtggcccacctattccgaccggggagaacaggccattcgacagggggattctgaaattgcggaggcttggtctgatcaagctgctgaatattggaaacaagcaatatcgcttactccaggtaattatattgaagcccataattggttgaaaatcacagggcggtaagaacactctttttttttttttttaattcaattatcatgttatgttggatccattaatcaaataaaatggatcgttcctctgggaagagccaatcaagtaatttcattatatcccttctaagatcgttctattttgtctggtacttccgaagtataaaccatacagatactgtacagaatacattacttttttctatgctaataaagctatatactcgaatgactaaatatggatatcgggatgtctctttttaatgactaatgactaattctttgatttggaatagagtaataaatacgttccatgtgagatatatgtaagatctaaactgaagtagattcatctaggcatttatccattgagatatgaatacattggattgcactaaaaaataaaaggtttttgcaccatgccatgcgaggaaggacctttagtattagataaaggtccgttgagcgccaaaaaaatatgtcataatagattcgaacacttgcccggattgacttccatatcataattgttctagtaaataactaaagaaaataactagatgggggataggaactaattctaaatagaaatatccatctctcagaggttcactaattactgacagttggcgggtctctttgtatgtgttgtccggaaagaggaggactcaatgattattcgttcgccggaaccagaagtgaagattatggtagacagggatcccgtaaaaacttctttcgaggaatgggccaaacccggtcatttctcaagaacaatagctaaaggccctgatactaccacttggatctggaatctacatgctgatgctcacgacttcgatagccataccagtgatttggaggagatctctcgaaaagtctttagtgctcatttcggtcaactctccatcatctttctttggctgagtggcatgtatttccacggtgcccgtttttccaattatgaagcatggctaagcgatcctactcacattggacccagcgcccaggtggtttggccaatagtgggtgaagaaatattgaatggtgatgtgggtggaggtttcccaggaatacaaataacctccaaattttttcagatttggagagcgtctggaataactagcgaatttacaactctattgtaccgcaattggtgcattagtatttgcagcgttaatgctttttgccggtggttccattatcacaaagctgctcctaaattggcttggttccaagatgtggaatccatgttaaatcaccacttagcggggttactaggactggggtttctttcttgggcgggacaccaagtacatgtatctttgccgattaaccaatttctagatgctggggtagatcctaatgagatcccgcttcctcatgaatttatcttgaatcgggattttttggcttaactttatccaagttttgctgagggagcaaccccttttttcaccttgaattggtcaaaatacgcggaatttcttacttttcggggaggattagacccagtaacagggggtctatggctgaccgatattgcacaccatcatttagctattgcaattcttttcctgatagctggtcacatgtataggactaactggggcattggtcacagtctgaaagatattttagaggctcataaaggtccatttacaggtcaggggcataaaggtctctatgagatcctaacaacgtcatggcatgctcaattatctcttaacttagctatgttaggctcttcaaccattgttgtagctcaccatatgtattccatgcccccatatccatacttagctactgactatggtacacaactttcgttgttcacacatcacatgtggattggtggatttctcatagttggtgctgctgcacacgcagccatttttatggtaagagactatgatccaactactcgatacaacgatctattagatcgtgtacttaggcatcgcgacgcaatcatatcacatctcaactgggcatgtatatttctaggctttcacagttttggtttgtatattcacaatgataccatgagtgctttagggcgtccccaagatatgttttcagataccgctatacaattacaacccatctttgctcaatgggtacaaaacacccatgctttagcacctagtgcaacagctcctggtgcaacaacaagcaccagcttgacttgggggggtagtgatttagtggctgtagggggcaaagtcgctttgttacctattccattaggaaccgcagattttttggtacatcacattcatgcatttacgatccatgtgactgtattgatattactgaaaggtgttctctttgctcgtagctcacgattgatacctgataaagcaaatcttgggtttcgtttcccttgtgacggccctggaagagggggaacatgccaagtatccgcctgggatcatgtcttcttaggcctattctggatgtacaattctatttcggtagtgatattccacttcagttggaaaatgcagtcagatgtttggggcagtataagtgatcaaggggtggtaactcatatcacgggggggaactttgcgcagagttccactactattaatgggtggctccgcgatttcttatgggcacaagcatctcaggtaattcagtcttatggttcctcattatccgcatacggcctttttttcctaggtgctcattttgtctgggcgtttagtttaatgtttctattcagcggccgcggttattggcaagaactcattgaatccatcgtttgggctcataacaaattaaaagttgctcctgctattcagcctagagccttgagcattgtacaaggacgcgctgtaggagtaacccattaccttctgggtggaattgccacaacatgggcattcttcttagcaagaattatttcactaggataatggctaggaggatttgaaaggcattatggcattaagatttccaaggtttagccaaggcttagctcaggaccctactactcgtcgtatttggtttggtattgctaccgcacatgatttcgagagtcatgatgatattactgaggaacgtctttatcagaacatttttgcttctcacttcgggcagttagcaataatctttctgtggacttccggaaatctgtttcatgtagcttggcaaggaaattttgagtcatgggtacaggaccctttacatgtaagaccaattgctcatgcaatttgggatcctcattttggtcaaccggcggtagaagcttttactcgagggggtgctctcggcccagtgaatatcgcttattccggtgtttatcagtggtggtatacaatcggcttacgtaccaatgaggatctttatactggagctctttttctattatttctttctgctatatccttaatagcgggttggttacatctacagcctaagtggaaaccaagtgtttcgtggtttaaaagtgctgaatctcgtctcaatcatcatttgtcaggactattcggagtaagttccttggcttggacagggcatttagttcatgtcgctattcccggatcaagggggcagtacgtcagatggaataatttcttagatgtattaccgtatccccaggggttgggccctctttttacaggtcagtggaatctttatgcccagaaccccgattccagtagtcatttattcggcacctccgaaggggcgggaacttccattctaacccttcttggggggttccatccacaaacacaaagtttatggttgaccgacattgcccatcatcatttagctattgcatttatttttctcgttgctggccatatgtatagaactaacttcggtattgggcatagtatgaaagatcttttagaagcacatattcctccgggaggtagattggggcgtgggcataagggtctttatgacacaatcaataattcgcttcatttccaattgggtcttgccctagcctctttaggggttattacctccttggtagctcaacacatgtactctttacccgcttacgcattcatagcacaagactttactactcaagctgcgttatatactcatcaccaatacatcgcagggttcatcatgacaggagcctttgctcatggagctatattcttcattcgagattacaatccagaacagaatgaggataatgtattggcaagaatgttagaccataaagaagctatcatatctcatttaagttgggccagcctgtttctggggtttcatactttaggactctatgttcataacgacgtcatgctcgcttttggtactccggagaaacaaatcttgatcgagcctatatttgcccaatgggtacaatctgctcacggtaagacttcatatgggttcgacgtactcttatcgtcaacgaatggcccagcatttaatgctggtcgaagcatatggttacctggctggttgaatgccgttaatgagaatagtaattccctatttttaacaataggtcctggagacttcttggttcatcatgcgattgctctaggtttgcatacaactacattgattttagtaaaaggtgctttagacgcgcgcggttccaagttaatgccagataaaaaggatttcggttatagtttcccttgtgatggcccgggacgaggtggtacttgtgatatttcggcttgggacgcattttatttggcagttttctggatgttaaataccataggatgggttactttttattggcattggaagcacatcacgttatggcaaggtaacgtttcccaatttaacgaatcctccacttatttgatgggatggttaagagattatctatggttaaactcttcacaacttatcaatggatataacccttttggtacgaatagtttatccgtctgggcatggatgttcctatttggacatcttgtttgggcgactggatttatgttcttaatttcctggcgtggatattggcaggaattgattgaaactttagcatgggctcatgaacgcacacctttggctaatttgattcgatggagggataaaccagtggctctttccattgtgcaagcaagattggttggattagcccacttttctgtaggttatatattcacttatgcagccttcttgattgcctccacatcagggaaatttggttaattcatttttcttgtaatgtgctccatcggcgacaatctcatttgattcggtggagaagggggactaccactaccctcttatatttctacatctaggatccgacccgtatcattgataataaaataggaactgaacaattatggcaaggaaaagtttgattcaaagggaaagtaaaaggcagaaattaaaagagaaatatcatttgattcgccgatccccaaaaaaagaaataagcaaagtttcgtcgttgagtgacaaatgggaaattcatggaaaattgcaatccccgccacgtaatagtgcacctatacgtcttcatcgacgttgcttttcgaccggaaggcccagaggtaactatcgggactttgggctatccgggcacatacttcgcgaaagggttcatgcatgtttgttgccgggggcaacgagatcaagttggtaagggtaaaaatactccttcttcatatttctatgggtctctatgatctatgatcatagaggggcccctttaccattctgtagaaatgggctagtctatttattatggtagaggggcaacccaatacttcttgttccacaagttcccgggtatttcgtgcggggtagagcagtttggtagctcgcaaggctcataaccttgaggtcacgggttcaaatcctgtctccgctacatttttgtttgtcagaaattctgttttaggctaggcattaggtgtaactccgttaatgttaattgttttgggatagtaggagagaaggagagtgggagagaagagggaagatagaaccactacattatcgtggtcaactagaccgaatcatttatcatattaatattagattattttaccctgggcggatagcgggaatcgaacccgcgtcttctccttggcaaagagaaattttaccattcgaccatatccgcatttcttcgttctgatatgaacatcatcatgttcacacatatatgatatatcatatatatatatatatgtgtgtctggatcatatttgtacaaggccatataatataatggattcctattattttattttaacattagattattcatttttttttttcattcaagaagtgacccctctccctccaacttttttctttatttatttatttatttattttcgcgactcatattgaattttaatgtgtctcacagtcggaattccttcgggggaggggtcacttttttgattctgtacgaggagattttctgtacgaggaggttcaagagattagagaattaaggatagcgactagaaagaccaatccaatccataatgatgtacccgaaaatacaacatttttgttacttgaccaaccatcaggagaagcaaatacaacgggtacactaattactaaaattgatgaagtagcaattaatgcaaaaacagccaattggaaagcaatagtcatgcttgtaatcctccaagctaccaacaaatgaacttgaactataccatttgatccccctctcagtccaaattgtactaaaatctatcgtgggggatttgcccatgaatatattgatcctttcgaacttattccgaattaaatctttaatttagtatttttttttatttgttacatggcggagccgagaggccatttttatttacttcacaaacgggcatactggctcatgcatatatctatataaacagatagatactatactagaactagacagatagatacagcaaaatatagctggatgcttttagagatagttatggtatcaactcatatggccatgttccattttggggaataaaatagagattgtctctcggagagatggccgagtggttgatagctccggtcttgaaaaccggtatagttctgaacaaagaactatcgagggttcgaatccctctctctccttttactcgttgaatagatttgtttctttattaatttggcctgacctgtgttataaagaggcacggctcggctaggtgggatagccgagccagaaaaaagaagtaaatataaataaataaataaaattaaatattttatttgaatttttaattttatttagaataaatctttatatatagaaatataaagaaaagaaatataaagaaatggataaatagatataatctaatctatgaatcaaaaaaaaaaaaagaaaaggaaaaataaatactttttaaaatttgagtatgccccgatcctaatatgtataatggaatcaaatggattcctacttcatgcatttgatctcctgtctcaattaaggggggtcatggaaagaacaggttcaaaatcgcgatcgattcctttttcaaatcccgctgcagctgcgcgagcccttcccgcatgccacaaatgccccacgaatagaaagaatcctagaacaaaatgagaggtagctaaccaacttctaggagagacataattgactgcattgatctcggtagctacgccacccacggaatttaaagaacctaaaggggcatgagtcatatactctgcagaacgtcgttcttgccaaggttgtatgtcttttttcagtctactcaagtccaacccattcggaccccttagaggttccaaccaaggagcacggagatcccaaaaacgcatagtttctcctccaaaaataacctctccagttggagaacgcattagatatttacctaaaccggtgggtccttgagcggatcccacgttagccccaagacgttggtctctaaccagaaaagtaaatgcttgagcttgagaagcttctggaccagtgggaccgtaaaactcactaggataagcggtattattgaaccagacgaaacaacaagcgatgaatccaaaaacggataaagcacctaaactataagacaagtaagcctccccagaccatacaagcgctcggcgagcccatgcaaagggtttggttaagatatgccagattccgccaagtatacaaatggaacctaaccacacatgtcctccaattatatcttctaaatcgtccacactaacaatccatccttctcctccaaagggggattttagtaaataaccaaatataacacttgggctaagggtcaagttggtaatttttcttacatctccacccccgggggcccaggtatcatatacgcccccaaaataaagagccttgagtactagaagaaaagcacctacacctaacaagattaagtgaatacccaaaattgtggtcattttatttctatctttccatacataaccgaagaatggaaaggattcttcaagagtctcagggccgataagtgcatgataaataccgccaaagcctaggactgcggaggaaattaagtgaagtactccggatacaaagtatggaaaggtgtctataacttccccacccggacctactccccaacctagagtagctaaatggggaagtaaaatcaatccttgttcatacatgggtttctctggtacgaaatgagccacttcaaataggttcattgctccggcccagaatacgattaatccggcatgggctacgtgagctccaagtagtttaccggacaaattgataagtcgggcattcccggcccaccaagcaaaaccggtggtttcttggtcacgaccagctaaagctaaagttccattaaagagcgtttccacggggtagaacctcctcagggaatataaggttttcatgaggctgatcctgagccgccatccaagcgcgaataccttcgtttaagagaatatttttggtgtaaaaagtctcaaattcaggatcttccgctgcacggatttcctgggaaacgaagtcataggcacgtaggttcagagccaggccgactactccaagagcgctcatccataaaccggttactggtacaaataacataaagaaatgtaaccaacgtttattggaaaaagcaaccccaaaaatttgggaccaaaagcggttagcagtgaccatcgaataagtctcttcagcttgagttggattaaaagcgcggaatgtatttgcaccgtcaccatcttcgaataaagtattttccacggtagcaccatgaatagcgcatagcagagcagcccccaatactccggcaactcccatcatatgaaatgggttcaacgtccaattatgaaacccttggaagaagaggatgaatcgaaatatagctgctacgccaaaactaggcgcaaagaaccaaccagactgacctagtggataaatcaagaatacagaaacaaaaacagcaattggaccggagaatgcgattgcattataaggtcgcaattgaacagatcgagcaagttcgaattgacgtaacatgaaacctattagtccaaaagcgccatggagagcaacaaaagtccacagaccgcctaattgacaccaacgagtaaaatccccctgtgcttcagggccccatagtagcaacaaagaatgtgctaaactattagcaggagtagaaaccgcagcggttaagaaattgcaaccttccaaataggaactagccaatccatgggtataccatgaagttacaaaggttgtacctgtgaaccaacctcctaaagcgaaataagcacaagggaagagcaatagaccagaccatcctacaaaaacgaaacggtccctacgtaaccagtcatccataatatcaaataagtcactttcttctttggtaactctaccaagggctatagtcatagtaatcctcctatttaactacttcaaccatttccgaacaccccatcgcattctcagggcatacgacggttcgattatctacggacgacgaatcatctactgactctttccaatgggtttcgaagatacaaacaaacaaatctttccttcctattggaaggctacaaccgaaccataagtaaatctatgagctcgcttcgattattatttcctatttttaataaacatatgaactcctaattttcttctgactcatcaatcagataatatttgatgagataactgtcaaggagcaggggatcctttctttcgctaccagttcttctactcatctatctctccgttccatcaacgaatcttattcttggatttcattcgtgatatgatattgagaaaagatcaataaatatctctatggattctcctaatttcatttagggtatactaaacggctacgatatcatatattacggtatcatatatatataatgaaactccatttttttcctttatttgattgttttttgtttcttattgttttctttagcttagttatatttccttcggatgaatctaaaataccagactatacctttcccatttcgcgggtagaagaaaaaaaaaggggggggggggagtattcccaatatcttttgtccctgcccttttaaaatcgaaattaaataggaagtggggactggaaatgaaaatcccgttctcgcattcgttctccattacattggtggaacaaaaatatctgatgcatccatatggaaatatttgatacatgaagtcatgtgacccaatatccatatctaagtcctatatggatataaaccaatctttttctggaaccaaaaaaagatattcaaaaaaagattgttcttgtgactcggaataaacatttctttgtggaggaaagggatgggcgatttattcctatgggtcatctaggaacaagaggattcaatcggaaatatcgacaaattcttgcgtggtccaaggaaataaaaaaggcccggcttccacaatttcatctctattgaaattgaatattttttaatatcagaatagccgatatagtcaccattcaatgggtcaggtccacttactttttcttttattgattttcaaatttgccgatcgggtttattggaacaatggagaagtaggaatgttttggtttgctgattcataatctgaattggatatataaaatagatatgatatgtaccaggaccagaaaaaataggaataatgaaaaatgaggcgaagtatatcctgtaatgacaacatagcagtcctcctaataagattagtgcaattacttatcatcataatgaacaaatgtttaactttgtacctataactcattctctaattttattagaataataactcattatgtgggcagttacctattacaaataactctaaaaaatctctcttttctctgctgaataatcaacactaagactgcaagctggagcttcatggaaaaagccccttatcggatttgaaccgatgacttacgccttaccatggcgttactctaccactgagttaaaagggcccgctttattcaattcaggaagaagccactcgctgctatgagtctactacatgatctatacatttagtatatgtacatatatatatgtatccatagggattcactgaggaacaaaaaatgggatttacctatacctatgagattctataggaaaaaaaaaatgattatttctatttcttttgttttgtatatttgaaaaatagcaatggtaatgcaatgaattctttcagggtcgggcctatactaatagctttgcttttattaacccgtccagacgagattcacttgattgatacatgtaccaatctgacatcgatccagaatataatatttcatcaaatcccttcccagatttaccaattctacatcatctttctgaatcgatcaaaaaaaagcattctatcgtttttaaatttcctggcttagtattagtgtgagataaagataggttatatcccatcttaatgttatatcccatcttaatgatgggtgagtcgatgagtaaaaatggaagaagggtttgacttaccttttctgtctgtcgaccaaatcatttcctgaagggattccatacttcgttatatatatatataggatataggacgggacggttcatgaatgataggatataggacgggatggttcatgaatgaaaatccaaaattctatggaatcatagaagcaggaaagatttttcggatctagtcatcccattatacattacattatattgacaattccaaaaaactgctcatactatgagcatagtatgatggcgatcgggcaggtatgcccctatcgtctagtggttcaggacatctctctttcaaggaggcagcggggattcgacttcccctgggggtagggtactacgaaaggaagttgatcatggattatcaataagcctagaatttattcttcctgggtcgatgcccgagcggttaatggggacggactgtaaattcgttggcgatatgtctacgctggttcaaatccagctcggcccactaattcgccgatccatgataaccaaatttgtcctccagaaatgcccattatttataatgccccatatattctaagtattctaaggatatacgggaataaaataaagtatatagggctaaagggaaagggtccattttttctacaatacccccttggtttctttcctatttctcacatcttctgatctgtctaaagatctagattaccaatttgttgcaaaggtaaggtagtaaagaaaaaaagaaaaagagtcatttttccattgaaaaatggattatcaatatattggcaggattaccagtaatccgtgtcattcggactcgagtccgtatccatgtggatatcagtatatcagtcgtgtttctgttacaacacaataatatttctcgtaaatagaaacgaaacgaatgaaagcataagaatacatatatgcatgctgtatacctcacccccgggattgtagttcaattggtcagagcaccgccctgtcaaggcggaagctgcgggttcgagccccgtcagtcccgacctcggatccggatgaatccatcaattcatctccccattttctgtgaggagagggaccccggacaggattgaatttcctgtggggatccttaatttacttttatttcgtttttcgtttcgaatttctcatcggacaaagacgggaatttctattatttgaacgagtactgattgctgggagagaggcatatgtagtcggaggtatcgccatactgggattccaagagagacctactggtttgactttttcaattgtttctgatccatgaaatggaatagggtacagagtaccaatatgtttccaaggagtacatatacaaattgtactcgtttattctacgatacacagttaactaacttagtgacatagttacccgggcagcagagtactattaaacctactcccttttgttttcgagatacgattttgtgcaacctcaattagtaaagtaattaaaaacaatatatcttattcaaattgcatgctgaatttcgctttctgtctcagtcccaatccaaggaaaaagagggtccttactttttattttaataataataataataagtcaaacaatgatccgccccttttgtttcttttctacggaggggatgaatcagtttttttttctttatctttatatatatattttagggtttcatcgaagaaggagaaaaatcaataaagaaagaatttgtcggaatattagatcttttttttttttatttatatcgggaccttcctttatctcatttctctgtcttccaggaagattagatcattacgcaaatttcgcttcgagcttaactccttcccttttccatttcactcctactgtttaggtctgttaccaatggaagggcggcaacggaacacaggtcagatgataccccgtcggatgattcttataaggaagatgataggttttataaactaaagaatgaaaaaaaaaagatgagaaattcaatgggattcttgattggatcaggaatcctatttttgattcggtatggataaaagatcttcctatgttatactattcaattctcgacgatgaatcgatttaatagatcagatattgttattcataatattgatccgattcagtatcaaccatcaggatgcaatccatcccattgaatttacaggatcaatagttttttttttttttttttctatgggattagatcccgagttattgcgaagcaaaaaaaacgatgagattatggaagtcaatattctcgcatttattgctactgcgctgttcattttagttcctactgcttttttacttatcatctacgtaaaaacagtcagtcaaaatgattagaattaaacttgacttattagctcttatcaatgattgacgaaataaaagggattgcaattccaagtcttaaatgaaatgagagaactggaatcaacagtataatagatggtgtagtagaaaggttcatatagttctttctaccacactatctattattatattgattgtataaatattctattgtataaagtgtataaagtagtattgtataaattaataaaatggatgggtttgatatagactagatacaatatctatccacataaatgaagtaattgattgagtcgttaacagataccccacggagttttatagtcacttcttcggatttgaaaaagaagtagtaaacctcacccatttttcatgcttgagccatgacatggggtgagtgaataaagcataaataagattactagaagtataaaacttaagtgaacacacacggatcacccaacgcaagatcttattatgcgtagtacgtagtacctctttgaacaaccacagcgcctatggcatctccagtagaaagtacgtatccacgtaatagtagcagtacttcctctttgaacagtcaagaaggaaaaacaaataaaaaataaaaaaataggggttggttgctcctcattgtaatgtaatatccataattatggtaagagcgggttcatcaaaatcaaatattctatttaggaaaggaataggaagagttcgtctggaaaaatttcctatcatgcgtattcctttgagtttcgaaatacgaacaacatcagaatcaaatcattgaaatatttgtttgatcgaaagatcattgttcatatattactggattaccctagaattttttgaaatggattatcttaaaacgcttcgcggaacggtctattaaacataaaccattgatccaatttgattactcaacttaattagtagtacccctagagcccacttcttccccatactacgagtgaaagggaaaacgtaaagaccaccattaaagcagcccaagcgagacttactatatccatgtaaattatctccctgatctctatgaatatgaaggaattattccattattaatcactaataatagtggaatcaatggtgcagagtcaaaatggcatttttctctaacgctattgatgaaccaacccaatgaatacaagagttcctatactctaactatactataagtatctctggtcgaatcggaaagcagtaagcaaaagcaagatatacagctacccttgggtatcttaaaggaatgttactaatgaaagatgtaggataggaatagtaaggcccattgtttgttttgttagctttcataagcataagcaaaaaaaaacggaaataaaataaaatagaaaatatatataccatcaagatggaaaagatcactatcttaactacctatcacatacctctatcttcccgcccatctaagtcttactgtctctgtttctttctgtgaaagaatcgggggacaccccattctgttcttagcagggtgttacaaaaaggggagaagttcttttttttttacttttattagaaaatgagattctctatatatattatagaatatggatataagatatagaatagttagttattgttagttattgtataactataatagttatagttaagagtcaattactcatccacatccaatctaatattgattggatacccgagtaagtactcagggactctcacgagtctcgatataaaataaaaactagccctttctgcaactcctaatttgattccccgccaacctacccaatctaattaaagactcagtcagtgggcatcaccctagtaaggtagggtaattaggaagtattgatagtatttcctataatctccctcagatcctagaatagaagcaaggattgggttttcatttaggaaccccctttcctttggctacctcaattttaggtatctgactttcgtagttatgaatctcacaattgaagttttactatcgattcgattgaaaaataaaatacaaataaatgaaatagcccgaacccatcggtaatcagtaataaataataaatgaggtttttttcatattgatacccgattttgaccataaccaaatggaaaaaattcaagtctttttttttttttattagagcctctatattcttaaatattcttaaagtattcttaaaatacagtatcgacaaccctagttatgctgccatcaggcaagaattttgtgagttctatttagcatagagggataaggtattccgaagcttttcttttgttgatcaggcgacacccggatttgaactggggagaaagggatttgcagtcccgcgccttaccactcggccatgccgccaaaataacccaaaatagacctaactctttcttttttgttttcgttttttttttgttttggggggggttactcaacctttttttggtttgtgttggattttgaaaacgggtttctttatccctttccaaaggggattcccgggtccagggttctcttgattgtagagtctttcaaaacatacagatcttttttttttatttttgatattgaaacataaaaaaaaaatcgatttctagacacagagtcaaaaattcagggtaaattagaactattaattattccctgtgaattcatgaatagttcttggatttggatctaacgttttctttccttaacttaataattaaattaataacataagaaaacaaaaaagttgatacacgactaatcagtatcaattgttttcaatttcaattataacaacatatatgtgtatatgtaaaccctcgagtagaaattgttacacggatacctagtcctatccaccttattttatagggaattgtcgtgcttgaattttgcattgaatatttttctattgaataagttgaatctaaattgcaaattctcatatagcaacatcgaaaagatgggatatgcagataactagatagctatatctgtatatacttatacaacgccctttacgcgtttcaatcgtattctactaattctactaacactaacaagggctccctattctctgggaatccttttttgaataatggtggaatcaatgaaatgagttaagtgtaaaaaccaactcgatactgttccagattattctgtctttatctcattcatagagaatggatcaaatcatgaatctatttatggtacccaatcttattgtaatatcataataacaataacaggtagaaattggatccatttgtatattctatacaagactccatcagtctaagctaagggacagaattttgtttcaaagaatgttttattaatccatctccatttggattaatccatctccatttggatccgtctaaaattctctctcttttttcctccgtctatgccaatttcattggtatatggaattggataaaatttcatgtgattcagtaaaaagaatatacattccatcattgctcgatccatctatatggttcgataaagagttaaccaataatgggattttatcaataaaagggaaactaaattaagatgctccgggatgaaaatgagggaatgtctacaatacctggatttagtcagatacaatttgaaggattttgtagattcattgatcaaggtttgaccgaagaacttcataagtttccaaaaattgaagatacggatcaagaaatcgaatttcaattatttgtggaaacatatcaattggtggaacccttgataaaagagagagatgctgtgtatgaatcactcacgtattcttctgaattatatgtacccgcggggttaatttggaaacccggtagagatatgcaagagcaaaccctatttattggaaatattcctctaatgaattccctgggaacttttatagtaaatggaatatacaggattgtgatcaatcaaatattgcaaagccctggtatttattaccgttcagaattggaccataacggaattgctgtctataccggaacaataatatcagattgggggggaaggtcagaattagagattgatagaaaagcaagaatatgggcccgcgtgagtaggaaacaaaaaatatctattctagttttactatcagctatgggttcgaatctaagagaaattctagataatgtttgctaccctgaaattttcttgtctttcctgaatgaaaaggaaaaaaaaagatcgggtcaagggaaaatgccattttggagttttatcaacaatttgcgtgtgtaggtggggatccggtattttcggagtccttatgtaaggaattacaaaagaaattttttcaacaaagatgtgaattaggaaggattggtcgacgaaacatgaaccggagacttaatcttgatatacctcagaacaatatatttttgttaccacgagatatattggctgctgccgatcatttgatcggaatgaaatttggaatgggcacacttgacgatatgaatcacttgaaaaataaacgtattcgttctgtagcggatctgttacaggatcaattgggattggctctggttcgtttagaaaatgtggttcgaggaactatatgtggagcaatcaggcataaattgataccgactcctcaaaatttggtaacttcaactccattaacaactacttatgaatcctttttcggactacaccctttatctcaagttttggatcgaacgaatccattgacacaaatagttcatgggcgaaaattgagttatttaggtcctggaggattaacaggtcgaactgctagttttcggatacgggatatccaccctagtcattatggacgtatttgtccaattgacacgtccgaagggatcaatgttggacttattgggtccttagctattcatgcgaggattggtcattggggtctatagagagtcctttttatgagatatctcagagatctaaagaagcacaggtgttttatttagcaccaagtatagatgaatactatatggtagcgacaggaaattctttggccttgaaccgggatattcaggaagaacaggttgttccagctcgataccgtcaagaattcctgactattgcatgggaacagattcatcttcgaagcatttttcccttccaatatttttctattggagcttccctcattccttttattgagcataatgatgcgaatcgggctttaatgagttctaatatgcagcgccaggcggttccgctttctcggtccgagaagtgcattgttggaactgggttggaacgccaagcggctcttgattcgggagtttccgctatagccgaatgcgagggaaagattgtttataccgatactgacaagatagttttatcaggtaatggagacactataagcattccattagttatgtatcaacgttccaacaaaaacacttgtatgcatcaaaaacctcaggctccgcggggtaaatgcattaaaaagggacaaattttagcgggtggtgcggctactgttggcggtgaactcgctttgggaaaaaatgtattagtagcttatatgccgtgggaaggctacaattttgaagacgcggtactcattagcgagcgtttggcatatgccgatatttatacttcttttcacatccggaaatatgaaattcagactcatgtgacaagccaaggtcctgaaagaatcactaaggaaataccccatttagaagctcatttactccgcaatttagacagaaacggaattgtgatgctgggatcttgggtagaaacaggtgatattttagtaggtaaattaacgcctcaggcggcgaaagaatcatcgtatgccccagaagatagattattacgagccatactcggcattcaggtatccactgcaaaggaaacttgtctaaaattacctatagggggaaggggccgggttattgatgtgagatggatccagaaaaaaaaagggtccagttataatccagaaatgattcgtgtatatatttcacagaaacgtgaaatcaaagtaggtgataaagtagctggaaggcatggaaataagggtatcatttcaaaaattttgcctagacaagatatgccttatttgcaagatggaacaccagtggatatggtcttcaacccattaggagtaccctcgcgaatgaatgtgggacagatatttgaatgctctctcgggttagcggggaacttgctgggcagacattatagaatagcaccctttgatgaaagatatgagcaagaagcttcgagaaaactcgtgttttctgaattatatgaagccagcaagcaaacagcaaatccatgggtctttgaacccgagtatccaggaaaaagcagaatatttgatggaagaacaggagatccttttgagcaacctgttataataggaaaaccctatatcctgaaattaattcatcaagttgatgataaaatccatgggcgctccagtggacattatgcacttgttacacaacaaccccttagagggagggccaagcaagggggacaacgagtaggagaaatggaagtttgggctctagagggatttggtgttgcgcatattttacaagagatgcttacttataaatccgatcatattagagctcgccaggaagtacttgggactatgattattggaggaacaatacctaacacggaggatgctcccgaatcttttcgattactcgttcgagaactacggtctttggctctggaactgaatcatttccttgtatctgagaagaacttacagattcatagggaggaagcttgatcggaatgaatccgaatttttcttctatgatcgatcggtataaacatcaacaacttcgaattggatcggtttctcctcaacaaataagtacgtgggccaccaaaatcctacctaatggagaaatagttggagaggtgacaaaaccctatacttttcattacaaaaccaataaaccggaaaaagatggattgttttgcgaaagaatctttggacctattaaaagtggaatttgtgcttgtggaaattttcgagtgatcggagatgaaacagaagacgcgaaattttgtgaacaatgcggagtcgaatttgttgattctcgggtacgaagatatcaaatgggatacatcaaactggcatgcccagtgactcacgtgtggtatttgaaacgtcttcccagttatatcgcgaatcttttagataaaccccttaaggaattagaaggcctagtatactgcgatgtgtgatttgatcgaaatcttgattttacagattcggaatgagaaactgtcatcccattcaatccgattgggatgcccccgactctgacatgtctctttagaggaggaacatgaagctcagaattatgggtgtattaaatacttccaaatagaaaggggaattgatccatggtcgattccgtaatagaaaaatgggaattgctagttatacctcgtgaaaaaaaaaaaaaaaaaaaacttctttcgtggaattagccattccatttcttttttgaaagagattccattcaagtaaacataaacaaatatgacatggttacaggagtttatccatcgcatatatgcttcaaaggatattatagcataaccatcgaggtgaagtagggacctaaaagatcgaatggaacgatacatagacaagtaaatcccttaccttatgagatgagtgagttcgaagatattcgaattttaattttaataattaaaattaaaggaatttctcattcgaagggaagtagactactcaataatttctcatttcctttatgtcataattgagttgaataactaattcataaagtaaaagtaagaatgaatcaatgagatattggttggtcctcgctgtgaacttgagtaaggagtaaatctttatggggcttctagaacaaaattggaattgtaaaataagaacccctttctttatttgatgtaactacttgagccggatgagaggaaaccttcacgtccgatttttaaggggggaattcataggaacctatcctaatttttcttttgctaggcccattgctaaaaaacccactttcttacgattacgaggttcattcgaatatgaaatccaatctcggaaatacagcatcccacttttttttactacccaaggcttcgatacatttcgaaatagagaaatctctacaggagcgagtgctatcagagaacaattagccgatctggatttgcgaattattatagatcattcattggcagaatggaaggaattaggggaagaagggcccaccgggaatgaatgggaagatagaaaaattggaagaagaaaggattttttggttagacgcatagaattagctaagcattttatccgaacaaacgtagaaccagagtggatggttttgtgcttattaccagttcttcctcccgagttgagacccattattcagatagatgggggtaaactaatgagttcggatattaatgaactctatcgaagagttatctatcggaacaatactcttactgatccattaacaacaagtagatccacaccaggggaattagtaatgtgccaggagaaattggtacaagaagccgtggatacacttcttgataatgggatccgcggacaaccaatgagggacggtcataataaagtttacaagtcgttttcggatgtaattgaaggcaaagagggaagatttcgcgagactttacttggtaaacgagtcgattattcggggcgctccgtcattgttgtgggcccttcgctttcattacatcaatgtggattgcctcgagaaatagcaatagagcttttccagacatttttaattcgtggtttaatcagacaacatcttgcttccaacatagggattgctaaaagtaaaattcgggaaaacaaacctattgtatgggaaatacttcaagaagttatgcaggggcatcccgtattgctgaatagagcaccaaccctgcatagattaggcatacaggcgttccaacccattttagtggaaggacgtgctatttgtttacatccattagttcgtaagggattcaatgcagactttgatggggatcaaatggctgttcatgtacctttatcttttgaagctcaagcagaggctcatttacttatgttttctcatatgaatctcttgtctccagctattggggatcccatttccgtaccaacgcaagatatgcttatgggactctatatattaacaattgggaatcgtcgaggtatttgtgcaaataggtataatccatggaatcgcggaaactatgaaaataaaataggtggtgataataactataagtatacgaaagagaaagaaccttatttttgtagttcctatgatgcacttggagcttatcgtcagaaacgaatcaatttagatagccctttgtggctccggtggcgactagatcaacgtgtcattgcctcaagagaacttcctatagaagttcaatatgaatcctcgggaacctatcatgagatttatgggcactttttaatagtgaaaagtgtcaaaaaagaaatcctttgtatatacattcgaaccacagttggtcatatttctttttatcgagaaatagaagaagccatacaagggttttggcgggcctactcatacggtgcctaagctaagtaattatgtgatatgatatccgggcgagcctccttggttcaaccggtatcctaattcctgaatttctacgtgaatcaagatcgaggaaaggaagtcttagaatcactgactcaaccccattgtcgaatcccactcagacgaatatggaggtacttatggcagaacgacccgatctagtctttcacaataaagtgatagatggaactgccatgaaacgacttattagcagattaatagatcacttcgggatggcatatacatcacatatactggatcaagtaaagactctgggtttccggcaagccactgctacatccatttcattaggaattgatgatcttttaacaataccttctaaaggatggctagtccaagatgctgaacaacaaagtttgattttggaaaagcaccatcattatgggaatgtacacgcggtagaaaaattacgtcaatctattgagatatggtatgctacaagtgaatatttgagacaagaaatgcatcttaattttaggatgactgatccttctaatccagtccatataatgtccttttcaggagctagaggaaatgcatctcaggtacatcaattagtaggtatgagaggattaatgtcggatccccaaggacaaatgattgatttacccattcaaagcaatttacgtgaaggactttctttaacggaatatatcatttcctgctacggggcccgcaaaggggttgtggatactgctgtacgaacatcagatgctggatacctcacgcgtagacttgttgaagtagttcaacacattgttgtacgtagaacggattgtggcactatccgaggtatttccgtgagtccccaaaacgggatgacggaaaaaatgttgatccaaacattaattggtcgtgtattagcagacgatgtatatatgggtctaaggtgtattgccgctcgaaatcaagatatcgggattggacttgtcaatcgcttcataacttttcaggcacaaccgatatatattcgaacccccttcacttgccgtagtacatcttggatctgtcgattatgttatggtcgaagtcccactcatggtgacctggttgaattaggggaagcagtgggtatcattgcgggtcaatcaattggggaaccggggactcaactaacattaagaacttttcatactggtggagtattcacaggtggtactgcagaacaggtacgagctccttttaatggaaaaattcaatttaatgaggatttagttcatccaacacgtacacgtcatgggcatcctgcttttctatgttatatagacctgtatgtaactattgagagtcagggcattatccatagtgtgaatattccaccaaaaagttttcttttagttcaaaatggtcaatatgtagaatcagaacaagtgatcgctgagattcgcgctggaacatctactttgaattttaaagaaagagttcgaaaacatatttattctgactcagagggagaaatgcactggagtaccgacgtgtaccatgcacctgaatatacatatgggaatgttcatctcttaccaaaaacaagccatttatggatattatcgggggacccgtgcagatctaatagagtgcccttttccctccacggggatcaagatcaaatgaatgttcattctctttctgtcgaacagagatatatttctggcctctcagtgactaatgatcgagtgagacacaaattgtttagttcggatcctttcggtaaaaaagtagataggagttttgataattcaagatcagatcgaatcatatccaacggccattggaatttcatatactccgccattctctacgagaattctgatttattggggaagaggcgaagaaatagattcatcctcccattccaatatgatcaagaacgagagaaagaactaatgtcctgttctggtatctcaattgaaatacccataactggtattttacgtaaaaattgtattcttgcttattttgacgatccccaatacagaagaagcaattcaggaattactaaatatggtaccgtagaggtggatttcatcctaaaaaaagaagatttgattgaatatcgaggagcaaaagaatttaggccgaaataccaaacgaaagtagatcgcttttttttcattcccgaagaagtgcatattttacccagatcttcgtccataaaggtacgtaacaatagtatcattggagtaggtacacgaatagctttaaatacaagaagccgagtaggtggattggtccgagtggagagaaaaaagaaaaagattgaattgaaaatattttctggagatatacattttcccggagagacagataaaatctctcggcatagcggcatcttgataccaccaggaacgggagaaaaaaattctaaggactcaaaaaaattgaaaaattggatctatgtccaacggattacacccatcaagaaaaagtattttgttttggttcggcctgtagtcacatatgaaatagccgatggcataaatttagcaacgcttttcccccaggatctgttgcaggaaagagataatgtgcaactacaagttgtcaattatatcctttatggaaacggcaaacccattcgaggaatctcccacacaaatattcaattagttcgaacttgtttagtattgaattgggaccaaggacaaaatagttctatagaagaagtccatgcttcctttgttgaagtaaggacaaatgatctgattcgaaatttcataagaattgacttagttaagtcccctatttcgtgtaccggaaaaagggatgataggggagattcgggattgaatctcgataatggatcagatcgcaccaatattaatcctttttaccccaaggcgaagattcaatcacttacccaacagcaagggactatccatttgttgctgaataaaaataagcaatgccaatcttttctaattttgtcatcatctaattgttctcgaattggtccattcaatggttccaaatctctcagtgtgagaaaaaaatcaattaaagaagattccacgattgctattgctattagcaatttgttgggccccctgggtactgtatttaaaattgcgaatttttattcatcttgttgcttaataacttataatcagatcttgttaaataaatatttgcgacttgaaaatttaaaacagactttccgagccattcaatattatttaatagatgaaaatgggggaatttacaattgcgatccttttagtaacatcatttttaatccattcgatttaaattggcgctttctccatctcaattattgtgagaagacatccacaacaattagccttgggcagtttatttgtgaaaatgtatgtatatccaaatatggaccgcgcataaaatccggtcaagttataattgttcatgttgactccttagtaataagattggctaagcctcatttggccactccgggagcaaccgttcatggccattatggagaaattctttatgaaggagatacattagttacatttatatatgaaaaatcgagatcgggtgatataacgcagggtcttccaaaagtggaacaagtgttagaagtgcgctcaattcattcaatatcgatgaacttagagaagagagttgaaggttggaacaaacatataacaaaaattattggaaatccctggggatttttaattggagctgagctaaccatagcgcaaagtcgtatttctttggttaataagatccaaaaggtttatcgatcccagggggtgcagatccataataggcacatagagattattgtacgtcaaataacatcaaaagtgttagtttcagaagatggaatgtctaatgttttttcacccggagaactaatcggattgttgcgagcggaacgggcagggcgcgctttagaagaagcaatctgttaccgagccattttattgggaataacgaaggcatctctgaatactcaaagtttcatatccgaagcgagttttcaagaaaccgctcgagttttggcaaaagctgctctacgaggtcgtattgattggttgaaaggcctgaaagagaatgttgttctggggggtatgatacctgttggtaccggatttaaaggattagtgcatcgttctaggcaacacaacaacattcctttggaaatcaaaaagaagaatctattcgaggggaaaataagagatatttttttccaccacagagaattatttggtttttgcacacaaaatactttccatgatacaacagaacaatcatttacaggatttaatgattcctaataagagcatattcattcttttcttttaacttttaactatatagggtatggtatgtatggtccggtcatttgatttgttaataaagataataacgaatagaaagtaattaacgacttggaccgtgtatcaatggccaatccccggcagaaggttccgtcggaacaattatttatttcaaggtaccttgtttcttaaaacaaaaaataaaagataaagtgtggggggaaatgacaagaagatactggaacatcaatttagaagagatgatggaagcgggagtgcatttcggtcatggtactaggaaatggaatcctagaatggcaccttacatctctgcaaagcgtaaaggtattcatattacaaatcttactagaactgctcgttttttgtcagcagcttgtgatttagtttttgatgcagcaagtaggggaaagaactttttaatagttggtaccaaaagtaaagctgcggattcagtagcagcagctgcaataaaggttcggtgtcattatgttaataaaaaatggctcgggggtatgttaacaaattggtctactacagaaacgagacttcataagttcagggacttgagagtagaggcggggaaactcaaacgtctcccgaaaagagacgctgcaatgttgaagagacaattatctcacttgcaaacatatctaggtgggatcaaatatatgacggagttacccgatattgtcatcatcgttgatcagcaagaagaatatacggctcttcgagaatgtatcactttgggtattccgacgatttgtttaatcgatacaaattgcgacccggatctcgcagatatttcgattccagccaacgatgacgctatagcttcaatccgattgattcttaacaaattagtatccgcaatttgtgagggtcgttctagctatataagaaatcgttgattaataataagattaagataagtcaataactttgggaactccatagattgattgaatcggttaccattcctgaatctcaaaaaagagatcaaaattgatggggatattctgtgattccttggcacctgaaacatacgattaaagtcaaagtaggcgagtcgagaaagagatggttgaatctgaatcaaaataattactttttaagttgtatttctgtcagagggtaatatgaattttctaccatgttccataagcacactaagggatatatacgatatatctggtgtggaagtaggccaacatttctattggcaaatagggggtttccaagtccatgcccaagtacttatcacttcttgggtcgtaattgctatcttattaggttcagctgctatagctgttcggaatccacaaaccgttccaaccgacggtcagaattttttcgaatatatccttgaattcattcgagatttgagcaaaactcagattggagaagattatggcccctgggttccctttattggaactatgtttctatttatttttgtttctaactggtcgggtgctcttttaccttggaaaatcatacagttacctcatggagagttagcagcacctacgaatgatataaatactactgttgctttagctttacccacatcagtggcatatttctacgcgggtcttaccaaaagagggttgggttatttcggtaaatacattcaaccaactccaatacttttaccaattaacatcctagaagatttcacaaaacctttatcacttagttttcgacttttcgggaatatattggctgatgaattagtagttgttgttcttgtttctttagtaccttcagtagttcctatacctgtcatgttccttggattattcacaagtgggattcaagctcttatttttgcaaccttagccgcggcttatataggtgaatccatggagggtcatcattgactagctttcaaaaaaaaaaaagcttatcccaattccaactctcgagtgtctcaagataatctactgggggaacacaatatatccaaaaagtgcatgtatggtctagagtaggaacaaaaaagatgtacgatattggggaattgtaaaaaaaaaagggaagagatctaaaagatctttttcctaagatttacttttggtccatttatgttacgtctctctaatcaatattctataattctataatataatcgtatttgttcagtcaattactatattttaaaaatttaactaagaattgttatcttatctgtctctgacatgcgcctaaaacaactaaaataaaaagagtatgttctatagaaacaatcattccgtttttatttgatttgattcaatttgattcaacgattgatcaaagttgtcattaattgcaatcaaatctttatacagaatgattcgggctaacgatcccgtctatttatattcatgcaggagtcgcgataatgtaaaaggaagagaagagtttacaagcaaataagattcataaaaaagtggattaggggctcgtgctgagctaggtatggatatatatatatatatatatataatggctataagccaattcctgtgtatgtttcgaagcatgattcaattcttcggctagaatccaattcaacagcataaagaatggtttacgttatggaagaaacacttgtatatgtgatattagatattcattaattgtctatatatggattatacatacaaataatatatatggattatacatacaaataaaataaatatataaatataaaaatagaatctattatttatttattattatttattttatatatatttattcttttaccataccatcctactgaattaaatgaattcaaattcaataggagttcttccgttttatctgtgaccggggattgaatgaataaacagatgaagtcaagcatatagagaagaacgtgccaagaataaaaagagtggcttagaacaaagaaattgaataactagaatcttttggatttacaaagactacacggtagaaattataaaggagatattgaagtcgttcggctaattcaggaatattattacctcaattcacttttctgttcttatcttagttacttcgcccgaatgggtctttgaaataataagtaataattcattggttgattgtatcattaaccatttctttattttggtgtgaggagcttactatgaatccactgatttccgccgcttctgttattgctgctgggttggccgtagggcttgcttctattggacctggggttggtcaaggtactgctgcgggccaagccgtagaaggtatcgcgagacaaccggaagcagagggtaaatacgaggtactttattacttagtctggctttatggaagctttaacaatttatgggctagtcgtggcattagcgcttttatttgcgaatccttttgtttaatcccataaatattttaaatacgtactcattttcttatttttttgttgtgtacttgcctcttgcttcttagaattagatcaacacttcacccctatcatctaatcacttgttgatctaatcacttgttcgttgaaacaataccccggggaaggactaatttgaggatgaggaatttgcgaatccactcgctttcttccttcccgcccttaatggaaaggaaacccccctttttttttttttagttttacttttttttattagattaggatggagcaaacgcaattgacatgaggcctggggcctaggcctaataagtgtcttattgagaacttccataattcataattctaataataataaaaaaaaaaaagaatagatttcatttctttatttcattttttttttcttaatttctaaaaaaaaaagagctcaatcaaacaaaacacaaaggatgaggtgatacaaaaagaactctgtttgattttcttagtcctatctatatctataagaggagatcatatgaaaaatgta

SEQ ID NO: 949 - DNA, 3746 bp, Cajanus cajan
atacaatagaataaagttcggatattgaaaaattgaattgaattattctttttagtataatactttagtgaatttcgcttcatttataatatttttcatttagtttagttttaattttgatttataagattggattttccataaaaaaggagtctttatgtcacgttacagaggacctcgtttcaaaaaaatacgccgtctggggtctttaccaggactaactcgtaaaaagctaacagtcaaaagcgaacttagaaatcaatcgcgatccagtaaaaaatctcaatatcgtattcgtttagaagaaaaacaaaaattgcgttttcattatggtcttacagaacgacaattgcttaaatacgtccgtatcgccggaaaagctaaaggatcaactggtcaggttttattacaactacttgaaatgcgcttggataacatactttttcgattgggtatggctgcgacgattcctcaagcccgccaactaattaaccatagacatgttttagttaatggtcgtatagtagatataccaagttatcgttgcaaacctcaagatattattacagcgaaggatgaacaaaaatcgaaaactctgattcaaaattatcttgattcagccccccgtgataaattgccaaatcatttgactcttcacccattccaatataaaggattaatcaatcaaataatagataataaatgggttggtttgaaaataaatgaattactggtcgtagaatattattctcgtcagacttaaacctaactaaaataacaagagtttttatccgaggattttccgacattcatatatcatagacatgattcatatatcatagacatggatataggaaaattttaattccttgctcactttttccactcttttttatattaccgaaaaaattaggaatagagagtccatatcaaaaaattggaaataatggtatgcattgttatttgaaacattgtgatgggtaatattgattaatttgttaaagattcggaaagagagggattcgaaccctcggtaaacaaaaagcctacatagcagttccaatgctacgccttgaaccactcggccatctctcctacataatgatgtccagaaaccgggtgaatagtgaattcattcatatttttgataaatgcataaaacctatccaaactaaaaaatagaaagataaaaattagaaaaaccctcctacaaagccttaggataaaccaattggattaatgaatctgtttttacgttatttcgcactgtattgtacaattcctttatttgtgtatttgtgggattgatttatttctcacacgataaataatttaattatagaatgaatttatacctatgcctagatctcggataaatgaaaattttattgacaagaccttttcaattgtagccaatatcttattacgaataattccgacaacttcgggagaaaaaaaggcattcacttattacagagatggtgcgatttgtatatatatatttaaccgaaatcggtaaaaaaatgaaaaaaaaccacgcttgctgaaggtgaaatttgtaaaaaaaaacaattaattccttctgtcgtgtatcctcgattaatgcagcctcatatgcttgaatttcaggtttctagtataaagcgaaaggttatacttatggggttaggtcaaccctaacctactagtaccgataggcagcatggggaaagaagcactacgcttaggaatcgacaacacgaaaactttgttttgtatatatttgtatatatatccttccatatcttattgggattgggacaaacaagaatggttgggacaataaacatccatctcgttcgtattttggatacccgtataaccatcgaatatttttgaagtgaataattccgggaaactaagcagcgttgaggacaaagaaattgttgaagttactgtctttttatccagtaccaagatacttaatgttaaggaagaattttttataggaaggttggctagagatttgttataaaaacactagccctgttcagttgataatgagaatactaaaatctttttggattctatgtatttttatcattacatatataagggaggagccgtatgagatgaaaatttcacgtacggttttggagcggagattctttgaaccgaatgacgaccgtaacggatgtcagctcaatctgaaggaaattatgcggaagctttacagaattattatgaggctatgcgactggaaattgatccctatgatcgaagttatatactttataacataggccttatccacacaagtaacggggaacatacaaaagctttggaatattattttagggcgctcgaacgaaacccattcttaccccaagcttttaataatatggccgtgatctgtcattacgtgcgactatctccaatatagaaagaaaaagaaacgaacaagcaaaaatacacaaatactaatatatatatctataatatatatctatataaaaaatactagaaaaaaaaaggactttctacatatacatatatcgtccaaaacaacgatttttatcagctgtagcaaagaaagaaacttcatagaagtcaaacaaaatatgaagaaatagatatgcctagatacccgctttttctatggataaaagatctaattgataaaggaagcatcgtaaagatcaattaacacggttttgagccgatacaataaaaactgcttacttatctcatgatagaaaagtaaggaaaccgcttatgtaataaagtggatcccctgatttttttagcagcggtgtagtatcaaatcccaaagatagaaagccttttctttataagaaagaaaatactttttccaagattctatagaaatggatatatcatatagaaaaatatatgatatatatataatcgagatagttacttttcagaaaattagaatgagggtgttaattcgaatgctttcttcctttttctgaaggtaggagaaaagataaaactaaaaaaagatgagattctttgaaattctttattagtcaaaattcaagtttgaaactcatgttaataacttctttttttttcttttagttaacttaaaaaaaatagaaaaaaaaagaattgactgctgagccgtatgagtcaggaaattctcaagtacggttctaaggaaaggaattgactcacctattccgaccgaggagaacaggccattcgacagggagactcggaagttgcggaatcttggtttaatcaagccgctgaatattggaaacaagctatagcccttacccctggtaattatattgaagcacagaattggttgaagatcacagggcgttttgaataaaaacactctgtttatttatttttcttctattttttttttttcttaaaaaatatatctatatctatctatatatagatagatatagatatatttaatttgttataatttattgtttgttgtccccatcaatcaaataaaaaagaatttctatgggaacgaccaatcacagaatttaattatatattatactttataaaatttatactttaaaaaattgttacatttctttgagtatttcgtagagataaacgatatgtggatacaatagataattttttcgttttttctgctattcaaacaaatattcaatccaattaagaaaagagaccttaccttcgaacaaaaaaaagaaagaaaaataccagtgcctcataaattgcctaataatgagtgctaatgacta

SEQ ID NO: 950 - DNA, 1747 bp, Persea americana
tttttcccgcgcgatttttaatactggaacggtcgatattcattttttttttttcgttctacctcccccctttctgaatgaaaccagcgaaatgtctcattatgatctggattgcatccttatcttatcctttccttagtaccgatctgctctaatatgattaatctaatctgctataactaactgctataaattaagtataatatataaattaagaattaaaaaaaacattctatatagatattctatatagatatagttagttagttctattgcacttatttctgttatgtgagcccgcttagctcagaggttagagcatcgcatttgtaatgcgatggtcatcggttcgattccgatagccggcttttcaatattccttgagatcaaggaatattgaaaagactcctctctttttttcttttaaaaatgtcgggtcaccgatctattatgtcgtagcaacttccaactatgaataaaaaactgatttgattggagcagttaaatctctacactacagaataaatcaagaaaggggtccttcacttcctatatatacaaaataatccggatattgatacaaaattcatctcattcttcttttgtagtcttcttttgtagtacttcaatagatttagtttcgtttatcgtttagttcagtcttaatttaagtttattctgtaaaataaaattttaacaaggagtctttatgtctcgttaccgagggcctcgtttcaaaaaaatacgctgtctgggggctttaccgggactaactagtaaaagacctagatccggaagtgatcttagaaaccaatcacgtttcgggaaaagatctcaatatcgtattcgtctagaagaaaaacaaaaattgcgttttcattatggtctgacagagcgacaattgcttagatatgttcgtattgccggaaaagccaaggggtcaacaggtcaggttttactacaactacttgagatgcgtttggataacatcctttttcgattaggtatggcttcgaccattcctggagccaggcaattagttaaccatagacatattttagttaatggtcgtgtagtagatatcccaagttatcgctgcaaaccccgagatattattactgcaagggatgaacaaagatccagagctctgattcaaaattatcttgattcatcgccccgcgaggatttggcaaaacatttgacttttgactcatcccaatataaaggattagtaaatcaaataatagatattaaatggatcggtttgaaaatcaatgagtttctagtcgtagaatattattcccgtcagacttgaacctcactaaaataacaaagcttcggaccattttgcccccccccctcttttttttttttttcaccgaagaaggggtttgatccggatttttctcccattcacgtatcacaaatggatcagcagtgagattttcattcctttccactctttccggtattttccgtactgcagtaattaggaatagagaatctctatcaaataagggtcttactgttggaataatggtatcaattgttatttgatttgatacattgtggtcggttggtgaattagatgaaggtacggaaagagagggattcgaaccctcggtaaacaaaagtctacatagcagttccaatgctacgccttgaaccactcggacatctctcctacataatcttattattaatggcccagaaaccgagtaaatagcgagtcattcatattattgca

SEQ ID NO: 951 - DNA, 606 bp, Ricinus communis
tcctcgttttaaaaaaatacgccgtctggggactttaccgggactcactagtaaaaggcctagggctgggagcgatcttagaaatcaatcacgctccggtaaaaaatctcaatatcgtattcgtttagaagaaaaacaaaaattacgttttcattatggtcttacagaacgacaattacttaaatacgttcgtatcgccgcaaaagccaaagggtcaacaggtcaggttttactacaattacttgaaatgcgtttggataacatcctttttcgattgggtatggcgtcaactattccctgagcccgccaattagttaatcatagacatattttagttaatggtcgtatagtagatataccaagttatcgctgcaaaccccgatatattattacagcgagggatgaacaaaaatccagagctatgattcaaaattatcttgagtcatccccccaggaggaattgccaaaacatttgactcttgacccatttcaatataaaggattggtcaatcaaataatagataataaatggatcgacttgaaaataaacgaattgctagtggtagaatattattctcatcagacttaactctaactaaaataaca

SEQ ID NO: 952 - DNA, 2166 bp, Glycine max
aaaaaattgggagaattcgatcgttgtggacaaatcaagaaaagacctacttcttttctttttttttctatacatagaataaagttcggatattgatagaattcgtctaatcttctttgtagtataatactttagtagattttgcttcatttataatagaatattttcatttagtttagttttaattttgatttataagattttccattaaaaaaggagtctttatgtcacgttacagaggacctcgtttcaaaaaatacgtcgtctggggtctttaccaggactaactagtaaaaggccaacagtcaaaagcgaacttagaaatcaatcgcgctccagtaaaaaatctcaatatcgtattcgtttagaagaaaaacaaaaattgcgttttcattatggtcttacagaacgacaattgcttaaatacgttcgtatcgccggaaaagctaaaggatcaactggtcaggttttattacaactacttgaaatgcgcttggataacatactttttcgattgggtatggctgcgactattcctcaagcccgccaattaattaaccatagacatgttttagttaatggtcatatagtagatataccaagttatcgttgcaaacctcaagatattattacagcgaaggatgaacaaaatcgaaaactctgattcaaaattatcttgattcagccccccgtgagaaattgccaaatcatttgactcttcacccattccaatataaaggattaatcaatcaaataatagataataaatgggttggtttgaaaataaatgaattactagttgtagaatattattctcgtcagacttaacctaactaaaataacacgagttttataccaggattttccgccattcatatatcatagacatggatatggtaaaattgtcattccttgcccacttttttcaactatttttgtattaccgaaaaattatgaatagagagtccatatcaaaaaatgggaaataatggtatgcattgtgatgagtaatattgatgaatttggtaaagattcggaaagagagggatcgaaccctcggtaacaaaaagcctacatagcagttccaatgctacgccttgaaccactcgccatctctcctacataatgatgtccagaaaccgggtgaatagtgaatcattcatatttttgataaatgcataaaacctattcaaactatcaaatagaaagaaaaattctaaaaaaacctcctacgggtcttaggataaacaaattggattaattaatgagtccgtttttacgttatttcgcactgtattgtacaattcctttatttgtgggattgatttctcacacgataattaattaaattatagaatggatttatacctatgcctagatctcggataaatgaaaattttattgataagaccttttcaattgtagccaatatcttattacgaataattccgacaacttcaggagaaaaagggcattcacttattacagagatggtgcgatttgattctatttttttaccgaaatcggtaaaaaatggaaaaaactcacgcgtgttgaaggtgaaatttgtaaataaaaaggattaattccttctgtcgtgtatcctcgattaatgaagccttatatgcttgaactttaggtttctagtattaagcgaaaggttatacctatacttatgtggttaggtcaaccctaacctactagtagtactgataggcagcattgggaaagaagcactacgcttgggaatcaagaacacgaaaactttgtatctatatatagagagatagatatccatgtcttatcgagattgcgacaaacaagaatggttgggacaataatatccatctcgttcatattttggatacccatataaccatcgaagattattgaggtgactaattccgcgaaattaagcagcgttgaggacaaagaaattgttggagttactgttttttttatccagtaccaacatacttaatgttaagaaatcattttttacaggaaggttggctagatattttttgtaaaaacactagccctgttcagttaataatgagaatactgcaatctttttgattctatgtatttttatcattacacacataagggaggagccgtatgagatgaaatctcacgtacggttctggagcggagattcttgaa

SEQ ID NO: 953 - DNA, 713 bp, Amborella trichopoda
gcacagggagtcagttttagtttaggttcatgttaattctgtaaaataaggagtctttatgtctcgttaccgaggacctcgtttcaaaaaaatacgccgtctgggggctttaccgggactaactagtaaaagacctagatctggaagtgatcttagaaaccaatcccgttctggaaaaagatctcaatatcgtattcgtttagaagaaaaacagaaattgcgttttcattatggtctgacggagagacaattacttagatatgttcgtatcgccggaaaagccaaagggtcaacaggacaggttttactgcaactactcgagatgcgtttggataacattctttttcgattgggtatggcttcgaccattcctggagccagacaattagttaaccatagacatattttagttaatggtcgtctagtagatataccaagttatcgctgcaaacccggagattttgttactacgagggagaaagaaagatccagagctctgattcaaaatcatatgaattcatcccccaacgaggagttgccaaaacatttgactctttactcgttgcagtataaaggattagtaaatcaaataatagatagtaaatggatcggtttgaaaatcaatgaattgttagtcgtagaatattattcccgtcagacttaaacctaaaattaagaaataagaaagcttcggacaattttgccaatttctt

SEQ ID NO: 954 - DNA, 630 bp, Lotus japonicus
tctttatgtcacgttatcgagggcctcgttttcaaaaaagatacgccgtctgggggctttaccgggactaaccagtaaaaggcctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatctaaaactctgattcaaaattctcttgaatcagccccccgcgaggaattgccaacccatttgactcttcagccattccaatataaaggattagtaaatcaaataatagatagtaaatgggttggtttgaaaattaatgaattgctagttgtagaatattattctcgtcagacttaaaccgaattaaaataaca

SEQ ID NO: 955 - DNA, 612 bp, Orobanche aegyptiaca
atgtctcgttaccgaggacctcgtttcaaaaaaatacgccgtctaggggctttaccaggactaactaataaacggcctaaagccgaaaaagatcttataaatcaatcgcgtttcgttaaaaaatctcaatatcgtattcgcctagaagaaaaacaaaaattgcgttttcattatggtcttacagaacgacaattacttaaatacattcgtatcgccggaaaagctaagggatcaacaggtcaagttttactacaattacttgaaatgcgtttggataacatcctttttcgattaggtatggctttgactattcctgcagcccgtcaattagttaaccatagacatgttttagtaaatgggcgtatagtagatataccaagttatcgttgcaaacctctagatattattacagcaaaggataaacaacaatccagaactctgattcaaaattccctcaactcttcccctcatgcgaaaataccaaaccatttgacccttgacctattccaatataaaggaatagtaaatcaaataataaatagtaaatgggtcggtttgaaaataaatgaatttttaattgtagaatattattctcgtcagattaaaacctaa

SEQ ID NO: 956 - DNA, 1888 bp, Phaseolus coccineus
ttttgctgaaaagaaagaaacaatccatttattcatatacaattgatataactcaaacgaatctagtggctataaaaaatcattcttttaatgtagaattagacatttctttaggaatctggaattccttaatatttacgaaaattgactttcaatactaataaataatctttttgaaatcaatcaatttaataatatatatctagaatattagatcaaaagagattatattcatattcattattatcttgcactttatgttatggactaacataacatataaataatagaaattctaaatattgggtttgattttctatattttctatgtttgtattcatttgaattttgttataaagaactaaaaatttataactcagatcccatgaaattcttctgcatatgtatatttcgtttacgttagccggtttagctcagaggttagagcatcgcatttgtaatgcgatggtcatcggttcgaatccgataaccggcttttctcaatttgttttttacataattgataatatcttttttagaaataaaaaattgggagagttcgatctctccggaagaaatcaagaaagaaacctacttttttgtatttttttatatacaatacaataaagttcggatattgataaaattcgtctaattcttctttgtactataaaactttagtagatttcgcttcatttcatttatatataatatttttcatttcgtttagttttcattttgatttataagatttttcattttaaaaaaggagtttttatgtcacgttacagaggaccttgtttcaaaaaaatacgtcgtctgggatatttaccaggacttactagtaaaaagccaaaagtcaaaaacgaacttagaaatcaattgcgcttcagtaaaaaatctcaatatcgtattcgtttagaagaaaaacaaaaattgcgttttcattatggtcttacagaacgacaattgctgaaatacgttcgtatctccggaaaagctaaaggatcaactggtcaggttttattacaactacttgaaatgcgcttggataacatactttttcgattgggtatggctgcgactattcctcaagcccgccaattcataaaccatagacatgttttagttaatggttgtatagtagatataccaagttatcgttgcaaacctcaagatattattacagcgaaggatgaacaaaaatcgaaaactctgattcaaaattatcttgattcagccccccgtgataaattgccaaatcatttgactgttcaccctttccaatataaaggtttaattaatcaaataatagataataaatgggttggtttgaaaatcaatgaattactggttgtagaatattattctcgtcaaacttaaacctaactaaaataacaagagttttttttttgacgaggattttctgttattcagatatcatagacatggatatggaaaaattgatattccttgcccacccgttatccactattttttgtattagcgaaaaattaggaatagagagtccatatcaacaaatttgaaataatagtatgcattgggatgagtaatattgatgaatttggtaaagattcggaaagagagggattcgaacccccggtaaacaaaaagcctacatagcagttccaatgctacgccttgaaccactcggccatctctcctatataatgatgcccagaaacgggttgaatgttgaatagtgaatcagtcatatttttaatcaatgcataaaacctattcaaactatcaaaataaaaagtaaaattagaaatacaaagtaaaataaaaaaaaacctcctacaaggtcttaggataaacaaatttgattaattagtttatttttacgttatttcgcactgtattg

SEQ ID NO: 957 - DNA, 996 bp, Cajanus cajan
atacaatagttgtattttttttatatacatttttttatatacaatagaataaagttcggatattgaaaaatgaattgaattattctttttagtataatactttagtgaatttcgcttcatttataatatttttcatttagtttagttttaattttgatttataagattggattttccataaaaaaggagtctttatgtcacgttacagaggacctcgtttcaaaaaatacgccgtctggggtctttaccaggactaactcgtaaaaagctaacagtcaaaagcgaacttagaaatcaatcgcgatccagtaaaaatctcaatatcgtattcgtttagaagaaaacaaaattgcgttttcattatggtcttacagaacgacaattgcttaaatacgtccgtatcgccggaaaagctaaaggatcaactggtcaggttttattacaactacttgaaatgcgcttggataacatactttttcgattgggtatggctgcgacgattcctcaagcccgccaactaattaaccatagacatgttttagttatggtcgtatagtagatataccaagttatcgttgcaaaacctcaagatattattacagcgaaggaatgaacaaaaaatcgaaaactctgattcaaaattatcttgattcagccccccgtgataaattgccaaatcatttgactcttcacccattccaatataaaggattaatcaatcaaataatagataataaatgggttggtttgaaaataaatgaattactggtcgtagaatattattctcgtcagacttaaacctaactaaaataacaagagtttttatccgaggattttccgacattcatatatcatagacatgattcatatatcatagacatggatataggaaattttaattccttgctcactttttccacttcttttttatattaaccgaaaaaattaggaatagagagtccatatcaaaaattggaaataatggtatgcattgtt

SEQ ID NO: 958 - DNA, 627 bp, Glycine max
tctttatgtcacgttacagaggacctcgtttcaaaaaaatacgtcgtctggggtctttaccaggactaactagtaaaaggccaacagtcaaaagcgaacttagaaatcaatcgcactctagtaaaaaatctcaatatcatattcgtttagaagaaaaacaaaaattgcattttcattatggtcttatagaacgacaattgcttaaatatgtttgtattgtcggaaaagctaaaggatcaattggtcaggttttattacaactacttgaaatgcgcttggataacatactttttcggttgggtatggctgcgactattcctcaagcacgccaattagttaaccataaacatgttttagttaatggtcatatagtggatataccaagttatcgttgcaaacctcaagatattattatagcgaaggatgaacaaaaatcgaaaactctgattcaaaattatcttgattcagccccccgtgagaaattgccaaatcatttgactcttcacccattccaatataaaggattaatcaatcaaataatagataataaatgggttggttgaaaataaatgaattacttgttgtagaatattattctcgtcagacttaaacctaactaaaataaca

SEQ ID NO: 959 - DNA, 620 bp, Glycine max
atgtcacgttacagaggacctcgtttcaaaaaaatacgtcgtctggggtctttaccaggactaactagtaaaaggccaacagtcaaaagcgaacttagaaatcaatcgcactctagtaaaaaatctcaatatcatattcgtttagaagaaaaacaaaaattgcattttcattatggtcttatagaacgacaattgcttaaatatgtttgtattgtcggaaaagctaaaggatcaattggtcaggttttattacaactacttgaaatgcgcttggataacatactttttcggttgggtatggctgcgactattcctcaagcacgccaattagttaaccataaacatgttttagttaatggtcatatagtggatataccaagttatcgttgcaaacctcaagatattattatagcgaaggatgaacaaaaatcgaaaactctgattcaaaattatcttgattcagccccccgtgagaaattgccaaatcatttgactcttcacccattccaatataaaggattaatcaatcaaataatagataataaatgggttggttgaaaataaatgaattacttgttgtagaatattattctcgtcagacttaaacctaactaaaataa

SEQ ID NO: 960 - DNA, 639 bp, Helianthus annuus
gaataataacttaaatagaaataagaagaaggagtctttatgccgcgttaccgagagatacctcgtttcaaaaaaatacgtcgcctgggggctttaccagggctaactaataaaaggcccagagctggaagtgatcttagaaaccaatcgcgttccgggaaaaaatcccaatatcgtattcgcctagaagaaaaacaaaaattgcgttttcattatggtcttacagaacgacaattacttaaatacgttcgtatcgccggaaaggcaaaggggtcaacaggtcaggttttactacaattacttgaaatgcgcctggataacatcctttttcggttgggtatggctccgactattccgggagctcgccaattagttaaccataaacatgttttagtcaatggccgtatattatatataccaagttatggctgcaaaccccgagatactattgcggcgagggatgaacaaaaacctaaagctctaacttaaaattctctcgattcataccctcctgaggaagtgccaaaccatttgactcttcaaccattccaaaatagaggattagtgaatcaaataatagttagaatatgggtgggctagaaaataaacgaattgctagtggtagaatattattcttgt

SEQ ID NO: 961 - DNA, 679 bp, Mesembryanthemum crystallinum
gaaggagtctttatgtcgcgttaccgggggcctcgtttcaaaaaaatacgtcgtctaggagcttgcctggactaactaataaaaggcctagagccggaagtgatcttagaaaccaatcgcgttccgggaaacgatcgcaatatcgtattcgtctagaagaaaaacaaaaattgcgttttcattatggtattacagaaagacaattacttaaatacgttcgtattgccagaaaagctaaagggtcaacaggccaggttttactacaattacttgaaatgcgtttagataacatcctttttcgattgggtatggctccgactattcctggagcccgccaattagttaaccatagacatattttagttaatggtcgtatagtcgatataccaagttatcgttgcaaaccccaagatactgttatggcgagggatgaacaaaaatccagagctctaattcaaaattatctagattcatctccccgcgaggaattgcccaaacatttgattcttcacccattcccgtataaaggattagtcaatcaaataatagatagtaagtggatcggtttgaaaataaatgaattgctagtggtagaatattattcccgtcagacttaaccctaaataaaatacaaagcaaagagttcggacaatttggcccctttctttcgccaaagtaa

SEQ ID NO: 962 - DNA, 3402 bp, Zostera marina
ggggatataattctttttatttaggaacaacatactattttgtagtactttagtatatttctttttttttatttagttcagttttaatttagatttattatttaaatattgaaatttacgtttcaataaaaaaaaggagtttttatgtctcgttaccgaggacctcgtttcaaaaaaatacgccgtctaggaactttaccgggactcactagtaaaagacctagatccggaagtgatcttaaaaaccaatcgcgttctgggaaaagatcacaataccgcattcgtctagaagaaaaacagaaattgcgttttcattatggtctaacagaacgacaattacttagatatgtgcatatcgctagaaaagcaaaaggatcaacgggtcaggtcttattacaattactcgagatgcgtttggataacattatttttcgattgggtatggcttcgaccgttcctggagccaggcaattagttaatcatagacatattttagttaacggccatatagtagatataccaagttatcgttgcaaaccccaagatattattactacaaaagataaacaaagatcaaaagctctggttcaaaattatattgactcattctcccgccaggaattgccgcaacatttgactgtcgattcatcccaacataaaggattcataaataaagtaatagatagtaaatcggtgggtttaaaaattaatgagttgttagtcgtagaatattattcccgtcagatttgagcctaccgaaaacgaaatgaggaaaactttccccccttttgacaaagtcaattcagagcttggatctccttttacatattacaaaaggatacaccggaaattaagaccgaaattggcaaccttttaggtactttgttttttatgtacacggaatctctatcaaataaagttcttattgttgggagaggaattcttttattcattgttattttatttgatccattgcgatcggtaacattgacgaattagttgaagttacaaaaacggaaagagagggattcgaaccctcggtaaacaaaagcctacatagcagttccaatgctacgccttgaaccgctcggccatctttccggcataatctttctttcttattattgatcagaaactgaccgaatagcgaattaatgctattcttgcagtacagatacagctaatcaattctaatctaataaaaaaagaaaatcttcaaagaataaaaatattccttttttttttatcatgatgaaatacaaatttctataattataagaatccaatctgcaggaaaataaaatattgattctttaacttaatagtaatacttttgttcactgttatactacttaagtaagataataattagataaaaatatttagtatttcttatttttcaaaaaaaaactatttgagtataaagtccatcttttagtctatttttatgttatttcgtactgtagaattcctttgtttgtgagatcatctttcttcgacgagggaaatgagaagaattaaaaatggattgctaattatgcctagatctcgtataaatggaaattttattgataagaccttctcaattgtggccaatatcttattacaaataattccgacaacttcaggagaaaaggaggcatttacctattacagagatggtgcgatttgattctttttgttttagccctgagtcttacgataaagaaacatgattcaagatagaaagataaaattattaaaataaaactacgcttgatgaaggtgaagtttggagatggaacaattccttctgtcgtgtatcctcgattgatgcagcctcagatgcttacattgttgattttagtattgagcgaaaggttaacctatgggttctgtattatgagtcactcttacttactaccgataggcagcataggggaagaagcactacacctaggaatcaacaagattaaaactttgttataaactaccccttttccttattggtattgggactaataagaatggttaggacaataaacatccatctcgtttgtattttggatacccgtataaccatcgaagatcgttgaagtgactaattcctgaaaataagggacgttgaggacaaagaaattgtttgagttatcatttttatccgacactgctacgattagtgttaagaaaaaaaaagctcttgcaggaaggctggctagaaatttcttgtaaaaatactagcccctgtcagttcataatgagaagaattaaatttaacttccatggattattcactttagaatactatgcacagaagggaggagccgtatgagatgcaaatggttctggaacggagattctttgaatagaataaacgaccgtaacggatgtcggctcaatccgaaggaaattatgcggaagctttacagaattattatgaagctatgcgactagaaagcgatccctacgatcgaagttatatactctataacataggacttatacacacaagcaacggagaacatacgaaagctttggaatattattttcgggcactagaacgaaatccgttcttaccacaagcttttaataatatggccgtgatctgtcattacgtgcgactatctccactatagaaataaggaaaaaagataaaatgaactagtaaatactagaaagaaagggctttctacatatgcatcgtccaaaacaacgatttttagaagctgtagcaaggaaaaatacttcgcgggaaccaaaacctgaaaaaaaaagggtatggcctatatatttatattctatggataaaggatacaattgataaagaaagcaccgtaaagattaattaactttggatcgatacaataagaactgcttgcttatctcatgatatgagagttaggaatctacttatgtaatagagttgatccactaaagtattgagcagcggtgtagcatcaaatcccaaagatagtaagttttctttcttatgtaagaaagtctttttcaaaaattctatatgaattacatctatgaaaccgagatagttacctttcataaactgataataataattatatagggggatacctatattttattcttctgaaatgaaggtgggagaaaagataaaactgatttattatttattgattaaaattagagtttaaaacttatgtaattaacttcttctggttaatccaagaaaataagaaatggatttcggaaaaaaagattcagttaaataaataaagtggattaagatgggtcgccaaaagaattaattgggagccgtatgagataggaaactctcaagtacggttctaaggaaggaatttacttacctattccgaccggggagaacaggccattcgacagggggattctgaaatttgcagaggcttggttcgatcaagctgctga

SEQ ID NO: 963 - DNA, 575 bp, Lotus japonicus
tctttatgtcacgttaccgagggcctcgtttcaaaaagatacgccgtctgggggctttaccgggactaaccagtaaaaggcctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatctaaaactctgattcaaaattctcttgaatcagccccccgcgaggaattgccaacccatttgactcttcagccattccaatataaaggattagtaaatcaaataatagatagtaaatgggttggttgaaaataatgaatg

SEQ ID NO: 964 - DNA, 659 bp, Nuphar advena
ctttttagcattagcacttcagtgggtttagctttgtttatcgtttagttcagtcttaaggtttatcctattatgtaaaataaggagtctttatgtctcgttaccgaggacctcgttttaaaaaaatacgccgtctgggggctttgccgggactaactagtaaaaaacctagatctgcaagtgatcttagaaaccaatcccgctctgggaaaagatctcaatatcgtattcgtttagaagaaaaacagaaattgcgttttcattatggtctgacggagcgacaactacttcgatatgttcgtatcgctggaaaagcaaacggttcaacaggccaggttttactgcaactacttgagatgcgtttggataacatcctttttcgattgggtatggcttcaactattcctggagccaggcaattagttaaccatggacatattttagttaatggtcgtctagtagatataccaagttatcgctgcaaaccccgagatattatcactacgaaggataaacaaagatccagagctttgattcaaaatcatatggattcatcctccaacgcggaattgccaaaacatttgactctgcactcattgcaatataaaggggtagtaaatcaaataatagatagtaaatgggtcggtttgaaaatcaat

SEQ ID NO: 965 - DNA, 586 bp, Lotus japonicus
gattcgatggggctttacgcgggactaaccagtaaaaggctacagtcggaagcgaacttagaaatcaatcgcgctccactaaaaaatctcaatatcgtattcgtttagaagaaaaacaaaaattgcgctttcattacggtcttacggaacgacaattgcttaaatacgttcgtatcgctggaaaagcaaaagggtcaactggtcaggttttactacaattacttgaaatgcgtttggataacatactttttcgattaggtatggcttcaactattcctcaagccagacaattagttaaccatagacatgttttcgttaatggtcatatagtagatataccaagttatcgttgcaaaccacaagatattattacagcgaaggataacaaaaaatctaaaactctgattcaaaattctcttgaatcagccccccgcgaggaattgccaacccatttgactcttcagccattccaatataaaggattagtaaatcaaataatagatagtaaatgggttggtttgaaaattaatgaattgctagttgtagaatattattctcgtcagacttaaaccgaattaaaataaca

SEQ ID NO: 966 - DNA, 542 bp, Solanum phureja
aaaccaatcgtgttctgaaaccaatcgcgttccgttaaaaaatctcaatatcgtattcgtctagaagaaaaacaaaaattgcgttttcattatggtcttacagaacgacaattacttaaatacgttcgtatcgccagaaaagccaaggggtcaacaggtcaagttttactacaattacttgtaatgcgtttggattacatcatttttcgattgggtatggcttccactattcccgcagcccgtcaattagttaaccatcgacatattttagttaatggtcatatagtagatatactgagttatcgctgcaaaccccgatatattattaccgcaaaggatgaacaaaaatccagagctctgattcaaatttctctcgattcatcccctcatgaggaattaccaaatcatttgacccttcagccattccaatataaaggattagtcaatcaaataatagatagtaaatgggtcggtttgaaaataaatgaattgctagtcgtagaatattattctcgtcagacttaaacctcagactaaaacca

SEQ ID NO: 967 - DNA, 643 bp, Brassica oleracea
ggagtggattttacgttatttatcattatcatttagttcagttttaattttttttagtttttgtccaatttcaataaaaaaaggagtctttatgtcacgttaccgagggcctcgttttaaaaaaatacgacgtctgggggctttaccgggactaactagtaaaaggcctagggcaggaagcgatcttagaaaccaatcacgctccggaaaaaaatctcaatatcgtattcgtttagaagaaaaacaaaaattgcgttttcattatggtcttacagaacgccaattacttaaatatgttcgtatcgccggaaaagccaaggggtcaacgggtcaagttttattacaattacttgaaatgcgtttggataacatcctttttcggttgggtatggctttgactattcctcaagcgcgccaattaggttaaccatgggcatatttttagttaatggtcgtatagttgatataccaagttatcgatgcaaaccccgagatattattacagtgaaggatgaacaaaactctagaactttggttcaaaatcttcttgagtcatctgcccccgaggaattgccaaaccatctgactcttcacacattccaatatgaagggttagtcaatcaaataatagataggaaatgcg

SEQ ID NO: 968 - DNA, 1307 bp, Saccharum officinarum
agttgaaccaacagagagggagagagaaagatagaggagagagagagagaggagggagggagaaggcgagagaagatgcgctgcgccgccgccgcgcttgcgttcgccctcatcgccgccgttgccggcgcaaccgccgcggggtcgccggccgcgggcacgtgcgcgcggaggggcgcgccgccgttcctcgacgccgtcggatcccgctgccccttcgtccggatcgagccgtccccgcctctcgaggtgagaggagaggctgttgatactgagttgaaccttcgaaggaggggtgcttcatactccattctcttttatgctgcatggtgtccattttcgagcaaattccgaccaacatttgaagctctcagcacgatgtaccctcagatacatcactttgctgttgaagaatcttctgctacaccaagtttgttttcaagatatggagtccgtggttttccagccattctttttgtaaatgagactacgatggttcgatatcggggttcaaaagatcttaactctctggtcgatttctataaagagactacaggtctcgatccaattgcatatattgatgttgtccagcaagagagcacaggaagcttgagctcagttatgccatgggatcattctctgcgtgaaatggccaaagatgagctgtatttgttagttgctgttctttttatcatcctgaaggttgcagcgaacttcatacctgttgtcatgtctcatctgagagctttcttagttgtccgtgtccaaaacttgaacctagggatccgtaggggatcaaaccagctcttggaacgagccttgaatgttcttgatatgaggaggctttggagcaagctgagactgagcaacaaggctacggacttgaggaagggagctagtaatgctcgagcttgggcttcctcatttgcttctgtttcactgggtgaaccgtcatcttcgagacaagcttagccattttggagatgtttgttagggtagctgctcccatggtgcaaaactatttaatctttgcttcccatcctgctatgtagcactgtttctgtgcagtcaggaagtggggaaaccttacagcatgtaaattttgaggacatcatgtgctgttgtatattaggaatacctctgcattagctgatgcaacgcctaatcttcctgtccattaactagagttatttggccatgtatcatgaacatctttgtaggttttgtagaatttctctctgttgtttgtggtgctgtattggtagtttacactgtaatctccattaaagaacctggtttcactttgt

SEQ ID NO: 969 - DNA, 1401 bp, Zea mays
ccactacccgcgcccgcacccaaaataacctagcggatttttttggtttcgtcaaatccggtctccacacaccgacacgcggagaaaattccgaagcggaagaagttccgacagcgagagagagagaggggacgggaggggaggggaggggaggggagagaacgcgagaaactatgatgcgctgcgccgccgccgcgcttgcggtcgccctcatcgctgccgttgccgccgcaaccgctgcggggtcgccggccgcgggcacgtgcgcgcggaggggcgcgccgccgttcctcgacgccgtcggatcccgctgccccttcgtccggatcgacccgtccccgcctctcgaggtgagaggagagactgttgatactgagttgaaccttcgaaggaggggtgcttcatactccattctcttttatgctgcatggtgtccattttctagcaaactgcgaccaatatttggaactctcagcactatgtaccctcagatacatcactttactgttgaagaatcttctgctacaccaagcctgttttcaagatatggagtccgtggtttcccagccattcttcttgtaaatgagactacgatggttcgatatcggggttcaaaagatcttaactctctggtcgatttctataaagaaactacaggtctcgatccaattgcatatattgatgttgttgaacaagagagcacaggaagcttgagctcagttatgccatgggatcgttctattcgtgaaatggccaaagatgagatgtatttgttagttgcagttctttttattatcgtgaaggttgtagcacacttcatacctgttgtcatgtctcatctgagagctttcttagttgttcgtgtccaaaacttgaacctagggatccgtaggggatcaaaccagctcctggaacgagccttgaatgttcttgatgtaaggaggctttggagcaagctgaggctgagcaataaggcaacagacttgaggaagggagcaaataatgctcgagcttgggcttcctcatttccttctgtttcactgggtgaaccgtcatcttcaagacaagcttagccatcttagagatgtttgttagggtagctgctcacatgtttctgtgcaaaaccatttaatctttgctccccactgtttctgtgcagtcaggaaggggggaaaaccttgcatgcatgtaaattttgaggaaatcatgtgctgttgtatattaggaatacctttgcatttgctggtgcgacgcctaatcttcctgtctattaaccagagtgtttatttggcaatgtatcatgaacttgtaggggtttttttttagaatttctctcttgtttgtggtgctgttgtactttacactgtactcttcattaaagaacttggtttcacttcgtta

SEQ ID NO: 970 - DNA, 1275 bp, Zea mays
tgccaaatccagcctccgcacgcggagaaaattccgaagcggaagaagttgaaccgacaggtgagagagaaagagataggagagacgaggccacgactccacgggggaggcagggagagaaggtgagagaagatgcgttgcgccgccgccgcgcttgcggtcgccctcatcgctgtcgttgccggcgcaaccgcgccggggtcgccggccgcgggcacgtgcgcgcggaggggtgcgctaccgttcctcgacgccgtcggatcccgctgccccttcgtccggatcgagccgtccccgcctctcgaggtgagaggagaggctgtggatactgagttgaaccttcgaaggaggggtgcttcatactccattctcttctatgctgcatggtgtcctttttcgagcaaatttcgaccgatatttgaaactgtcagcactatgtaccctcaggtacatcactttgctgttgaagaatcttctgcgacaccaagtttgttttcaagatatggagttcgtggtttcccagccattcttcttgtaaatgagactacaatggttcgatatcggggttcaaaagatcttaactctctcgtcgatttctataaagaaactacaggtctggatccagttgcatacattgatgttgttgtccagcaagagagcacagcaagcttgagctcagttgcaccatgggatcgttctccgcttgagatggccaaagacgagccgccgtatctgttggtcgcagttctcttcatcatcctgaaggccgcagcgcgcttggtacctgctgccatgtctcatctgagggccttcttggccgtccgtgtccagaacctgaacctagggatccgcaggggatcaagccaggtcttggaacgagccttgaacgcccttgacgtgaggaggctgtgcagcaagctggggctgagcaacagggcaacagatctgaggaagggtgcaagcaatgctcgagcctgggcttcctcgtttgcttccgtctcactgggtgaaccttcatcttcgagacaagcttagccatttttttttgttttttttttggagatgtcgcttgttagggtagctagctgctcacatgatgcaaagaccatataaggtttgcttcccatcctgtttgtttctgtgcagtcaggaggagaggggaaatcttacatgcctgtaaattttgacgacatcatgtgctgttgtatattaggaatacctttgcatttcctgtttcggttttagaagtgcggtctcaaatgagctgaagcagaa

SEQ ID NO: 971 - DNA, 1523 bp, Pennisetum glaucum
atctagcctccacacgcggagaaatttcggaagcggaagaatcgaaaggggagagagaccgagagagagacgcagagaggagggaggaggagggaggagctatgatgcgctgcgccgccgccgccgccgttgcggtggccgtcgccctcgccgccgttgccggctccgccgttgccgcggagtcgcgggggccggcgggcacatgcgcgcggagggacgcgccgccgttcctcgacgccgtcggatcgcgctgccccttcgtccggatcgagccgtccccgcctctcgaggtgagtggagaggctgttgatacagagttgaaccttcggcgtaggggtgcttcatactccattctcttttatgctgcatggtgtccattttcgagcaaattcctaccaatatttgaagctctcagcactatgtaccctcagatacagcactttgctgttgaagaatcttctgctacgcctagtttgttttcaagatatggagttcgtggcttcccagccattcttcttgtaaatgagactacgatggttcgatatcggggttcgaaagatctcatctctctggttgatttctataaagaaactacaggtcttgatccaattgcacatcttgatgtcgtgcaacaagagagttctggaaacttgagatccatcatgccatgggatcgatctcttcgtgaaatggcaaaagatgagccctttttgttgcttgcagctctttttatcatcatgaaggttgtggcatacttcatacctgttgtcctgtctcatctgagagccttcttagttgtgcgtgtccgaaacttgaacttggggatccgtaggggatcaaaccagctcttggatcgagtattgaatgttcttgatgtgaggaggctttggagcaagcttagactgagcaacaaggcaacggacctaaggaaaggagcaagtaacgctcgagcttgggcttcctcatttacttctgtttcactgggtgaaccatcgtcttcaagacaagcttaggcttttaggggggttgttgtttgttagggtagccgctcacgtggtccaaaaccattactctttgtttccaaccctgctatgtaccatggttctctgttctgtgcagtcaggaagttgggaaaccttacagacatgtaaattttgaggacatcatgtgctgttgtatattaggaggaataccttggtgatgcaatgcctaatctttctgttcattaacttaagtaaatgggtcatatggacatctttgtaggttttctcttgggatttatttctgtgtgtgatgttgtattggtaatatactctgtagtctccaaagacttggtttcactttgttattattttttaagataacatgaagagcttgaagcttggaccattggagtcatgctctgatccttgggacccagttgctctcttgattgtatggtcactatattgtttaaaattaacaaaatcagatcatgtgaaaaaaaaaaaaaaaacaaaaaaaaaaagtaaaaaactactgcg

SEQ ID NO: 972 - DNA, 1322 bp, Setaria italica
gggcagggggcggcgggcacatgcgcgcggagggacgcgccgccgttcctcgatgccgtcggatcgcgctgccccttcgtccggatcgagccgtccccgcctctcgaggtgagtggagaggctgttgatacagagttgaaccttcggcgtaggggtgcttcatactccattctcttttatgctgcatggtgtccattttcgagcaaattccgaccaatatttgaagctctcagcactatgtaccctcagatacatcactttgctgttgaagaatcttctgctacacctagtttgttttcaagatatggtgttcgcggcttcccagccgttcttcttgtaaatgagactacgatggttcgatatcggggttcaaaagatctcagctctctggttaatttctataaagaaactacaggtcttgatccaattgcacatcttgatgtcgtgcagcaagagagtacaggaagcttgagatccatcatgccatgggatcgatctcttcgtgaaatggcaaaacatgagccctttttgttgcttgcagctctttttatcatcatgaaggttgtgtcgtacttcatacctgttgtcctgtctcatctgagagccttcttagttgtgcgtgtccgaaacttgaacttggggatccgtaggggatcaaaccagctcttggatcgagcattgaatgtacttgatgtgaggaggctttggagcaagcttagactgagcaataaggcaacggacctaaggaaaggagcaagtaacgctcgagcttgggcttcctcatttacttccgtttcactgggtgaaccgtcatcttcaagacaagcttaggcttttaggggggtgttgtttgttaggctagctgctcacatggtccgaaaccatttactctttgtttccaatcctgctatgtaccatggttctctgttccgtgcagtcaggatgttgggaaaccttacaggcatgtaaattttgaggacgtcatgtgctgttgtatattaggaggaatacatttgcatttgctgatgcaatgcctaatctctctgttcattaactacagtaaatgggtcatgtatgatgaacatcttattaggttttcttttaggatttatttctgtttgtgatgttgtattggtaatttactctgcactctccattaaagaacttggtttcactttgttattctgttttaagctagcatgaagagcttgaagcttggactattgagtcatgctctgatctgtgggactcagttgctctcttgagttgtaatggtcactatattgtttggaagaaacaagatcagatcacgtggaatctga

SEQ ID NO: 973 - DNA, 770 bp, Panicum virgatum
gtccctcccgtcgacccgacgccgcgccgcacccctcttctgcgccctttcctctccgttggcggcgaagaggttttctccaaaccggcgaggggagaggaactagccagtgaattcggttcctccaaccgaacgagaagatgccgcggatccctttgatcaagttccccaagcggaatctcaaagccccatccccatccgtaccagcagcatcgcagcccgcggatcagcacgcgaccctcatgtcccgcttgggggctaaagcagaggcaccatcttctggagagattaaaaattaccgttttagatctgatgtgccatccccaccttctcatactgctgttggaggtccagcttcactccttcctaagcgcaaacccctgactgaagaagagattgaggctatcatgcttggtggctccatctgatatggccttacatggattggaaacgtaggaggtatcaataagatcatgtacccaaacttgccttgactgtaaggggtgttattaatgccatgttgatatggaatttgttttttttttgtttctctgtctgggagtcagctgctgctgtcatccgtttctaatattctctggtcttcacatgtgacttgaccaaatcgtgagcagtcatgttgatacggagtccggtttttgtttctctgcctggaagccagctgttgcgatatcaggtcctaatattcttcacatgtgactgaccgaatcgtgggcgtattgaagttgctagccgaaaatgtgttgaccctg

SEQ ID NO: 974 - DNA, 1006 bp, Setaria italica
ggggatttggtgggtggtgctggtggccaaggagagccattgaaagggattgggtgactagatgaagtgtcagctgatgtggacgccagcggggatcaaaaccgtcctggtgggcactcgggggggttcaggtacctgggttgcatagtttgggggcgtcggttagatgggtttgtagtgtggggttgaattctagactcgtagaagagatgaggggttccaaagaaattttccatctagccgcctcccagatgcgaaagcggctttcggtccaaaaaacaatcgagctctccagcctcgagcctgacccctcctctgtcctctcccagcatcgacccgacgcctcgccgcacccgcaccccctcttcctctccgtcggcgacgaagcgatttctccaatccggtgaggggagaggaagtcagtgaattcggtcgctccagccggacgaggagatgccgcggattcctctgatcaagttccccaagcggaatctcaaagccccatccccatccgcaccagcagcgtcgcagcccgcagatcagcacgcgaccctcatgtcccgcttgggggctaaagtagaggcaccaccttctggagagattaaaaattaccgttttagatcagatgtgccatccccaccttctcatactgctgttggaggtccagcttcactccttccgaagcgtaaacccctgactgaagaagagattgaggctatcatgctaggcggctccatctgatatggcctcacatggattggaaatttaggagctatcaataatatcatatacccgaactgaactcgactctaaggggtgttattcaagccatgtccatatggaattcgtttttttgtttcaactgtccctaagtcagctgctgtgacattctgctctaatattcttcacatgtgactgaccaaatcgtgggcatattgaagttggttgtggaaaaagtgttgaccctgaatgattttgcgcatctctaatgagtttgcgccatcat

SEQ ID NO: 975 - DNA, 679 bp, Pennisetum glaucum
tccaccgtgagtccgtgacaccgtgctctcccagcatcgacccgacgccgcgccgcacccgcatcccctcttcctctccgtcggcgacgaagcggtttctccaatccggcgaggtgagaggaagtcggtgaattcggtcgctccagccggaagaggagatgccgcggatccctctgatcaagttccccaagcggaatctcaaagtcccatccccatccgcaccagcagcgtcgcagcccgcagatcagcacgcgaccctcatgtcccgcttgggggcgaaagtagaggcaccaccttctggagaaattaaaaattaccgttttaaatcagatgtgccatccccaccttctcatactgctgttggaggtccagcttcactccttcctaagcggaaacccctgactgaagaagagattgaggctatcatgctgggtggcaccatctgaaatggcctcgcctggattggaaatttagtagctatcaataattaatcatatacccgaactgaacttggtataagggttgttattcaagccatgtccatatggaattcgttttttttttgtttcaactgtcacgaagtcagcttgtgttctaatatcattcacatgtgactgaacaaatcgtgggcatatcgaagttggttgtggaaaaagtattgacccccttattttgcgca

SEQ ID NO: 976 - DNA, 809 bp, Pennisetum glaucum
taaacagctagtaccacctggctaccacatcattggtccaagttaattcatgtggccttctccaccttgggaagtacttccccctcaatctactcttcttcaggatagtcttctattgattttcccagcagaatcagtaagcctgaccctccaccgtgagtccgtgacaccgtgctctcccagcatcgacccgacgccgcgccgcacccgcatcccctcttcctctccgtcggcgacgaagcggtttctccaatccggcgaggtgagaggaagtcggtgaattcggtcgctccagccggaagaggagatgccgcggatccctctgatcaagttccccaagcggaatctcaaagtcccatccccatccgcaccagcagcgtcgcagcccgcagatcagcacgcgaccctcatgtcccgcttgggggcgaaagtagaggcaccaccttctggagaaattaaaaattaccgttttaaatcagatgtgccatccccaccttctcatactgctgttggaggtccagcttcactccttcctaagcggaaacccctgactgaagaagagattgaggctatcatgctgggtggcaccatctgaaatggcctcgcctggattggaaatttagtagctatcaataattaatcatatacccgaactgaacttggtataagggttgttattcaagccatgtccatatggaattcgttttttttgtttcaactgtcacgaagtcagcttgtgttctaatatcattcacatgtgactgaacaaatcgtgggcatatcgaagttggttgtggaaaaagtattga

SEQ ID NO: 977 - DNA, 798 bp, Sorghum bicolor
ggtccaagaaaacaatcgaaatctcgagtccaccgtggagcgagcctcaggccctagtctcctctcctcaatccgacgcggcgccgcggccccctattttttagcctttcctctccgtcggcgacgcatacatccggcgagcggtccaatccggacgaggagatgccgcggatccctctgatcaagttccccaagcggaatctgaaagccccatcggcgccagcgccgtcgcaacccgcagatcagcacgcgaccctcatgtcccggttgggggctaaagcagaggcaccatcttctggagggattaaaaattaccgctttaggtcagatgtaccttccccaccttctcatactgccgtaggaggtccagcttcactccttcctaagcgtaaacccctgactgaagaagaaattgaggctattatgttgggaggctccatctgatatcacctcatatggattggaaattctaggaacatcaataagatcgtatacctgaacttatttcctttgacctctgaaagagtgttactgaagccatgttgatatggaattgggtgttttttttaattgtctggaagtcagctgttgagacattcgtttccagtattctgcacatgtaactggccaaatcgtgaacacattcagttccttgcagaagaagtgttgatcatggaatggttttgcatatctgattattttgtcgtgcatgttttgaattcttgccccaccataggatctgatgatcatgctttttgaagcatgccttccttgtgcatgttgtgagtacttgatctg

SEQ ID NO: 978 - DNA, 637 bp, Saccharum officinarum
ctgaggcccgagtcccctctcctcgacccgacgcggcgccgcggccccctgatttttagcctttcctctccgtcggcgacgcatacatccggcgagcgcaccaatccgtacgaggagatgccgcggatccctctgatcaagttccccaagcggaatctgaaagtcccatccgcgccagcgccgtcgcaacccgcagatcagcacgcgaccctcatgtcccggttgggggctaaagcagaggcaccatcttctggagggattaaaaattaccgctttagatcagatgtgccttccccaccttctcatactgccgtaggaggtccagcttcactccttcctaagcgtaaacccctgactgaagaagagatcgaggctattatgctggggggctccatctgataccacctcatatgaattggaaattctaggaacatcaataagatcatatacccgaacttattgcctttgacctctgaaagagtgttatttaagccatgttgatatggaattgttttttttattctgtttggaagtcagctgttgagacattcatttccaggattctgcacatgtaactgaccaaatcgtgaacacattcagttccttgcggaagaagtgttgatcatggaatggttct

SEQ ID NO: 979 - DNA, 1031 bp, Cenchrus ciliaris
  misc_feature (12)..(12): n is a, c, g, or t
  misc_feature (210)..(210): n is a, c, g, or t
  misc_feature (212)..(212): n is a, c, g, or t
  misc_feature (217)..(217): n is a, c, g, or t
  misc_feature (221)..(221): n is a, c, g, or t
  misc_feature (223)..(223): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (401)..(401): n is a, c, g, or t
  misc_feature (429)..(429): n is a, c, g, or t
  misc_feature (460)..(460): n is a, c, g, or t
tgaggggaaaanaatttttccacagggaaaaaacttatttccattatttccgcgaaagttagaaattaacccctcttaaaaggggaaaaaaagtgggaggctcccccgggggggggggccgttttaaaataaagggttccccccggggtggaggcaaagcttcaaaacaagcctggaccccttctttttccaaaattttacccggagagngngccgnaccngnatcccntnttnctctccgtcggcgacgaagcgggttctccatccggcgagccggcgaggggagaagaagtcagtgaaatcggtcgctccagccggaagaagagatgccgcggattcctctgatcaagttccccaagcggaacctcaaagtcccatccccatccgcaccagcagcgtcncagcccgcagatcagcacgcgaccctcntgtcccgcttgggggctaaaatagaggcacngccttctggagagattaaaaattaccgttttaaatcagatgtgccatccccaccttctcatactgctgttggaggtccagcttcactccttcctaagcgcaaacccctgactgaagaagagattgaggctatcatgctaggtggcaccatctgaaatggcctcgcatggattggaaatttaggagctatcaataattatattatacccgaactgaacttgctctgagggttgttattcaagccatgtccatacgggattctttttttttgtttcaactgtcacgaagtcagctgctgttggttgtgactgacgaaatggtaggcatatcaaagttggttgtgcgcatccctaatgagtttgcgccaccataagatctgatgagcatgcttattgaatcagacctttgtatacatgttgtgaatacttagcgacgaggccataagatccgtgtgcttttggcttagtcgtggtgccattgctgcagctttcgattccgtaggtcaatatctcatttagtggcagagggaatttgagttaaggtcacacatgcgtacaattctattacagtgc

SEQ ID NO: 980 - DNA, 770 bp, Zea mays
aaatcgagtcgagcaagttatcgaggaaccagtatttcgtccggtcgtccagccctatctgcagtccaccgtcgggcgagcccgagaatcccgtctcctcggcgccgcggcccccggtttttttatgctttcctttcggtcggcgacgcatacattcggcgagggagaggaagaagtcagtaaagtaaattctgttgctccaattcggacgaggagatgccgcggatccctctgatcaggttccccaagcggaatctcaaagccccatctccatccgcgccagcggcgtcgcaacccgcagaccagcacgcgaccctcatgttccggttaggggctaaagcagaggcaccatcttctggagagattaaaaattaccgctttagatctgatgtgccttgcccaccttctcatactgccgtaggaggtccagcttcactccttcctaagcgcaaacccctgactgaagaagagattgaggctattatgctggggggctccatctgatatcacctcatatgaattggaaattctaggaacatcaataagattgtatgcctgagcttattgcctttgacctctgaaagagtgttattgaagccatgtcgatatggaagtgtttttttttttaattcagtctggaagttggctgttgagacatccatttccagtactccgcacatgtaactgagcaaaccgtgaacacatttagttccttgcagaagtgttgagcatggaatggttttgcttttgcataccaggttaaaaaaaaa

SEQ ID NO: 981 - DNA, 818 bp, Zea mays
agaatctcacaagaaatccaaatattcagactccagtctagcattgagcgacgagcccgagtatcgtctttagactcctcattcctcaacccgacgcggcggtgtgcccccctgctttttttggcctctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagcttcactccttcctaagcgtaaacctctgactgaagaagagattgaggctattatgctgggtggctccatctgatatcacctcatatgaattggaatttctaggaacatcaataagatcgcatacccggacttattgccttcgacctctattattgaagtcatgttgatacagaattgggtttttttccaattctctgcaagtcagttgtggagacattaatttccagtattctgcacatgtaactgaccaaatcgtgaacacattgagttccttgcggaagaagtgttgatcatggaatgtttttgcatctgattattttgtattgatgtcttgaattcttgccacacctgaaagatctgatgatcatgtccttttggaggcatcgcctttatttttaga

SEQ ID NO: 982 - DNA, 690 bp, Triticum aestivum
acgaaccggagaggaacatcaggttttagcatcgcgatttccctagaagcgttgcgcggagaaatctcgtcggattgttccccggattccagcgcaaagatgccgcgcattcccatgatcagattccccaagaggcatctcaaagtcccatccccaccagcggcgcagcctgcagatcagcacgcgaccctcatgtcccgattgggagctaaagtagaggcaccatcttctggagagaaaaagaattaccggttcagatcagatgtgccttccgcaccttctcataatgctgttggagggccagcttcacagcttcccaagcgcaaaccactctctgaggaagagattgaagctatcatgcaaggtggtgtcttctgatatcgcttcccgccagcggcacctttttgtggagcaccaataagccctacgccgcgctgcattcctaaccgttttgcacagagccatgttgatatggaactcttctcttttggtccccagaactcaccaaccgccgcaccccgtttcctgaatattccttacatgtgacttgaccgaaagtggtgaaggctgaacatgtgatgcatgggtgggtgccctgccttgccgaaatatgtgatcatggaatgatttcgtgaacctccataagttttttttttgttggtggatgttctctctctcttttctttctca

SEQ ID NO: 983 - DNA, 778 bp, Triticum aestivum
  misc_feature (688)..(688): n is a, c, g, or t
  misc_feature (724)..(724): n is a, c, g, or t
ggagaggaacatcaggttttagcatcgcgatttccctagaagcgttgcgcggagaaatctcgtcggattgttccccgaattccagcgcaaagatgccgcgcattcccatgatcagattccccaagaggcatctcaaagtcccatccccaccagcggcgcagcctgcagatcagcacgcgaccctcatgtcccgattgggagctaaagtagaggcaccatcttctggagagaaaaagaattaccggttcagatcagatgtgccttccgcaccttctcataatgctgttggagggccagcttcacagcttcccaagcgcaaaccactctctgaggaagagattgaagctatcatgcaaggtggtgtcttctgatatcgcttcccgccagcggcacctttttgtggagcaccaataagccctacgccgcgctgcattcgtaaccgttttgcacagagccatgttgatatggaactcttctcttttggtccccagaactcaccaaccgccgcaccccgtttcctgaatattccttacatgtgacttgaccgaaagtggtgaaggctgaacatgtgatgcatgggtgggtgccctgccttgccgaaatatgtgatcatggaatgatttcgtgaacctccataagttttttttttgttggtggatgttctctctctcttttctttctcatgcgnggttcgagtcgttcttgatggcgtaggttacattgngctgtgattttggttgtctttccaactgctttggtcgttggagcaaaaaaaaaa

SEQ ID NO: 984 - DNA, 952 bp, Cynodon dactylon
ggccggggggcccgaagcgtcttttgctccagaaaaccaaatcggaaccttccggtctcggagttgttccagcctctttacccgaaccggcgccgcggctcgccgcttgagcccttcctctcgtcgccggaaaaaattctcctcacggaagctaggaaattcggtttccttcgatcctgacgagatgccgcgtatccccatgatcaagttccccaagcggaacctcaaagtaccgtcaccatcgccatcgacgccagcagcgtcccagcccgcagatcagcacgcgacccttatgtccagattgggggctaaagtagaggcaccacctgctggagaggtgaaaaattaccgctttagatctgatgtgccctccccaccttctcatactgctgttggcggaccagcttcactccttcctaagcgcaagcccctaactgaggaagagattgaggctattatgctgggtggttcgatctgatattgcttcacaaggatttgaaagtttgagcatcaataagatcatgtacctgaatctcgtagcacctttgaagggcgttattagagccatgtcgatatggaactcggttatttcagtcgtttctggtgtcaggaagtcagcagctttcactcatttcaaatattcttcacatgtgactgaccatagatcaccactgaacacgcatttcttgtgagaaaatgctaatcaatcgccgtaccttttctcttgtacccttggaactgtcaccactctataagatctgtatgctttgaggcattcctttctcgtgcttgttttgagtcctttgctatgagggcataccatcggtgtgcattccgtagtttggcgtggacattgacccattgctagactttttctgcttctgatgaaaatgttaatgtcactgtcgttacggtcgatttggttgttggttccgctctctgttctcgtttg

SEQ ID NO: 985 - DNA, 493 bp, Zea mays
gcttccagcttttgaccatcagaatctcacaagaaatccaaatattcagactccagtctagcattgagcgacgagcccgagtatcgtctttagactcctcattcctcaacccgacgcggcggtgtgcccccctgctttttttggcctctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagcttcactccttcctaagcgtaaacctctgactgaagaagagattgaggctattatg

SEQ ID NO: 986 - DNA, 508 bp, Zea mays
gcttccagcttttgaccatcagaatctcacaagaaatccaaatattcagactccagtctagcattgagcgacgagcccgagtatcgtctttagactcctcattcctcaacccgacgcggcggtgtgcccccctgctttttttggcctctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagcttcactccttcctaagcgtaaacctctgactgaagaagagattgaggctattatggtatgccttttgttc

SEQ ID NO: 987 - DNA, 981 bp, Triticum aestivum
tcgcctcccaccgcaagaaaagcgaccggaagggaaaagacgaaccggagaggaacatcaggttttagcatcgcgattttcccagaagcgtttcgcggagaaatttcgtcagattgttccccggattccagcgcaaagatgccgcgcattcccatgatcagattccccaagaggcatctcaaagtcccatccccagcagcggcgcagcctgcagatcagcacgcgaccctcatgtcccgattgggagctaaagtagaggcaccatcttctggagagaaaaagaattaccgctttagatcagatgtgccttccgcaccttctcataatgctgttggagggccagcttcacagcttcccaagcgcaaaccactatctgaggaagagattgaagctatcatgcaaggcggtgtcttctgatattgcttccagccagtggcaccttttgtggagcaccaataagccctacgccgcgccgcattcgtagccgttttgcacagagccatgttgatatggaactcttctgttttggtccccagaactcaccaaccgccacaccccgtttcctgaatatcccctgcatacatgtgactaaccaaaaatggtgaacactggacatgtgatgtatgggcgggtgccctgccttgccaaaatatgtgatcatggaatgatttcatgaacctccataagtttttttttttggtattagtgagtgttctctcttttttctcatgtgtggtttgactcgttgtactttatcccgtaggttacattctgctgttattttgtttgtcttttcccctgttttggtcgttggagctttcgctgtcccactgccgtgcgggtatcttattcttatccagcggctgctgcactaaactctggtctttgcacgcatttgcccccttctcaggacagggttcttccacacaacgtgcgtagagtttcccaaatgacgctttagtacaaaaagtgcctgggcta

SEQ ID NO: 988 - DNA, 764 bp, Triticum aestivum
gaaaagacgaaccggagaggaacatcaggttttagcatcgcgattttcccagaagcgtttcgcggagaaatttcgtcagattgttccccggattccagcgcaaagatgccgcgcattcccatgatcagattccccaagaggcatctcaaagtcccatccccagcagcggcgcagcctgcagatcagcacgcgaccctcatgtcccgattgggagctaaagtagaggcaccatcttctggagagaaaaagaattaccgctttagatcagatgtgccttccgcaccttctcataatgctgttggagggccagcttcacagcttcccaagcgcaaaccactatctgaggaagagattgaagctatcatgcaaggcggtgtcttctgatattgcttccagccagtggcaccttttgtggagcaccaataagccctacgccgcgccgcattcgtagccgttttgcacagagccatgttgatatggaactcttctgttttggtccccagaactcaccaaccgccacaccccgtttcctgaatatcccctgcatacatgtgactaaccaaaaatggtgaacactggacatgtgatgtatgggcgggtgccctgccttgccaaaatatgtgatcatggaatgatttcatgaacctccataagttttttttttttggtattagtgagtgttctctcttttttctcatgtgtggtttgactcgttgtactttatcccgtaggttacattctgctgttattttgtttgtcttttc

SEQ ID NO: 989 - DNA, 758 bp, Triticum aestivum
tcgcctcccaccgcaagaaaagcgaccggaagggaaaagaacgaaccggagaggaacatcaggttttagcatcgcgatttccctagaagcgtctcgcggagaaattttgttggatttgttccccggattccagcgcaaagatgccgcgcattcccatgatcagattccccaagaggcatctcaaagtcccatccccagcagcggcgcagcctgcagaccagcacgcgaccctcatgtcccgattgggagctaaagtagaggcaccatcttctggagagaaaaagaattaccgctttagatcagatgtgccttccgcaccttctcataatgctgttggagggccagcttcacagcttcccaagcgcaaaccactatctgaggaagagattgaagctatcatgcaaggcggtgtcttctgatattgcttccggccagtggcaccttttgtggagcaccaataagccctacgccgcgctgcattcgtaaccgttttgcacagagccatgtcgatatggaactcttctcttttggtccccagaactcaccaaccgccacaccccgtttcctgaatatcccctgcatacatgtgactaaccaaaaaatggtgaacgctggacatgtgatgtatgggtgggtgccctgccttgccaaaatatgtgatcatggaatgatttgatgaacctccataagctttttttttgtattattagtgggtgccttttttttctcatgcgtggtttgagtcgttcttatggcat

SEQ ID NO: 990 - DNA, 707 bp, Triticum aestivum
  misc_feature (686)..(686): n is a, c, g, or t
acgaaccggagaggaacatcaggttttagcatcgcgatttccctagaagcgtctcgcggagaaattttgttggatttgttccccggattccagcgcaaagatgccgcgcattcccatgatcagattccccaagaggcatctcaaagtcccatccccagcagcggcgcagcctgcagaccagcacgcgaccctcatgtcccgattgggagctaaagtagaggcaccatcttctggagagaaaaagaattaccgctttagatcagatgtgccttccgcaccttctcataatgctgttggagggccagcttcacagcttcccaagcgcaaaccactatctgaggaagagattgaagctatcatgcaaggcggtgtcttctgatattgcttccggccagtggcaccttttgtggagcaccaataagccctacgccgcgctgcattcgtaaccgttttgcacagagccatgtcgatatggaactcttctcttttggtccccagaactcaccaaccgccacaccccgtttcctgaatatcccctgcatacatgtgactaaccaaaaaatggtgaacgctggacatgtgatgtatgggtgggtgccctgccttgccaaaatatgtgatcatggaatgatttgatgaacctccataagctttttttttgtattattagtgggtgcttttttttntcatgcgtggtttgagtcgtt

SEQ ID NO: 991 - DNA, 1170 bp, Triticum aestivum
aacacaaaaacgaaatgccactgctgcagctgccgaccgcgtgtggcgccgctgcggcgtcggcgtcggcgccgggccccttcttgctctcacggccgccgccctcgcggctgcgcgcgtcgcacgtcctcttcgccttccctcgcctgaggaaatacggccgccggagccgcgagccggtacccaccaccctcgacgacgacgacgaggacgaggccgatgaggacgacgacgacgacgtggaggaggcggttgacgaggacatctttctcaagaaccggcccaagccggccgggttcggcgtggggaagacctacaccaccgacgtcgaagagcagcttctccgggagatgggcatcggcggcgccgggcgcaagagcaaatcggctgcgcccaagaacctcaaagccaacggctcggacacagaaaccggcgcagatcgcagtaatgatggcgttcatgttcgtatttggaacctcccgaaaaagaagaacatacataaggacctgaacctagctttcaaagggtttcctggcctggtaactataaatccagcaaactctggaactaagaagacccgtgatcctatttgtaagggctttgcatttgtcaaactggagtcagtggatgctgcaacgaggttcgttgaactgtactctcgtaaagctgtgtcgttcggtaaggttgagaagccaatcaagtgctgtattgttgaagggcacgtctcgacggatccttcaggtccagcatccagtagtcagccaccagggtcgaacccacaacggttggtagccgtaagatgagtggcacagttgatctgtcgtcgatccagttgccactcggtacttcgactgaaggagaattccgggaagaaggttcgctacacagatatcggcatgcttcgctcaagattgcgaagatacagaccgtctggtcggaattcccggttttatagatgatatcaagcattgacattggtaggaaaccctttctccaatgggtttatttagaagatgggcagggatattagactcggttccttaaggtatgcagtggtttttttagttaaatttacgtgaagggattgtgtctaaattaggcccactgtttcggagaaggatttgaatctgaatccgcagcgtcgttataaatccccagattaaagttgct

SEQ ID NO: 992 - DNA, 1163 bp, Triticum aestivum
gaattcggcacgaggctacagctgccgaccgcgtgtggcgccgctgcggcgtcgtcggcgccgggccccttctcgctctcgcggccgccgccctcgcggctgcgcgcgtcgcacgtcctcttcgccttccctcgcctgaggaaatacggccgccggaaccgcgagccggtacccaccaccctcgacgacgacgaggacgaggccgatgaggacgacgacgacgacgtggaggaggcggttgacgaggacatctttctcaagaaccggcccaagccggccgggttcggcgtggggaagacctacaccaccgacgtcgaagagcagcttctccgggagatgggcatcggcggcgccgggcgcaagagcaaatcggctgcgcccaagaacctcaaagccaacggctcggacacagaaaccggcgcagatcgcagtaatgatggcgttcatgttcgtatttggaacctcccgaaaaagaagaacatacataaggacctgaacctagctttcaaagggtttcctggcctggtaactataaatccagcaaactctggaactaagaagacccgtgatcctatttgtaagggctttgcatttgtcaaactggagtcagtggatgctgcaacgaggttcgttgaactgtactctcgtaaagctgtgtcgttcggtaaggttgagaagccaatcaagtgctgtattgttgaagggcacgtctcgacggatccttcaggtccagcatccagtagtcagccaccagggtcgaacccacaacggttggtagccgtaagatgagtggcacagttgatctgtcgtcgatccagttgccactcggtacttcgactgaaggagaattccgggaagaaggttcgctacacagatatcggcatgcttcgctcaagattgcgaagatacagaccgtctggtcggaattcccggttttatagatgatatcaagcattgacattggtaggaaaccctttctccaatgggtttatttagaagatgggcagggatattagactcggttccttaaggtatgcagtggtttttttagttaaatttacgtgaagggattgtgtctaaattaggcccactgtttcggagaaggatttgaatctgaatccgcagcgtcgttataaatccccagattaaagttgcttcaaaaa

SEQ ID NO: 993 - DNA, 1133 bp, Pseudoroegneria spicata
  misc_feature (25)..(25): n is a, c, g, or t
  misc_feature (89)..(89): n is a, c, g, or t
  misc_feature (514)..(514): n is a, c, g, or t
  misc_feature (617)..(617): n is a, c, g, or t
  misc_feature (715)..(715): n is a, c, g, or t
  misc_feature (853)..(853): n is a, c, g, or t
  misc_feature (1116)..(1118): n is a, c, g, or t
gccactgctgcagctgccgagcgcntgctgcgccgccgcggcgtcggcgtcggcgtcgggccccttgtcgttctcgcggacgccgcccncccggctgcgcgcgtcgcacatcctcttcgccttccctcgcctgaggaaatacggccgccggaaccgcgagccggtacccaccaccctcgacgacgaggaggaggaggcggatgaggatgaggacgacgacgacgacgtggaggaggcggttgacgaggacatctttctcaagaaccggcccaagccggccggtttcggcgtggggaagacctacaccaccgatgtcgaagagcagcttctccgggagatgggcatcggcggcgccgggcgcaagagcaaatcggctccgcccaagaacagcaaaaccaacggctcgtccacagaaaccggcgcaggtctcagtaatgatggcgttcatgttcgtatttggaacctcccgaaaaagaagaatatacataaggacctgaacctagctttcaaaggntttcctggcctggtaactataaacccagcaaactctggaactaagaagacccgtgatcctatttgtaagggttttgcatttatcaaactggagtcagtggacnctgcaacgaggttcgttgaactgtactctcgtaaagctgtgtcattcggcaaggttgagaagccaatcaagtgctgtattgttgaagggcacgtctcnacggatccttcagctccagcatccagtagtcagccaccagggtcgaacccccaacggttggtagccgtaagatgagtggcacagttgatcttgtcatcgatccagttgccactcggtacttcgacagatggaaatccngggaagaaggttcgctacatagacatcggcatgcttcgctcaagattgcgaagatacagactgtttggtcggaattcccgattttgtagatgatatcaagcattgacattagcaggaaaccctttctccaatgggtttatttagaagataggcagggattagactcggttccgtaaggtatgcagtggttttagttaaatttacgtgaagggattatgtctgaattcggtccactgtttcggaggggggatttgaatctaaannncgcgatgttggtata

SEQ ID NO: 994 - DNA, 711 bp, Leymus cinereus x Leymus triticoides
  misc_feature (35)..(37): n is a, c, g, or t
cgcgtcgcacatcctcttcgccttccctcgcctgnnnaaatacggccgccggaaccgcgagccggtacccaccaccttcgacgaggaggaggaggaggcggatgaggacgacgacgacgacgtggaggaggcggttgacgaggacatctttctcaaaaaccggcccaaaccggccggtttcggcgtggggaagacctacaccaccgatgttgaagagcagcttctccgggagatgggcctcggcggcgccgggcgcaagagcaaatcggctccgcccaagaacgtcaaaaccaacggctcggccacagaaaccggcgcagatctcactaaggatggcgttcatgttcgtatctggaacctcccgaaaaagaagaacatacataaggacctgaacctggctttcaaagggtttcctggcttggtaactataaacccagcaaactctggaactaagaagacccgtgatcctgtttgtaagggttttgcatttgtcaaactggagtcagtggacgctgcaacgaggttcgttgaactgtactctcgtaaagccgtgtccttcggcaaggttgagaagccaatcaagtgttgtattgttgaagggcacgtctctacgaacccttcaagtcaagcatccagtagccaggcgccagggtcaaatccccaacggttggtagccgtaagatgagtggcacagttgatctgtcatccagt

SEQ ID NO: 995 - DNA, 1387 bp, Arabidopsis lyrata
gtgctccagaatattaaagatcgggtggtgctatttaaatccaatatcagaaacacatcgaacgagacgaatagctagcttctgattaaattttcaacttttggcgtttttcgatctgttgcttctgcaaaaaaaaaaaattagtgaattttcggatcggagatttccccaaattgtaaaattaggttttgttcttcgcctcctcgttctagccctagcttagtttcatggattctcgagtttcgattctcttcgtctgtgcgatagctgtgtcatgctttacgtctgggtccgcttcatcacgggtggacttttccgtttgcaattacgaattcgaggtgtttcgattcgatttagaagccaaatgtcctccttctctgtatccaagtcctcctattgaggtagatggagactcactggacagggtaatggattcaaatcatggaaatgcttatatgtcagtactcttttatgcttcctggtgcccattctcacgtgctgtgcgccctaagttcgatatgttgagttcgatgtttcctcatatacagcacctagctgtggagcattctcaagcactgccatctgtcttttctaggtatggtatccatagcttaccttcaatcctgatggtaaatcaaactttaaaggctcggtaccatggacgaaaggatcttacatccctgattgagttttatgaagaggcaacaggtctccaacctgtccattatgtggctgaaggggaaccaacaggtttagacgccggcgatggtaacttgatcacatggttgcgcaatgggacatctatcagagaaatattcaaacaagatccgttcttggtactatctctgctgtttatctgtttacaaatggcaatccttgtcttccccatagccgaatcgcgcatgaaagctttatgggcttcttatgttcccaatctgaacctgggaagatttggagagataagccaactgttcagccgtggtattcacatggtcgatgtgaggaggttatggttgaaactaagcctcgtcaaaacaaggaacttccatgaaagagcaaagaacgcacaagcttgggcttcatcgctcgcatctgtctctctaggacaaacttcatcagaccaatcctgatcttaagggtaagatcctgtcagcattgggaagagatgagcttgaagtgtgttctggaaatctgagagttcctttaatgaaacccctgttatatgacttttttgagtttgatttgtctgcaacgaagcatgtaaatccaggaacagctttgcttctgtttgtgaatatctatctttctcccttttttgttctataaatttgagatgtctgttttggcctcatttcttttactgaataatttgattgagtcagctaaa

SEQ ID NO: 996 - DNA, 1358 bp, Raphanus sativus
gggggttcaaaaccccgaaaatatctccggaacttttttttttaaccttttcgaatctacgatttgccccaaattgtcctaatagatgttctgattcttgagaattaggttttgatcttatctcaatccttcgattcgatcctacctttgtttctccttgctctttgaattgcaatcaaagctccatggatctccacgttccaattctcctcttctgtgtgatagctgtgtcatgctttccttctgggctcgcttcatctcccgttgacttctccgtctgcaatcacgaattcaagctgtttcggttcgatctacactcgaaatgccctctttctctccatccaagccctcctataaaggtagatggggactcgctggacaggttaatggctttgaaccatgatggaaatgcttttatgtctgtgctgttttatgcttcttggtgcccgttctcacgtgcggtgcgacctaagtttgatatgttgagttccatgttccctcagatacagcacctatctgttgaacattctcaagccctaccatctgtattttcaaggtatggtatccatagcttaccttcaatcctgatggtaaaccaaacttttaaggcgcgataccgtggtcggaaggatcttacttccctgattgagttttatgaagaatcaacaggtctcaaacctgtccagtatgtggctgaagcggaaccagcaaccaccttagacgctaccgatgacaacctgatcacatggttacgcaatggggcatctattagtgaaatattcaaacgagatccgttcttggtactctctctgctgtttctctgtttacgaatggcaatcctcgtcttcccaatagcaaaatcacgcatgaaagcattatgggcttcttatgttcccaatctgaacctggaaagatttggagaggtaagccaagtgttcagccgtgctcttcacatggtcgatgtgaggaggctatggttgaaactaagactcgtcaaaacaaggaacttccatgaaagggcgaagaacgctcaagcttgggcttcatctctcgcgtctgtctctctgggccaaacttcatcagaacaatcctgatcccttgggagatccttctagttatcttgtcagcattggaaagagataagctttaaagtttgttctggaaaagttccctacatagtatgttatactgacttttgagttaacttgtctgcaaccaaagcatgtaaattcaggaacagcgtttgcttccgtttgtgaatatctttctctctcttttttgttttgtttttataaatctgagatatctgttttgacctcatttctctgactcgagaataattttgattatttcagcta

SEQ ID NO: 997 - DNA, 1170 bp, Brassica napus
taggttttgttcttatcttcatcccttcgattcgatcctaccctttttgtttctcctccctcttgaattcaccatcaacctccatggatctccatcttccgattctcctcctctgtgtaatagctgcgtcgtgcttcccttctcggctcgcttcatctccggttgactcctccatctgcaatcacgaattcgagctgttccggttcgatctagcctcgaaatgccctccttctctccgtccaagtcctcctatcgaggtggatggagactcgctggataggttaatggctttgagccatggtgatggagatgcttatatggcagtgctgttttatgcttcttcgtgcccgttctcacgtggtgtgcgaactaagtttgatatgttgagtttgatgttccctcagatacagcatttcgctattgagcattctcaagcactaccatctgtcttttcaaggtatggtatccatagcttaccttcaatcctgatggtaaaccaaactttaaaggcgcgataccatggtcgaaaggatcttacatccctgattgagttttatgaagaatcaacaggtctcaaacccgttcagtatgtagctgaaggggaaccagcaacgagcttggacgctgccgatggtaacctcatcacatggttacgcaatgggacatcaatcagtgaaatattcaaacgagatccgttcttggtactgtctctgctggttatctgcttacaaatggcaatcctcgtcttccccatagcagaatcacgcatgaaagcgttgtgggcttcttatgctcccaatctgaacctggaaagatttggagaggtaagccaagtgttcagccgtgctcttcacatggtcgatgtgaggaggctatggttgaaactaagactcgtcaaaacaaggagcttccatgaaagggcaaagaacgcacaagcctgggcttcatctctcgcgtccgtctctctaggccaaacttcatcagaccaatcctgatcccttgagagatccttgtagtatcttgtcagcattggaaagagataagctttaagtgtgttctggaaaaagttcccttacatagtaatgttatactgacttttgagttaacttgtctgcattaaagcatgtaaatccaggaacagctttgcttctgtttgtgaatatctttctc

SEQ ID NO: 998 - DNA, 4212 bp, Sorghum bicolor
gaaattggcaatggaaatctcatggagaaggcgcatgaaagtggcgacaaaaacctcacggagaaggtgcaggaaagtgacgaggaaaacctcatggagaaggagaatgaagggccagcggaggtctcaaaaaccaccaaaagacgcaggggggatcctgttgcggacccctcttctcttgagtctagtggtaacatacaacttcgggagaggcagaatgcttcagcggatcaggagcaggggcctaagaagagaagtaaggctgaggattcaaacatgtgccatcagtgccagaggaatgataacggaagagttgtacggtgccaaggctgtgtcaaagaaaagagaaaatacagatactgtgtgaagtgcattaatcgctggtatccacatttatcagaggacgattttgcgaacaattgcccagtttgtcaaaaaaattgcaattgtaaggcctgtctgcggggagacataacccgaaccaacgccaaagttactgaaggatatagtgtatctgaacaagataaaattcaattctctatgcgtatcgtgcgctttttgctcccttggctgaaagaattccaccaagagcagatgcaagagaaaagtgctgaggctgcaactaaagggattgatgcaggcaaactagaggtccctctaaccatttgtggaaaaaatgaacggatatactgtgacaactgcaggacatctattgttgacttccacagaacctgcaataaatgtaactatgatctctgcctccggtgctgccgggagcttcgtcgaggccttgttcctggtaatggtgtcaaggttgatggtggaggcaaggaagatttgcaattgggagttagtcatgataaaattgtaagtaaagggccatctgatggacagaatggcatgttaatagatagtgtagttcctgctgacaagagcacttctagcttgagagagtggagtgtgaataacgatggaaccataccttgcccaccaaatgcatttggtggttgtgggagctctcttcttgaacttaagtgcttgttcgaagagacgtttattgctgaattactggagaaggccaattcagcggtcaataatggaatggaggtgaagatggaaggatcaaaatgttcctgcttcactgaatccggtgacatagatgatggtatatcgcggaaaacagcttgcagagagaattcctgtgataactacatatattgcccaaccgctactgatgtccaaaatggaagtttagatcatttccaggagcattggttgaagggtgaacctgtaattgtccgtgatacgcttgcattgacttctggattaagctgggaaccgatggttatgtggcgcgccttacgagaaaagagagacaaagttgagaggctctcagttcttgctcttgaatgcttgggttggtgtgaggttgatgtaaatattcatatgttttttgcggggtattcacgtgggcttgttggtccagacgatttgcctctgttacttaagcttaaagattggccaccacatagttcttttgaggagcggctgccaagacatggtgcagagtttatgtctgcgttgccatttcgcgaatacacagatcctaaatgtggtcctcttaatctggcagtaaagcttcccaagggtgttaataagccagaccttggtccaaagacttatattgcatatggtgtttccaaagagttgggaattggtgattctgtcaccaagcttcactgcgatatgtctgatgcggtgaatatcctcacacatactgatgaaataaaactcaaagcaaaaaggattgcagcagtggaaaagaagaagcagtgtttagaaatgaagagtctatctaccaaggaagcaagtggtgaccttcaatggcatgcagattttgctagtattccagcagttctcagtgaatctaacaaggagccaaggcctgaagagtttggaaatgagttgggcattaaacagccagtacaacatgttgcttctgaggagcaggaaggagttcaagatgatgccaaggctgatgcaaatgatatgaatgtttcttttgataaggggaaatcagaagattcttttggcacaattaatggtagaaaaaatgctggtgatggtgtcaacagtggagataaaattgaatctcctagtggtttagcagaaagaacattggctaaacctaccactaagggatgcagtaagcagcgtggccgtgattcttctaatgcaagagggaacaggaataaaagaacagaagaggaaaatgtgcctggattgattaccgtggctcctgagtcagaagatgagaccccatttgtagatggaaaccaagcagagggtggtgcattgtgggatattttccgacgggaagatgtgagcaaactacatgattatctaatgaaacatgcagacgagtttaggcattgcaactttgagacagtgaagcaggttactcatcctatacatgatcagtgtttttatctaacaaatgagcacaagagaaagcttaaggaagaatatggaattgagccttggacatttgaacagaagctaggtgaggcagtatttattccagcaggatgtccccaccaggttagaaatttgaagtcttgcataaaggttgcacttgactttgtttctccggagaatgtgagagagtgcatcaggttaacagaacaattccgtctgcttccgaagtggcatagggtgaatgaagataaattggaggttaagaagatagctcttcatgcactcaatcaagcgattaaagatatctctgatgaatcatctaatagcaacgaaagcagcccaaataatgacgtcaaagatgagcctagctcaagtgagtcagcggaaatagagcaaggagagtgaccagcgcaaggcatgctgaccttattgatacttatgtggcttcatatttatgtacgtggatcatgcttttgtatggtcggtggtttggccattactctgacaacaaactgatagatattacaaacagatagttattctaatctggtctgggtgcctggccagctctatagctatcgtgtgaacagtagttccctatttgacacctatatatatgacccatatttgggttcttccttccatggtccttgcaagcttgaatttctcttatctgatatacaccttcaatgtccatcctaaatttgcactgctgttcaatttcatcctatttctgttagttggctgtggaccgagttagttcttttgtcatatggacaaaatttatccctaaccatttggccttctcccaatattgctcgaaccatctagtgcagacatgtgaaccagcctctctaaaccctagatcaggtggccatggagatggaggccaacaccatgactagtgaagacagtggtgctctgatggcgggcatcacaatagggtgaaggcatggtcacatagggtggcctcacctggcggtgcacggggccgatcgttgggcgacctgaggcgaggctagttgcggcatcctgaaggcagccatctcagtagggtggaggcacgcttgcccagggtggcctcactatggtgcttggggcctgatcatgtggcgacatgggtcgccctcttcccatggcatgggagcatgcatgtgtcgctacaagggcagttgcgggtgatagctcgaagtcttgctcactcggcgacacgggcctgagccaggcttgggtgatggcttgaggtatgctggcccgatgatggaggtggggcttgtggcctgatggtggccttaacctgaggcacaggtcgatccgcacatggtggcgcactggcgtgctcgcctggaggccctgggttggcctctcctagcaatggcgcatgcgcaacaacaaaagcatcatgaatggcttaagggtcaagaagtggctcaaatcagtctaagtcaatttccatagagttttcttcgatcaatggacaaggataaaaggaggatgcaatgagcacgatgagtaaaagaaggctgagtgtgcttctcatatgtttaattttttgtcccatgtaatggatttggatttggtgtgtatgtgaaccagaatgaatatgagaacttaaatgtgtgtgcaccacatcatgtgtttgaagcggtaactatgaggattttattctaagacttcttgttattagaaacagtgtatacaagttttattctcataaaaatcattttctcatga

SEQ ID NO: 999 - DNA, 895 bp, Arabidopsis lyrata
cgacgacaaaagtcgtctacacatgtcccattaacgtctcgattcgactgtcagaatttttgtaaaacgcgaactccgacaatctttctctaatctccgatcgtgttttcttagtgagatgtcggaagagatggtaaaagatgaagcgatgcaaataatgggaatgtttcaaattcttccgagacttgtcgtctttgatctcgattatactctctggcctttttactgtgaatgccgttcgaaacgagaaatgccgtctatgtatccacaagcaaagggtatattgagtgctctgaaagagaagggtattgaaatggctattgcttcgagatctcctacttcggatattgctaacacatttcttgataaattgaacatcaagcctatgtttgtcgccaaggaaatatactcaagttggagtcacaagacggaacattttcagaagatacacacaagaaccggagtgccttttactgcgatgctcttcttcgatgatgaggacagaaacattaaatcagtttcgaaaatgggagtgacaagcatccttgtgggggatggtgttacgcttggagcatttagacaagggctcactgaatttactcaaaatcataacagtatcgagaagaataaacaggtttggcgtgacaagtattccggaaagcctacatcatcggagtcggagacagacaaagattgacattcatttccggtttgaactggagagttctaatccataggacacaaaacattctcgagtgttgtattcaccatttatttactacaagtaatttactcggatatgttaagatttgtacatggataaggattattaatctagactaaaaacatgctcttctcgacaaaatgcagaaaacattggattgacttctatttt

SEQ ID NO: 1000 - DNA, 845 bp, Thellungiella halophila
tcatgattgtaattttcacttttccgacaaaaaaaaggtagggtctcgattgtaaaaaaaaagtctctctctctctctcgatctccgatcgtttctctccggtccgaaagatgaccgaagagaaggtaaaagatgaagcgatgcaaataataggaatgtttcaaattctcccgagacttgtcgtctttgatctcgattatactctctggcctttttactgcgaatgccgctcaaaacgcgaaatgccgtctttgtatccacaagcaaagggtatattgagtgctctgaaagagaaaggaattgaaatggcgattgcttcgagatctccaacttcagatatagctaacacattcattgacaaattgaacattaagtccatgtttgtcgccaaggaaatattctcaagttggactcacaagacagaacattttcagaagatacacacaaggacaacagtgccttttactgcgatgctcttcttcgatgatgaagacaggaacattaaatcagtttcaaaaatgggagtgacaagcatcttggtgggtaatggggttacacttggagcattaagacaagggcttactgaattttctcaaaatcataacactatcgagaagaataaacatgtttggcgcaacaagtattctggaaaggctgcatcatctgagaccgacaaagactgactttgctccatagttctgatcgattggacacaccattgttgtgtattgttttaatggacgattatttatatggattcgtgaagatttgtattgaactgcagtgtaccatactggttgatacgccgtctaggccgcaaggtgagaatatcggcttttcacttg

SEQ ID NO: 1001 - DNA, 907 bp, Raphanus sativus
  misc_feature (880)..(880): n is a, c, g, or t
ggtcgacctttgggctttgtaagaaggcgcagtccgtctcggttattccagaaagatggcggacgaaaaggttagagatgaagcgatgcagatcattggaatgtttcagatccttcctagacttgtcgttttcgatctcgattatactctctggcctttctactgtgaatgtcgttctaaacgagaaatgccgtctttgtatccacaagcaaagggtatagtgagtgctctgaaagagaaaggaattcaaatggcgattgcttccagatctcccacttcagacatcgccaacactttcattgacaaattgaatattaagtccatgtttgtcgccaaggaaatattctcgagttggagtcacaagacggagcattttcaaaagatacacacaaggacaggggtgccgtttactgacatgctcttcttcgatgatgaggacagaaacattaaatcagtttctaaaatgggagtgacaagcatcttggtgggtgatggagttacacttggagcactcagacaagggcttactgaattttctcataaccataacactatcgagaagaacaaacaggtttggcgcaacaagtattccggaaagtctgcctcatctgagaccgacaaagactgacatttccggtttttttccggagttgtataacccattataccattctatggtgatcatccacccttattatttactgtataaataaattgcctggatacgtgaaagttttgtgttgaagattctaactctctcaatacaggctttgttgttacatggatgttcctagagtaactgtgttttcctatgaaactcactgaaaatggtggtgcttgtgcgtagttgaaatctatgaatgttaaggaagtccccttnaaactattgtatgaaataagttttcca

SEQ ID NO: 1002 - DNA, 872 bp, Raphanus sativus
ggattgtaagaacgggcaaaagaacctttgggctttgtaagaaggcgcagtctgtctccgttatcccagaaagatggcggacgaaaaggttagagatgaagcgatgcagatcattggaatgtttcagatccttccgagacttgtcgtttttgatctcgattatactctctggcctttctactgtgaatgtcgttctaaacgagaaatgccgtctttgtatccacaagcaaagggtatagtgagtgctctgaaagagaaaggaattcaaatggcgattgcttccagatctcccacttcagacatcgccaacactttcattgacaaattgaatattaagtccatgttcgtcgccaaggaaatattctcgagttggactcacaagacggagcattttcaaaagatacacacaaggacaggggtgccgtttactgacatgctcttcttcgatgatgaggacagaaacattaaatcagtttctaaaatgggagtgacaagcatcttggtgggtgatggggttacacttggagcactcagacaagggcttactgaattttctcaaaaccataacactatcgagaagaataaacaggtttggcgcaacaagtattctggaaaggctgcctcatctgagaccgacaaagactgacatttccggagttgtttccggtttttctccagagttgtataacccataccattctatgggatcattccaccattatttactgtataaataaattgcctgtatacttgaaagttttgtgttgaagattctaactctctccatactggctttgttgtgttacatggatgttccttatgtaactgtgttttcctatgaaactcactgaaaatggtggtgcttgtgcgta

SEQ ID NO: 1003 - DNA, 762 bp, Brassica napus
ccgttattcccgaaagatggcggacgacaaggttagagatgaagcgatgcagatcattggaatgtttcagatccttcccagacttgtcgttttcgacctcgattatactctctggcctttctactgtgaatgtcgttctaaacgcgaaatgccgtctttgtacccacaagcaaagggtataatgagtggtctgaaagagaaaggaattcaaatggcgattgcttccagatctcccacttcagatattgccaacactttcattgacaaattgaatatcaagtccttgttcgtcgccaaggaaatattttcgagctggagtcacaagacggagcattttcaaaagatacacacaaggacaggggtgccgtttactgacatgctcttcttcgatgatgaggacagaaacattaaatcagtttctaaaatgggagtgacaagcatcttggtgggtgacggggttacacttggagcactcagacaagggcttactgaattttctcaaaaccataacactatcgagaagaataagaaggtctggcgcaacaagtattctggaaaggctgcctcatctgagaccgaaaaagactgacattgagttgtaaaacccatactattctatggtgatgcatgcaccattatttactgtataaataaattgcatggatacgtgaagttttgtgttgaagattctaactctcaatactggctttgttacatggatgttccttaagtaactgtgtttccgacgagactcccagaaaa

SEQ ID NO: 1004 - DNA, 646 bp, Brassica oleracea
gtctccgttattcccgaaagatggcggacgacaaggttagagacgaggcgatgcagatcattggaatgtttcagatccttccgagacttgtcgttttcgacctcgattatactctctggcctttttactgtgaatgtcgtcctaaacgcgaaatgccgtctttgtacccacaagcaaagggcataatgagtggtctgaaagagaaaggaattcaaatggcgattgcttccagatctcccacttcagatattgccaacactttcattgacaaattgaatattaagtccttgttcgtcgccaaggaaatattttcgagttggactcacaagacggagcattttcaaaagatacacacaaggacaggggtgccgtttactgacatgctcttcttcgatgatgaggacagaaacattaaatcagtttctaaaatgggagtgacaagcatcttggtgggtgatggggttacacttggagcactcagacaagggcttactgaattttctcaaaaccataatactatcgagaagaataagaaggtttggcgcaacaagtattctggaaaggctccctcatctgagaccgacaaagactgacatttccgggttctagagttgtaacccataccattctatgggggtgatgcacc

SEQ ID NO: 1005 - DNA, 765 bp, Brassica napus
attcccgaaagatggcggacgacaaggttagagacgaggcgatgcagatcattggaatgtttcagatccttccgagacttgtcgttttcgacctcgattatactctctggcctttttactgtgaatgtcgtcctaaacgcgaaatgccgtctttgtacccacaagcaaagggcataatgagtggtctgaaagagaaaggaattcaaatggcgattgcttccagatctcccacttcagatattgccaacactttcattgacaaattgaatattaagtccttgttcgtcgccaaggaaatattttcgagttggactcacaagacggagcattttcaaaagatacacacaaggacaggggtgccgtttactgacatgctcttcttcgatgatgaggacagaaacattaaatcagtttctaaaatgggagtgacaagcatcttggtgggtgatggggttacacttggagcactcagacaagggcttactgaattttctcaaaaccataatactatcgagaagaataagaaggtctggcgcaacaagtattctggaaaggctccctcatctgagaccgacaaagactgacatttccggtttctagagttgtaacccataccattctatggtgatgatgcaccattatttactgtataaataaattgcatggatacgtgaagttttgtgttgaagattctaactctcaatactggctttgttacatggacgttccttaagtaactgtgtttcctatgagactcccagaaaa

SEQ ID NO: 1006 - DNA, 792 bp, Cleome spinosa
taggaaaaggaagtttgaggcaatttttctcaacgaacagagattctcagcgacttctctctcctcccggccattttcctcctgtctatttctagagagagagagagatggcggaggagaaggtgagagacgaggcgatgcagatgatgggaatgtttcaagttcttccgaggctcgtggtcttcgatctcgattacactctctggcccttttattgcgaatgccgctccaaacgcgaaatgccgtctttgtatccgaatgcaaagggcatcctgaaagctctgcaagaaaaggggatcgatatggcaatcgcttcaagatctccgactgcagacatagctaacacattcctcgacaagttaaacatcaaaccgatgttcattaccaaggagatcttttcgagttggagtcacaagacggaacattttcagaggatacacgcaaggacaagcgtgccattcacctcgatgctcttcttcgatgatgaagacagaaatatcaaatctgtatcgaaaatgggagtgacaagcatcttggtgggaaacggggttacccttggagcatttagacaagggctcactgaatttgcacaaaatcagaacaacatcgagaagaacaagcagagatggcgtaagttttcaggaaagtcatcatccgagatagacgacgaggactgacagaaaccgaacaaacatttgaggtcggggaatgaccaacattgtctcacttagccatatacactgcggaataactttcatggatgcaaacaagatttcgttgaatacaaaaaaa

SEQ ID NO: 1007 - DNA, 2530 bp, Sorghum bicolor
ctccttccaacctcgggcccgcccgtcctgaggtccgagctcgatgcagccgatccggcggcggcaccgaggctttccactcctctgtctctccgccgccctcctcgctgccgccactcttctccccggtgccgccgtcgctgagggcgtcacgccctccgaggcgcgccggctccgcgatgaggtgaaggatatgttctatcatgcgtttgatgggtacatgaagtatgctttcccactcgatgagctgcgacccttaagttgccaaggtgaagactcccttggtggttacgcgctcactcttatcgattctttggataccttggctttactgggtgataaggagaaatttggtgctgctgtggagtgggttggtaagaatgtccgctttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttggctcagaggttgttgcccgcatttgacactcctacaggtattccatttggatctgttaatttaatgtatggagtcgatgaaaatgaaagcaagataacatcaacggctggtggtggtactttgacactggaatttggcatattgagtcgcttgactaataatactgtttttgagcgagttacaaaaaaatcagtgcgtggaatatggtcacgcagatcaaaactcaatcttgttggtgcccatataaatgtctttactggtgaatggacacagaaggatgcaggaattggcacaagcattgattcattctatgaatatcttctaaaggcaaggaagaccaccatgtttattatttttggcgcgtatttattgtttggagatgaagaatacctgtatatatttcaggaggcttacaaagctgccatgcactatctccatcacgatccttggtacgtggaggtcaatatgaactctggtgctactgtttggccactcttcaatagtctgcaggcattctggccagggcttcaggtcttagctggagatgttgatcctgctattcgcacacatgctgccttcttcagcgtctggaaaaagtatggttttacccctgaaggttttaatcttgctacatccactgtccagaatggacaaaggagctacccgctacggccagagttgattgaaagcacatattggttgttcaaggctaccagagatcatagataccttgatgttggaagggacatattagcaagccttcaatatggtgctagatgcccttgtggctactgccacatagcagatgtggaaacccacaagcaggatgatcacatggagagttttttccttgcagaaacggtcaaatatctctggcttctttttgatttagctgctggccctgacaatattgttgaaagtggaccatataagtacatatttagtacagagggtcatttgctacctgttactcctgagatagccttggtagatgaacattgttcttattttggagcattctgtaatggtggtgccgaccatggatatggtgctagtgctagttctactaagcatcaaaatggaaactatacccaattagatgatattcaaacccattccagtctctattcaacgtccaacgtgttgtttaagacaggaggttacatcaagggagtttgtccaggattgactcatgcacagaaacttgggatatcatactctgatggagaggataactttatagagcagacttctgaaagtcgtgagcatcatggtgaatctgcagtagaatctagcatccaagaccaatcaagttctattatattaatctctcacccagtcacaagccaacaggatgaggctttggagagtgggtctggaagtcaagatcatggaaacattgttgtaacttctgattctgattctgattctgattccacaagccgtgataatattgttggagcgaacactgaagaacttatggaggacattgagggcacctctggacaggacaaaagatgaagaggttgctcagagtgttgagtcgaagatatcaactgaccctttgttcatgtagcgacccatttctgtggaatctccagggtcaatagcttgctgaatgcagaacaagttagcaagcaagcaaatggctggtagacgcttcagtatcttgtccgattctcaacatctgaaaggagttcttgagatgattgggcgccatattgttgcgttgaggactgactttgaacgtgggaaattgatatttactttcagatagtagtatattacagggtgggcattcactaatttgttcttttctgtattggttacatagatattcttttgattaatagagaaggtacgaattttgtacaccagatgcatatgaagagacactgcatacaacatgggatttttttggttgtagaacagatcataaacagcaaacgagttttagtgtgcaagcttacaagactttatattcgaattcag

SEQ ID NO: 1008 - DNA, 1983 bp, Setaria italica
gctcgactcgaacgcgatgcagccgatgcggcggcggcaccgaggcttcccgctcctctgcctctccttcgccctcctcgctgccgccgctcttctccccggcactgccgtcgccgagggcgtcacgccctccgaagcgcgccggctccgcgacgaggtgaaagatatgttctatcatgcatttgatgggtacatgaagtatgctttcccactcgatgagctgcgacccttaagttgccaaggtgaagactcccttggtggttatgcacttactcttatcgactctttggataccttggctttactgggtgataaggagaaatttggggctgctgtggagtgggttggtaagaatgtccgctttgatattaataaaaccgtctctgtttttgaaaccaacatacgtatccttgggggtctgttgtcagctcacctgattgccagtgactatgctactggtatgagaatccaatcttacgatgaccagttacttaatttagctgctgacttagctcagaggttgttgcctgcatttgacactcctacaggtattccatttggatctgtcaatttaaagtatggagttgatgaaaatgaaagcaaggcaagcttctttcttcctcccattttataaactgctggtggtggtactttgacactggaatttggcatattgagtcgcttaactaataatactgtttttgagcgagttacaaaaaattcagtgcgtggaatatggtcacgcagatcaaaactcaaccttgttggtgcccatataaatgtctttactggtgaatggacacagaaggctgatcaactagctggtccattcttccttttcttctactatcatgcattttgtgtcaaaatcaaacaggcatatttattgtttggggacgaagagtacctgtatatatttcaggaggcttacaaggctgccatgcactatctccatcatgatccttggtatgtggaggtaaatatgaattctggtgctactgtttggccactattcaatagcctgcaggcattctggccaggacttcaggtttggattacttatattttagaagtatttatgacgcacgctgccttcttcagtgtctggaaaaagtatggtttcacccctgaaggttttaatcttgctacatccactgtccagaatggacaaaggagctatccgctacggccagagttgattgaaagcacatattggttgttcaaggctaccagagattatagataccttgatgttggaagggacatattagcaagccttcaatatggtgctagatgcccttgtggctactgtggaaacacacaagcaggatgaccacatggagagttttttccttgcagaaacggtcaaatatctctggcttctctttgatttagccgctggccctgataacattgttgaaaatggaccatataagtacatatttagtacggaaggtcatttactacctgttactcctgagatagtcttggtagatgagcattgttcttattttggagcattctgtaatggtggtgcagaccggtgctagttctatgaagcataaaaaagcaaactatactcatttagatgatatccaaaccccttccagtcactattcagcatccaacatgtttgcaacaagaggttacatcaagggagtttgtccaggattgactcatgcacagaaacttgggatatcatactctgatggtcatagagcagacttctgaaggtcatgagcatcacgatgaatctgcaatagaatctagcgtccgaacccaatcaagtaatgttatacttatatctcacccagttgcaagccaacaggatcaggctttggagagcagctctggaaatggagatcatgctgatattgtggtaactgctgattctgattccataagccatgataataatgatggctcactcggagcaaacactgaagaacttactgaggacaccgagcgcacctccaaacattc

SEQ ID NO: 1009 - DNA, 3034 bp, Brachypodium distachyon
atgacaactaacaaaaactcaacagataatacgtataaacgtatctgcgagtacacaaacacaagatcgggtacactaaactcacggggattaaaaatctctggctccgcagcaacgtccgttgaggcaccaccacaacagaggaagaaccagggtacctttattcgcgacggcatcgcaatctctgccattgtgttgtcgatcagaaccaaacaattgaaatatgcaaacactctgaataatgttaggagaaaccgaggtttccccccacctccccacgccaagacggcggccggaggtgagggaaacgctaacttgaatggtgacggcggcggcacagctctcgtggagacaacagaagcgatcgatctgtcaaagctatgtaggttgttcggaaagatagatggataccgtgctttataccggagaagttttattgggttttctttgtgtggcgagacacgtctccttgaatcgtgtttgtacgctggagcctggaagcaagaaatttggaacccctttgatcctatccctgcctcccggctcccgcacacccctggtctctcgggctcgtcccagctcagagccccagacccgaacacgatgcggctgcggcgccaaggctcccccctcctatgcctatccgcggccctcctcgcggtcgccctgctcaccggcgccgccgtagccgatggcgtcacgccctccgaggcgcgccggctacgggacgaggtgaaagatatgttctatcatgcatttgatgggtacatgcaacatgcttttccacttgatgaactgcgaccattgagttgcaaaggagaagactcccttggtggttatgcacttactcttattgactctttggataccttggctttactaggtgataaggagaaatttggtgctggtgtggagtgggttggtaagaacgtccgctttgatattaacaaaaccgtttcagtttttgaaaccaatattcgtatccttgggggtctgttatcagctcacttgattgccagtgattatgccaccggtatgagaatccaatcttacgatgaccagttgcttcatttggctgttgacttagcccagaggttgttacctgcatttgacactcctacaggtattccatttggatctgttaatttattgtatggtgtcgacgatgatgaaagcaaggcaagcttcttctctggtggtggcactttggcattggaatttggtatcttaagtcgattgactaataacactgtttttgaggaagttacaaaaaatgcagtgcgtgggatatggtcacgcaggtcgaaactcaaccttgttggtgcccatataaatgtctttactggtgaatggacacagaaggatgctggaatcggcacaagcatcgactcattctatgaatatcttctgaaggcatatttattgttcggagacgaggagtacttgtatatatttcaagaggcttacaaagctgccatgcactatctccatcttgatccttggtatgtcgaggtaaatatgaatactggagtgaccgtttggccactattcaatagtctgcaggcattctggccaggacttcaggttttagctggagatgttgatcctgccattcgaacacacgctgccttcttcagcgtctggaaaaaatatgggttcactccagaaggatttaatcttgctacctccactgttcagaatggacaaaggagctatccgctgcggcctgagttgattgaaagcacgtattggctattcaaggctaccagagactataagtaccttgatgttggaagggatatactagcaagccttcaatatggtgctagatgtccttgcgggtactgccacatatcagatgtggaaactcacaagcaggatgaccacatggagagttttttccttgcagaaacggtcaaatatctctggcttctttttgatttagccgtaggccctgataacattgttgaaaatgggccttacaaatacatatttagcacagaaggccatttgttacctgctactcctgagatagcgttggtagatgagcactgctcttattttggagcattctgtaatggcagtacagaccgtggctacagtaagagtgatagttctagtaagcaccaaagtgcgaacaacactcagtttgatgacagacaaactgcttccagtaaatattcaatgtccaatgttttgtttacaacaagaggttacattaagggagtttgtcctggattgactcatgcacagaaacttggcatatcgttctacgatgaaggtgataactccgtggaacagaactctaaaagtcccgagaaccctgatgaatctcatgtggtcgaatccagtgtccacgctcaatcaagtgctgttatattgatgtctcatcatgtcacgagccaacccgatgaacctttgaagacaaagttgataaattggcatcatgaaactattgtggtaactgctgattctgatcccatgaggactgatgctaccggtggcttgtctgaaggaagcactgaagaactttctgaggaaaccataagcatctctgaacagacagaagtcactgaagaagatattgcttctcaggacattcaaccgaatgaagatagtacgagttgacccctagaccatgtaggcaccaattctttgactttactggagcaccttcatgcatgatcagagctgtccgttttacactacacaatgtgcccggaagcaagcgacaatgagccaggtcggtcaatcagtatctaacccctgcttgagttgggaatcgatggttgtaatgggggtcgttctggagtcggtatttaccacaggaaacccgatggcaaaggaactaaagaataagcattcattaatttattctgtttgtagcaattagataggcaattgaatggtttcaatcgaatagcagatgtgaagttttgtatactagaagcaaacaaagaactatatgggcatatggccaactaggtgcatgcaacatactattgcaaatcagaaacaactcggctgaaaactc

SEQ ID NO: 1010 - DNA, 565 bp, Saccharum officinarum
  misc_feature (495)..(495): n is a, c, g, or t
ctctcccccagtctcacctcacttcgtgcatggtcttcagagtagagagaggaggaagaagagcaggaggcggcgtccgatgtgctgctacgtgggcaaggccaccaagatcttcctgtgcctcgtggcggcgctcctcgtcgcgggcctcgtcctcggcttcggcctggcccgccacacgtggggagccgacagggcccagcagcagcagcagccggactgccgctggcccgactgccagcagcaggagggctccgcgtacggcggcgacccgctcctccccgccaccgccaccacgccgaccaacccgctcacgcagccggccgtggctgtctttcccggtgccaccccgtcgtcgtctgccggcgccgccgcgccgcccacgggcgtgccatactttgggccgcctggcccgttcgtcgtgggcctcggcccagccgctcatgcgtgagtcgtcgggctgagccactgcaggcctgaggcgatgcgagcggnctttttgacttttgctcgttgtcgtagtcttctccccttctggaatcagcgtttgaatattgttattatc

SEQ ID NO: 1011 - DNA, 831 bp, Pseudoroegneria spicata
ccgttgctgtcgactaacctcactactcttaagcgccaaaatatttttgctaccagcacctaagctccaatggagggtgagaagaactcgtccggggacctgatgtccagcagcaagctggtcgcggaggccgccaagacggcctacgagaagaagagcgtcgagggcatcgacaaggagaaggtagccgccgcctccgccgagatcctcgactccgccgccaagtacggcaagctggaggacaagccggtggggcagtacctcgagaaggccgaggggtacctgaaacagtacagctccggcggcaccgagaaggagaaaaccgacgcacctgctgccgctgacgcaccgaagccggatgcacccaaggagccagcgcctgcgtctgcacccgccgcggaggaagagaaatcgtccgatgggttcggtctcgacgacgtcatgaagggggctgcatcgctgtcggggaagaagagtggcgaggaggagaaggagagcggcggcggcggcgggttcatgaagatggctcaggggttcatgaagtagaagtctggttgctgcatctctgtgcatgtagctcttgctaatgtttgtgcgctgctttccttgtgtattttattactgtaacgctgtggttgtgcttaattatattattagctgctgatatttggttatgtaaagtttcttaagttatgtatgtctgtatgatgatcaataattcagttgtgctagctagctgcttcctgcttgcatgattttttttttttgatggactgcttgcaggatttcggttgtatataagttacataaagcatgatctttccattgtca

SEQ ID NO: 1012 - DNA, 730 bp, Triticum aestivum
ctaacctcactagtcttaagccacaaaagatttttgctaccagcacctaagctccaatggagggtgagaagaactcgtccggggacctgatgtccagcagcaagctggtcgcggaggccgccaagacggcctacgagaagaagagcgtcgagggcatcgacaaggaaaaggtagccgccgcctccgccgacatcctggactccgccgccaagtacggcaagctggaggacaagccggtggggcagtacctcgagaaggctgaagggtacctgaaacagtacagctccggcggcaccgagaaggagaaaactgacgcacctgccgccgctgacgcgccgaagccggatgcacccaaggagccagcgcctgcgcctgcacccgccgcggaggaagagaaagcgtccggtgggttcggtctcgacgacgtcatgaagggggctgcatcgctgtccgggaagaagagtggcgaggatgagaaggagagcggcggcggcggcgggttcatgaagatggctcaggggttcatgaagtagaagtctggtttctgcatctacatgcatgttgctcttgctaagtttgtgcgctgcgttccttctgtattttattactgtaacgtcgtggttgtgcttaattatgttacctgctgatattcggttctgtaaagtttcttaagtcatgtgtgtctgtatgatgatcaataatccagttgtgctagctagctggttccttc

SEQ ID NO: 1013 - DNA, 653 bp, Setaria italica
tgctactaacctcactactcttaagccacaaaagattttgctaccggcacctaagctccaatggagggtgagaagaactcgtccggggacctgatgtccagcagcaagctggtcgcggaggccgccaagacggcctacgagaagaagagcgtcgagggcatcgacaaggaaaaggtagccggcgcctccgccgagatgctggactccgccgccaagtacggcaagctggaggacaagccggtgggacagtacctcgagaaggccgaggggtacctgaaacagtacagctccggcggcaccgagaaggagaaaaccgacgcacctgctgccgctgacgcaccgaagccggatgcacccaaggaggcagcgcctgcacccgccgcggaggaagagaaagcgtccgatgggttcggtctcgacgacgtcatgaagggggctgcatcgctgtccgggaagaagagtggcgaggaggagaaggagagcggcggcggcggcgggttcatgaagatggctcaggggttcatgaagtagaagtctggtttctgcatctacatgcatgtagctcttgctaagtttgtgcgctgcgttacttctgtattttgttactctataacgttgtggttgtgcttaattatgttagctgctgatatctg

SEQ ID NO: 1014 - DNA, 847 bp, Triticum aestivum
aacttcctcgggaagaagctcaagaagcaggtgacctcggccgtgaactaccatggcaagagctccaaggccaacaggttcacggtcatgcagcggaaaacatcgacgagaagaggaacaccgacaagtggaagggtcttgcgtacgatatctccgacgaccacctcgtgccgaattcggcacgaggcctcactactcttaagccacaaaagattttgctaccggcacctaagctccaatggagggtgagaagaactcgtccggggacctgatgtccagcagcaagctggtcgcggaggccgccaagacagcctacgagcagaagagcgtcgagggcatcgacaaggaaaaggtagccggcgcctccgccgagatgctggactccgccgccaagtacggcaagctggaggacaagccggtgggacagtacctcgagaaggccgaggggtacctgaaacagtacagctccggcggcaccgagaaggagaaaaccgacgcacctgctgccgctgacgcaccgaagccggatgcacccaaggaggcagcgcctgcacccgccgcggaggaagagaaagcgtccgatgggttcggtctcgacgacgtcatgaagggggctgcatcgctgtccgggaagaagagtggcgaggaggagaaggagagcggcggcggcggcgggttcatgaagatggctcaggggttcatgaagtagaagtctggtttctgcatctacatgcatgtagctctcgctaagtttgtgcgctgcgttctactgtataacgttgtggttgtgcttaattatgttagctggtgatatctggttctgtaaagtttaaagtttcttaagtca

SEQ ID NO: 1015 - DNA, 676 bp, Triticum aestivum
ttttgctaccggcacctaagctccaatggagggtgagaagaactcgtccggggacctgatgtccagcagcaagctggtcgcggaggccgccaagacagcctacgagcagaagagcgtcgagggcatcgacaaggaaaaggtagccggcgcctccgccgagatgctggactccgccgccaagtacggcaagctggaggacaagccggtgggacagtacctcgagaaggccgaggggtacctgaaacagtacagctccggcggcaccgagaaggagaaaaccgacgcacctgctgccgctgacgcaccgaagccggatgcacccaaggaggcagcgcctgcacccgccgcggaggaagagaaagcgtccgatgggttcggtctcgacgacgtcatgaagggggctgcatcgctgtccgggaagaagagtgacgaggaggagaaggagagcggcggcggcggcgggttcatgaagatggctcaggggttcatgaagtagaagtctggtttctgcatctacatgcatgtagctctcgctaagtttgtgcgctgcgttctactgtataacgttgtggttgtgcttaattatgttagctgttgatatctggttctgtaaagtttaaagtttcttaagtcatgtatgtctgtatgatgatcaataatccagttgagctagcta

SEQ ID NO: 1016 - DNA, 735 bp, Triticum aestivum
ggctactaacctcactactcttaagccacaaaagattttgctaccggcacctaagctccaatggagggtgagaagaactcgtccggggacctgatgtccagcagcaagctggtcgcggaggccgccaagacagcctacgagcagaagagcgtcgagggcatcgacaaggaaaaggtagccggcgcctccgccgagatgctggactccgccgccaagtacggcaagctggaggacaagccggtgggacagtacctcgagaaggccgaggggtacctgaaacagtacagctccggcggcaccgagaaggagaaaaccgacgcacctgctgccgctgacgcaccgaagccggatgcacccaaggaggcagcgcctgcacccgccgcggaggaagagaaagcgtccgatgggttcggtctcgacgacgtcatgaagggggctgcatcgctgtccgggaagaagagtgacgaggaggagaaggagagcggcggcggcggcgggttcatgaagatggctcaggggttcatgaagtagaagtctggtttctgcatctacatgcatgtagctctcgctaagtttgtgcgctgcgttctactgtataacgttgtggttgtgcttaattatgttagctggtgatatctggttctgtaaagtttaaagtttcttaagtcatgtatgtctgtatgatgatcaataatccagttgagctagctagctgcttccttctcaaaaaaaaaa

SEQ ID NO: 1017 - DNA, 864 bp, Hordeum vulgare
ctagcctcaccactcttaagcgacaaaagattgttgctaccagcacctaagcttgaatggagggtgagaagaactcgtccggggacctgatgtccagcagcaagctggtcgcggaggccgccaggacagcctacgagaagaagagcgtcgagggcatcgacaaggaaaaggtagccgccgcctccgccgatatcctggactccgccgccaagtacggcaagctagaggacaagccggtgggccagtacctcgagaaggccgaggagtacctgaaacagtacagctccggcggtgcagagaagactgatgcacctgctgccgctgacgcaccgaagccggatgcacccaaggagccagcgcctgcgcctgcacctgcacccgccgtggaggaagagaaatcgtccgacgggttcggtctcgacgacgtcatgaagggggctgcatcgctgtcagggaagaagggtgacggggaggagaaggagagcggcggcggcggcttcatgaagatggctcaggggttcatgaagtagaagtcgggtttctgcttctactacatgcatgtagctcttgctaagttcgtgcgctgcgttccttttttgtattttattactgtataaaataataacgtcgtggttgcgcttaattatattattagctgctgatatttggttctgtaaagtttcttaagttatggatgtctgtatgatgatcaataatccggttgtgctagctagaggcatcctgcttgcaggatctcggttgtaatctactccctccctttctaaatataagtctttttagacgtttcactaaaagactatatgcggatgtatataaacatattttaaaatataaattcattca

SEQ ID NO: 1018 - DNA, 832 bp, Hordeum vulgare
agccgacaaaagattgttgctaccagcacctaagcttgaatggagggtgagaagaactcgtccggggacctgatgtccagcagcaagctggtcgcggaggccgccaggacagcctacgagaagaagagcgtcgagggcatcgacaaggaaaaggtagccgccgcctccgccgatatcctggactccgccgccaagtacggcaagctagaggacaagccggtgggccagtacctcgagaaggccgaggagtacctgaaacagtacagctccggcggtgcagagaagactgatgcacctgctgccgctgacgcaccgaagccggatgcacccaaggagccagcgcctgcgcctgcacctgcacccgccgtggaggaagagaaatcgtccgacgggttcggtctcgacgacgtcatgaagggggctgcatcgctgtcagggaagaagggtgacggggaggagaaggagagcggcggcggcggcttcatgaagatggctcaggggttcatgaagtagaagtcgggtttctgcttctactacatgcatgtagctcttgctaagttcgtgcgctgcgttccttttttgtattttattactgtataaaataataacgtcgtggttgcgcttaattatattattagctgctgatatttggttctgtaaagtttcttaagttatggatgtctgtatgatgatcaataatccggttgtgctagctagaggcatcctgcttgcaggatctcggttgtaatctactccctccctttctaaatataagtctttttagacgtttcactaaaagactatatgcggatgtatataaacatattttaaa

SEQ ID NO: 1019 - DNA, 691 bp, Triticum aestivum
ttgtaacaaacacctaaggtccaatagagcggtgagaaaaactcgtccggggaccttatgtccagaagcaacttgatcgcggaagcccccaagacgccctacgagaagaagagcctcgaggccatccacaaaggaaaaggtagccgccgcctcccgccgacatcctggactccgccgccaagtacggcaagctggaggacaagccggtgggccagtacctcgagaaggctgaggggtacctgtaacagtacagctccggcggcaccgagaaggagaaaaccgacgcacctgctgccgctgacgcacggaagccggatgcacccaaggaggcagcgcctgcgcctgcccataccacggaggaagagaaatcgtccgatgggttcggtctcgaagacgtcatgaagggggctgcatcgctgtcggggaagaagagtggcgaggaggagaaggagaacggcggcgacgacgggttcatgaagatggctcaggggttcatgaagtagaagtctggtttctacatcaacatgcatgtagctcttgtaaagttcgtgcgactgcgttacttccgtattttgttactctaacacgttgtggttgtgcttaattatgttacccgctgatatctggttcggtaaagtttcccaaatcaagtctgtctgtattgatgatcaataatccagttgtgctagct

SEQ ID NO: 1020 - DNA, 692 bp, Triticum aestivum
ttgtaacaaacacctaaggtccaatagagcggtgagaaaaactcgtccggggaccttatgtccagaagcaacttgatcgcggaagcccccaagacgccctacgagaagaagagcctcgaggccatccacaaaggaaaaggtagccgccgcctcccgccgacatcctggactccgccgccaagtacggcaagctggaggacaagccggtgggccagtacctcgagaaggctgaggggtacctgtaacagtacagctccggcggcaccgagaaggagaaaaccgacgcacctgctgccgctgacgcacggaagccggatgcacccaaggaggcagcgcctgcgcctgcccataccacggaggaagagaaatcgtccgatgggttcggtctcgaagacgtcatgaagggggctgcatcgctgtcggggaagaagagtggcgaggaggagaaggagaacggcggcgacgacgggttcatgaagatggctcaggggttcatgaagtagaagtctggtttctacatcaacatgcatgtagctcttgtaaagttcgtgcgactgcgttacttccgtattttgttactctaacacgttgtggttgtgcttaattatgttacccgctgatatctggttcggtaaagtttcccaaatcaagtctgtctgtattgatgatcaataatccagttgtgctagcta

SEQ ID NO: 1021 - DNA, 2254 bp, Sorghum bicolor
gcagcggcatgtgaaggtcgcagtcgtccccagggccttgctctgattgagcatcagtaacgcctcgctcactcgctcaccacaggaaccagcgagttctctgcagcttgctatgggaaccacaacggcaacaatggacaggaataatgcagatggagggctgggtaggaggaagaagggaggcttcaggaccatgccgctcatactagcaagcgaagtgtgcgaccggtttgccacggccggcttcagcgccaacctgatcacgtacctgacgcagcagctgcacctcccgatggtggaggcctccaacacgctgacaaacttcggcggcacctccgccttcacgcccatcctcggcgcgttcgccgccgactccttcgccggccgcttctggaccatcatcgccggctccgtggtctaccagttcggcatgatcggcgtcgtcgtgtccgcgctcctcccttcgctccgcccgcccccgtgcaaaccaccggccaccccgtgccagcgcgcctccgggtggcagctcgccctgctctacctctcgctgctgctcacgtcgctggggtccggcgggatccggccctgcgtcgtggcgttcggcgccgaccagttcgagcaggacagcagcggcgccgccgaggcggcggccaaggcggaggcggagcggaagcggcgctacttcaacctctacttcttcaccatgggcttcgccgtgctgctggcgctcacggtggtggtgtacatccaggagaacgtcgggtggggctggggcttcggcatcccggccatcggcatgttcatctccatcgtcgtgttcctcgccggctacccgctctacgtgctgctcaggcccggcggcagcccgttcacgcggctcgcgcaggttgtcgctgccgcgttcaagaagcgcaacgccgccgtgccggaggaccccggcttgctgtaccaggacaaggagctcgacgcgctcatctctaccaacggcaggctcctgcacaccaaccagctcacgttcttcgaccgggcagcaatagtgacgccgggcgacatcaccccgtccgggcaacccgacctgtggcgtctgtcgacggtgcaccgcgtggaggagctcaagtccatcctccgcttgctgcccatctggtcggccggcatcatgctggccaccgccggctcccacaactacaccttcaccatcatgcaggcgcggaccatggaccggcacctggggcccggccacttccagctcccgccggcgacgctgaccatcttctcgacggccgccatgctcgtcaccctggccttctacgaccgcgtcttcgtgccgctggcgcgccgcgtcacgggcctgccgtcggggatcacctacttccagcgcatgggcatcgggctcgccatctccgtgctcagcgtcgcgtcggccgcgctcgtggagaccaagcgccgcgacgccgcggcgcggcacgggctcctggacagccccgccgccgtcgtgcccatcagcgtgttctggctcgtgccccagttcgccgtccacgggatcggcgacgccttctcgtcggtggcgcacatggagttcctctacgaccaggcgcccgagagcatgcgcagcagcgccgtcgcgctcttctggctcgccggctccatcgggagctacatgggcacggtgctcgtcacggcggtgcagagcgccaccagaggggcgtggctccaggacaacatcaacaaggggaggctcgactactactactggctcgtcacgtgtatcatggtgctcaacttcggatactttctcgtctgcttctacttctacaccatgaagccgctggaggtggcgggtgatgacaatggtggtgaccatgacaaggagtgtgagctctcgtcgtcgtctctccggaaaaatggcggtggcggcaccggcggtgggatggtgtaaggttgatttgtttgagggtaattaactaaaaggctagaaagaatggtcttgttaagatatgtaatcagctgctgcacatgcacaaggattacaatttactatagggattatactgtatatatatcgaggctagaattatgaacttgagcgagcatgcatactgtcagaggaagatatacgaacgtacgatcatgatcgtgatcaagcaagctaattaaaagcactatgcatctcatgcatgatagtatagcttagtatattttattgtgtccatacctgtatgacagattcacttttttttagtggagtctgcgctga

SEQ ID NO: 1022 - DNA, 777 bp, Triticum aestivum
gtcattcctagctgaaaagaaagagaagcactaccatttctacagaagaaactactccatcgatctccatggaaatctacggtgacctcgaggccggctgcctcagccactccgtctctcccatcaagccggcgtccccgccgaggaaggccgggccgggccgcctcttctgcgacccctgcgacgacgccggcgagctcctcggccaccaccactacctggacatctgcttcagctgccggaagctcctcgccgggaacaaagacatcttcatgtacagaggtgacacgcccttctgtagcgaggagtgcaggcaggagcagatcgagatcgacgaggcgagggagaagcggtcgaatcagaccgggagggcggaggagcagcggcagaggcagcagcagaagcagagcaccccgaggatccccgtctgggcgtggtagcagctttccggcaaccaatccgaacgtaggattttcagcagcagttcgtgaacaaaagctcgatgatgggttgggaagcctagatccagttgagggaagcttggatcgccggttcgacgggacgaccaccacctgcaggcagcaaacctgctgcatcttttatgctgtctctgaaccgcagggatgggttctcacccttttgatctccgaagatggagactaagagttaaattttgtgtgtgaattatcgctggttttttgttcttgtgtcgcgtaaggtgtaccatagcctgcctgtcgatatgaaagaaagtgagaggcataacaaaagctctct

SEQ ID NO: 1023 - DNA, 795 bp, Triticum aestivum
gtcattcctagctgaaaagaaagagaagcactaccatttctacagaagaaactactccatcgatctccatggaaatctacggtgacctcgaggccggctgcctcagccactccgtctctcccatcaagccggcgtccccgccgaggaaggccgggccgggccgcctcttctgcgacccctgcgacgacgccggcgagctcctcggccaccaccactacctggacatctgcttcagctgccggaagctcctcgccgggaacaaagacatcttcatgtacagaggtgacacgcccttctgtagcgaggagtgcaggcaggagcagatcgagatcgacgaggcgagggagaagcggtcgaatcagaccgggagggcggaggagcagcggcagaggcagcagcagaagcagagcaccccgaggatccccgtctgggcgtggtagcagctttccggcaaccaatccgaacgtaggattttcagcagcagttcgtgaacaaaagctcgatgatgggttgggaagcctagatccagttgagggaagcttggatcgccggttcgacgggacgaccaccacctgcaggcagcaaacctgctgcatcttttatgctgtctctgaaccgcagggatgggttctcacccttttgatctccgaagatggagactaagagttaaattttgtgtgtgaattatcgctggttttttgttcttgtgtcgcgtaaggtgtaccatagcctgcctgtcgatatgaaagaaagtgagaggcataacaaaagctctctcagttttcaaaaaaaaaa

SEQ ID NO: 1024 - DNA, 821 bp, Leymus cinereus x Leymus triticoides
cgccgttgctgtcgccgttgctgtcgcattcctagtagctgaaaagaaagagatgcattaccagtttgcagaagaaactactccatcgatctccatggaaatctacggtgacctcgaggccggctgcctcagccactccgtctctcccatcaaaccagcatcctcgccgaggaaggccgggccgggccgcctcttctgcgacccctgcgacgacgccggcgagctcctcggccaccaccactacctagacatctgcttcagctgccggaagctcctcgctggaaacaaagacatcttcatgtacagaggtgacatgcccttctgtagcgaggagtgcaggcaggagcagatcgagatcgacgaggcgagggagaagcggtcgaatcagacggggagggcggaggagcagcggcagagacagcagcagaagcagagcaccccgaggatcccggtctgggcgtggtagcagctctccggcaaccaaaccgaacgtaggattttcagcagcagttcatgaacaaaaaaagctcgatgagttggacagtccagatccagttgagcgaagcttggatccccggttcaacgggacgaccaccaccagcaggcaggggagcagcaaacctgctgcgcctttatgctgtctcaaaaccgcaacgatgggttctcatcctttcgatctccgaagatggagactaagagttaaattttgtgtgtgtgaattatcactggttttttcgttccttcgcacggttgcttggtgtactacaacctgttaatatgaaagaagtgagaggcataacaaaagctctctcaattttcta

SEQ ID NO: 1025 - DNA, 781 bp, Triticum aestivum
ctctccgttcagccattcctagctgaaaagaaagagaagcattaccagtttgcacaagaaactactccgtcgatctccatggaaatctacggtgacctcgaggccggctgcctcagccattccgtctctcccatcaagccggcgtccccgccgaggaaggccgggcccggccgcctcttctgcgacccctgcgacgactccgaccagctcctcggccaccaccactacctggacatctgcttcagctgccggaagctcctcgccgggaacaaagacatcttcatgtacagaggtgacacgcccttctgtagcgaggagtgcaggcaggagcagatcgagatcgacgaggcgagggagaagcggtcgagtcagacggggagggcggaggagcagcggcagagacagcagcagaagcagagcaccccgaggatcccggtctgggcgtggtagctgctctccggcgaccaagccgaacgtaggattttcagcagcagttgatgaacaaaagctcgatgatgagttgggcagtctagatccagctgagggaagcttgggtcgccggttcgacgggacgaccaccgccagcagcaggcggcaaacctgctgcatcttatgctgtctctgaaccgcagggatgggttctcatccttttgatctccgaagatggagactaagagttaaattttgcgtgtgaattatcgctggttttttgttcttgtgtcgcgtaaggtgtaccatagcctgtcgatatgaaaaaaagtgagaggcctaacaaaagctc

SEQ ID NO: 1026 - DNA, 781 bp, Triticum aestivum
  misc_feature (709)..(709): n is a, c, g, or t
gccattcctagctgaaaagaaagagaagcattaccagtttgcacaagaaactactccgtcgatctccatggaaatctacggtgacctcgaggccggctgcctcagccattccgtctctcccatcaagccggcgtccccgccgaggaaggccgggcccggccgcctcttctgcgacccctgcgacgactccgaccagctcctcggccaccaccactacctggacatctgcttcagctgccggaagctcctcgccgggaacaaagacatcttcatgtacagaggtgacacgcccttctgtagcgaggagtgcaggcaggagcagatcgagatcgacgaggcgagggagaagcggtcgagtcagacggggagggcggaggagcagcggcagagacagcagcagaagcagagcaccccgaggatcccggtctgggcgtggtagctgctctccggcgaccaagccgaacgtaggattttcagcagcagttgatgaacaaaagctcgatgatgagttgggcagtctagatccagctgagggaagcttgggtcgccggttcgacgggacgaccaccgccagcagcaggcggcaaacctgctgcatcttatgctgtctctgaaccgcagggatgggttctcatccttttgatctccgaagatggagactaagagttaaattttgcgtgtgaattatcgctggttttttgttcttgtntcgcgtaaggtgtaccatagcctgtcgatatgaaaaaaagtgagaggcctaacaaaagctctctcagttttc

SEQ ID NO: 1027 - DNA, 725 bp, Hordeum vulgare
ccttcactcattcctactagtagctgaaaagaaagagaagcattaccagcttgcagaaggaaactacaaccccatcgatctccatggaaatctacggtgacctcgaggccggctgcctcagccactccgtctcgcccatcaagccggcgtcctcgccgaggaagcccgggcctggccggctcttctgcgacccctgcgacgacgccgacgagctcctcggccgccaccactacctggacatctgcttcagctgccggaagctcctcgccgagaacaaagacatcttcatgtacagaggtgacacgcccttctgcagcgaggagtgcaggcaggagcagatcgagatcgacgaggcgagggagaagcggtcgaatcagaccgggagggcggaggagcagcggcagaggcagcagcggaagcagagcaccccgaggatcccggtgtgggcgtggtagccagggcggttttccggcgaccaagccgagcgtaggattttcatctttttagcaagcagttcgtgaacaaaagctcgacgatgagttgggcggtccaggtccagatcttatgccgtcccctgaaccgcagcgatctccgaagatggagaagaagagtttgttttgtgggtggattatcactggttttttgttcttgcgtcgcgtaaggtgtactataatctgtcgatatgaaagaaagggagaggcataacagaagctctctcaattttc

SEQ ID NO: 1028 - DNA, 719 bp, Hordeum vulgare
ctcattcctactagtagctgaaaagaaagagaagcattaccagcttgcagaaggaaactacaaccccatcgatctccatggaaatctacggtgacctcgaggccggctgcctcagccactccgtctcgcccatcaagccggcgtcctcgccgaggaagcccgggcctggccggctcttctgcgacccctgcgacgacgccgacgagctcctcggccgccaccactacctggacatctgcttcagctgccggaagctcctcgccgagaacaaagacatcttcatgtacagaggtgacacgcccttctgcagcgaggagtgcaggcaggagcagatcgagatcgacgaggcgagggagaagcggtcgaatcagaccgggagggcggaggagcagcggcagaggcagcagcggaagcagagcaccccgaggatcccggtgtgggcgtggtagccagggcggttttccggcgaccaagccgagcgtaggattttcatctttttagcaagcagttcgtgaacaaaagctcgacgatgagttgggcggtccaggtccagatcttatgccgtcccctgaaccgcagcgatctccgaagatggagaagaagagtttgttttgtgggtggattatcactggttttttgttcttgcgtcgcgtaaggtgtactataatctgtcgatatgaaagaaagggagaggcataacagaagctctctcaattttc

SEQ ID NO: 1029 - DNA, 838 bp, Avena sativa
ctcccacagctgaaaaacaagaacagaaagcaaaaaaaccagtaagccaaagaaggcaccataccagcccaccgatctccatggaagtctacggcgacctggaggccggctgcctcagctactccgcctcgcccgtgaagccggcgtcctcgccgcggaagcccggccgcctgttctgcgacccctgcgacgacgccgaggagctgcacggccaccaccactacctggacatctgcttcagctgccggaagctcctcgccgggaacagggacatcttcatgtacagaggcgacatgcccttctgcagcgaggagtgcaggcaggagcagatcgagatcgacgaggcgagggagaagcggtcgaagcagaccgggagggcggaggagcagcagcggcagcagcagaagcagagcccccacaggatcccggtctgggcgtggtagcagttttcctgcacccaaacgtaggattttttagcagcaagtacgttcaagaacgaaggcgtgatatgagtcgggcagtccagatccggctcgacggcgtgacgaggggagcagcagatccgatcggctgcgtcttgtgatctccgaagatggggacgaagagttgatttttgtttgtgaattaccactgggttttttgttccctttgcacggttgctcgtgacacgatgatgaaaagtgtgtttgcgtgcagccggtgctgcgttcgtgtgtgggggtaattaagtataacaacctgtcgatatggaaaaaaaatgagagatataacagaaattctctcaagttttatcatcagttcatctgaactttcttcttgttttgacagttcgtttcca

SEQ ID NO: 1030 - DNA, 837 bp, Avena sativa
ctcccacagctgaaaaacaagaacagaaagcaaaaaaccagtaagccaaagaagccaccatacccgcccaccgatctccatggaagtctacggcgacctcgaggccggatgcctcagctactccgactcgcccgtgaagccggcgtcctcgccgcggaagcccggccgcctgttctgcgacccctgcgacgacgccgaggagctccacggccaccaccactacctggacatctgcttcagctgccggaagctcctctccgggaacagggacatcttcatgtacagaggcgacatgcccttctgcagcgaggagtgcaggcaggagcagatcgagatcgacgaggcgagggagaagcggtcgaagcagaccgggagggcggaggagcagcagcggcagcagcagaagcagagcccccacaggatcccggtctgggcgtggtagcagttttcctgcacccaaacgtaggattttttagcagcaagtacgttcaagaacgaaggcgtgatatgagtcgggcagtccagatccggctcgacggcgtgacgaggggagcagcagatccgatcggctgcgtcttgtgatctccgaagatggggacgaagagttgatttttgtttgtgaattaccactgggttttttgttccctttgcacggttgctcgtgacacgatgatgaaaagtgtgtttgcgtgcagccggtgctgcgttcgtgtgtgggggtaattaagtataacaacctgtcgatatggaaaaaaaatgagagatataacagaaattctctcaagttttatcatcagttcatctgaactttcttcttgttttgacagttcgtttcca

SEQ ID NO: 1031 - DNA, 825 bp, Avena sativa
ctcccacagctgaaaaacaagaacagaaagcaaaaaaccagcaagccaaagaagccaccgtacccgcccaccgatctccatggaagtctacggcgacctcgaggccggatgcctcagctactccgactcgcccgtgaagccggcgtcctcgccgcggaagcccgggcgcctgttctgcgacccctgcgacgacgccgaggagctccacggccaccaccactacctggacatctgcttcagctgccggaagctcctctccgggaacagggacatcttcatgtacagaggcgacatgcccttctgcagcgaggagtgcaggcaggagcagatcgagatcgacgaggcgagggagaagcggtcgaagcagaccgggcgggcggaggagcagcagcggcagagtcagcagcagaagcagagcccccacaggatcccggtctgggcgtggtagcggttttccggcgcccaaacgtaggattttttagcagcggaaagttcgagaacgaaggcgtgatatgagtcgggcagtccagatccggctcgacggcgtgacgaggggggcagcggatcggctgcatctttgtgatctccgaagatggggacgaagagtcgatttttgtttgtgaattaccactgggttttttgttccctttgcacggttgctcgtgacacgaagataaaaaaaagagtgtgtgtgcgtgcaaacggtgcggcgttcgtgtgtgggggtaattaaggtgtataacaacctgtcgatatggaaaaaaaatgagagatataacagaaattctctcaagttttatcatcagttcatctgaactttcttct

SEQ ID NO: 1032 - DNA, 822 bp, Avena sativa
ccacagctgaaaaacaagaacagaaagcaaaaaaccagcaagccaaagaagccaccgtacccgcccaccgatctccatggaagtctacggcgacctcgaggccggatgcctcagctactccgactcgcccgtgaagccggcgtcctcgccgcggaagcccgggcgcctgttctgcgacccctgcgacgacgccgaggagctccacggccaccaccactacctggacatctgcttcagctgccggaagctcctctccgggaacagggacatcttcatgtacagaggcgacatgcccttctgcagcgaggagtgcaggcaggagcagatcgagatcgacgaggcgagggagaagcggtcgaagcagaccgggcgggcggaggagcagcagcggcagagtcagcagcagaagcagagcccccacaggatcccggtctgggcgtggtagcggttttccggcgcccaaacgtaggattttttagcagcggaaagttcgagaacgaaggcgtgatatgagtcgggcagtccagatccggctcgacggcgtgacgaggggggcagcggatcggctgcatctttgtgatctccgaagatggggacgaagagtcgatttttgtttgtgaattaccactgggttttttgttccctttgcacggttgctcgtgacacgaagataaaaaaaagagtgtgtgtgcgtgcaaacggtgcggcgttcgtgtgtgggggtaattaaggtgtataacaacctgtcgatatggaaaaaaaatgagagatataacagaaattctctcaagttttatcatcagttcatctgaactttcttct

SEQ ID NO: 1033 - DNA, 838 bp, Brachypodium distachyon
catcactccgtttggtcattcccagctgaaaaagaagagaaagcatagcaattcgccaaagaaacaaccaccaccacccgatctccatggaagtctacggtgacctcgaggccggctgcctcagccactccgcctcgcccctgaagccggcatcctcgtcgaggaagcccgtccgcttgttctgcgacccgtgcgacgacaccgacgatctcctcggccaccgccactaccttgacatctgctgcagctgccggaagctcatcgccggaaacagagacatcttcatgtacagaggtgacatgcccttctgtagcgaggagtgcaggcaggagcagatcgagatcgacgaggcgagggagaagaggtcgaagcagacggggagggcggaggagcagcggcagagacagcagaagcagagcccccagaggatcccggtctgggcgtggtagtaagaaattttggccaccgaaaacgtaggatttagcagcagttcaaggaggaaagcttggtgagctgggttagcccagatccacgcttccgtcgtcagttcgactggcggcgacaatcggcaggagggtgggcggcaaatcgtctgtggccttttgtatcccaaagtccaataggctggctcttccttttgatctccgaagatggagagatgaagagtcaatcttgtgtctgaattatccccggtttttattttgttcctttgcacactattgcacttttgcaccaaaatgaaaagtgcgtgtgggggtgcatccggtgtcgcgtaaggtgtataacctgttgatatgaaagaaatgagaggcataacagaaagttctctcaagtttct

SEQ ID NO: 1034 - DNA, 989 bp, Saccharum officinarum
tgactctttatcacgcttaccgtgttgaaccgagctccttccgccgtctccgcaccgcaggcccccgtctccggctctcggctcacctctagtcgctccttccgccggcgagtggccgtcgctgcaacgaggagaagagagcggagatgggcgacgagcgggtgaaggcggaggcgctgcagatcctgggcctcttccaggtgcttccccgcctcgtcgttttcgacctcgactacaccctctggcccttctactgcgagtgccggtccaagagggattcgccgagccttttcaggcacgccaggggcatcatgtacgccctcaaggagaaggggatcgacatggcgattgcgtctcgctcgcccaccccggacatagccaaggtgttcctcgacaagttggagctccagtccatgttcgtcgcccaagaaatattctccagctggactcacaagactgagcatttccaaaagatccagaggaaaactggaattccctacaaatccatgcttttctttgatgacgaggacaggaatattgatccggtatcaaatttgggggtgacgagtgttttagtagagaacggggtgaaccttgacatgtttaagctgggtctcagtaactttgcaactaactatgctgcctccagcagaaaggaagacaaataacctcgacgagaagtgatacattcgaagaaaataccctcaaaacattgtacttgaatttcctgtaatcaattgcccctattcatggacaatttgttgctgaaggatgacctcacaaactagctattgaactgatgcaacgcttgtctaatatttatttgaaggcaaagcatcgcgtgtctttatttcatgtgccaaaacaatatattggagcatctgttttgttttattttgtgtcagaatggtggccctatgggatatttatagtcgccataggtcatttcatagctgggctgcggtatttgtaagcaaaagatggagtgg

SEQ ID NO: 1035 - DNA, 832 bp, Panicum virgatum
gggcgccgtctcccctagccgctccgcccgccggcgagtggccgtcgccgcagcaaggagaggagagtggcgatgggggacgagcgggtgaaggcggaggcgctgcagatcctgggcctcttccaggtgctcccccgcctcgtcgtctttgaccttgactacaccctgtggcccttctactgcgagtgccggtcgaagagggattcacccagcctcttccggcatgccaggggcatcatgtacgccctcaaggagaaggggatcgacatggcgattgcttctcgctcgcccaccccggacatagccaaggtgttcatcgacaagttggagctccagtccatgttcgtcgcccaagaaatattctccagctggactcacaagaccgagcatttccaaaagatccagaggaaaactgggattccatacaagtccatgcttttctttgatgatgaggacaggaatattcaaacagtatcaaaaatgggagtaacgagtgttctagtagagaacggagtgaacctcgacatgtttaagttgggtctcagtaactttgcaactaactttgccgcttccagcagaaagcaagacgagtagcctcaaggaaaaagcaatacattctccaaaaagaaccttcgagacattatacctgagtttcttataatcatcaattgctactattcatgaacattattttgagtaaggatggcctcggaaactaactactgtactgatgcagcaactatctaatgtatgtttgaagcaaagcactgcatgtatttattttacccactcaattgatgtatttgtgcatttgtgattgattacgtgctgt

SEQ ID NO: 1036 - DNA, 870 bp, Zea mays
acgcgtttcggccgatcttgtccgcggtctgcctccctgacttttgttggcgctagccgtgtcgaaccgaaagtcccaagtcccacccaccaaacccaacacatcgtgtctgcgttctccccctttacgccggcgagtgttcgtcgctggctcgctgcagcggggagaatagaggcagagagcagggatgagcgacgagcgggtgaaggcggaggcgctgcagatcctgggcctattccaggtgctcccccgcctcgtcgtcttcgacctcgactataccctctggcccttctactgcgagtgccggtccaagagggattcgccgagccttttcaggcacgccaggggcatcatgtacgccctcaaggagaaggggatcgacatggcgattgcttctcgctcccccaccccggacatagccaaggtgttcctcgacaagttggagttccagtccatgttcgtcgcccaagaaatattctccagctggactcacaagactgagcatttccaaaagatccagaggaaaactgggattccctacaaatccatgctgttctttgatgacgagaacaggaatattgaagcagtatcaaaaatgggagtgacgagtgttttagtagagaacggggtgaaccttgacatgtttaagctgggtctcagtaactttgcaactaactgtgctgcctccagcagaaaggatgacgaataacctcgagaagtgatacatagaagaaaataccttcaaaacactgtactcgaattcattgtaatcaatttgcccgattcatgaacaatttattggtgaaagatgacctcacagactagcttttgaactgatgcaacgcctgtctaatatatttatttgaaggc

SEQ ID NO: 1037 - DNA, 958 bp, Panicum virgatum
gttgtcgacttgccttgtcgaaccgtccaggtccaggtccagccgtccaggtcaggggcgccgtctcccctagccgctcctcccgccggcgagaggccgtcgccgcagcaaggagaggagagcagcgatgggcgacgagcgggtaaaggcggaggcactgcagatcctgggcctcttccaggtgctcccccgcctcgtcgttttcgaccttgactacaccctgtggcccttctactgcgagtgccggtcgaagagggattcgcccagcctcttccggcatgccaggggcatcatgtacgccctcaaggagaagggggtcgacatggcaattgcgtctcgctcgcccaccccggacatagccaaggtgttcatcgacaagttggagctccagtccatgttcgtcgcccaagaaatattctccagctggacacataagactgagcatttccaaaagatccagaggaaaactgggattccctacaagtctatgcttttctttgatgatgaggacaggaatattaaaacggtatcaaaaatgggagtgacgagtgttctagtagagaacggagtgaacctcgacatgtttaagttgggtctcagtaactttgcaagtaactttgctgcctccagcagaaagcaagacgagtagccttgaaaaggaaaaagcaatacattctccaaaaaaaacctttggaacgttgtacccgaatttcttataatcaattgcccctattcatgaacattgttttgaggaaggatggcctcagaaactagctagtgtgctgatgcagcaactatctaatgtatgtttgaagcaaagcactgcatgtatttattttacccactcagttgatgtatttgtgcatttttgattgattacgtgctgtaccagaattttcatgtgccctactgtaaatcacacctgtacatttttcattttaaatttcgtgtttcagtg

SEQ ID NO: 1038 - DNA, 740 bp, Pennisetum glaucum
gcttctcctcccggcggcgagtaaccgtcgccgcagcaaggagaggagagcagcgatgggcgacgaccgggtgaaggcggaggcgctgcagatcctgggcctcttccaggtgctcccccgcctcgtcgtcttcgacctcgactacaccctctggccattctactgcgagtgccggtcgaagagggattcgccgagcctcttccggcacgccaggggcatcatgtacgccctcaaggagaagggggtcgacatggcgattgcttctcggtcgcccaccccggacatagctaaggtgttcatcgacaagttggagctccagtccatgttcgtcgcccaagaaatattctccagctggactcacaagaccgagcatttccaaaagatccataggaaaactggaattccctacaagtccatgcttttctttgatgatgagagcaggaatattgaaacggtatcaaaaatgggagtgacgagtgttctagtagagaacggagtgaatcttgacatgttcaagttgggcctcagtaactttgcaagtaactttgctgcctccagcagaaaccaagacgagtagcctcaaggaaaaagcaaagccttaaaaaaacctttgaagtattatacttgaatttcttgaaatcaactgcccttattcatgaccaacattttgagaaaggatgacctcgggaactagctactgaactgatggtgtgattgtctgatatttatttgaagcaaag

SEQ ID NO: 1039 - DNA, 970 bp, Oryza sativa
aaaaataaaaaaaattcgatcttttggtgctacccactacccagacgagccgatctctcgcgagccctcctccagtcatccatccgagccgcagcgacgagccgagccgccgcgacgccgccggcgagcgcctgctccgccgccgcccgccgccgcagatgggggacgagcgcgtgaaggcggaggcgctgcagatcctggggctgttccaggcgctcccgcgcctcgtcgtcttcgacctcgactacaccctctggcccttctactgcgagtgccgctccaagagggagtcgccgagcctctaccggcacgccaagggcatcatgttcgccctcagggagaaggggatcgacatggcgattgcgtcccgctcccccaccccggacatagccaaggtgttcattgacaagctggagatcaagtccatgttcgttgcccaggaaatattctccagctggactcacaagacagagcatttccaaaagattcagaggaagactgggattccttacaaatccatgcttttctttgatgacgaggacagaaatattgaatcgatatcaaaaatgggagtgacgagcgtgctggtggagaacggggtgaatcttgacatgtttaagttgggtctgagtaactttgccacaaatgttgctgcctcgagcacaagtaaagatgaatagcctcattgaacgactagaaccaacagacaagaaaaacatataaatttaagttaagcatgcatttcttgtaatttatattgcccttgctcatgtacgagatggagtatttgagtacaggataacttctgagagcaagtctttgcttcatttatgtggatgttacgattcgatcgaatcagatgaatttgattcgatcggtgaattgagtcatactgaattaacttaaatgtatattcaatgtttggcttgacattatgggttcaaatgtgacgttgccattggccggtgtc

SEQ ID NO: 1040 - DNA, 786 bp, Setaria italica
tgctcccgccggcgagtgaccgctgcctcagcaaggagaggagagcggcgatgggcgacgagcgggtcaaggcggaggcgctgcagatcctgggcctcttccaggtgctcccccgcctcgtcgtcttcgacctcgactacaccctctggccattctactgcgagtgccggtcgaagagggattcgccgagcctcttccggcatgccaggggcatcatgtacgccctcaaggagaaggggatcgacatggcgattgcgtctcgctcgcccaccccggacatagccaaggtgttcatcgacaagctggagctccagtccatgttcgtcgcccaagaaatattctccagttggactcacaagaccgagcatttccaaaagatccagaggaaaactgggattccctacaagtccatgcttttctttgatgatgaggacaggaatattgaaacggtatcaaaaatgggagtgacaagtgttctagtagagaacggagtgaatcttgacatgtttaagttgggtctcagtaactttgcaacaaactttgccgcctccagcagaaaccaagacgagaagcctcaaggagaaagcaaagccttcaaaaaagaactttgaaacattatacttgaatttcttgtaatcaattgcccttattcatgaataatattttgagaaaggatgacctcggaaactagctactgaactgatgcagtgattgtctgatttttatttgaagcaaagcaccgtgtgtctttattacgtactcaattgatgtatttgtgcacttgtg

SEQ ID NO: 1041 - DNA, 905 bp, Avena sativa
ccggacacgccgttgaaccgggcgaccaatccctcccagccaccaccggctgaccgccgccaccgcggaaggaggagcaggagccagtagaggagtcgggaactcgggatgggcgacgagcgcgtgaaggcggaggcgctgcagatcctgggcctcttccaggtgctcccccgcctcgtcgtcttcgacctcgactacaccctatggcccttctactgcgagtgccgctccaagagggagtcgccgagcctgtaccggcacgccaagggcatcatgtgcgcgctcaaggagaagggggtcgacatggcgattgcgtctcgctcccctacctccgacatcgcaagggtttttattgacaagctggagctccagcccatgttcgttgcccaggaaatatactccagctggactcacaagacggagcatttccaaaagatccagagaaaaactggggttccatacaagtctatgctcttctttgatgacgaggacaggaatattgaatcggtatcaaaaatgggagttacaagtgttctggtggacaacggagtgaatcttgacatgtttaagttgggccttagtaacttcgctactgctgctgctgcagcagcaccacaggacaagtaaccttactgtacaagtagaaacgacaacgacggacttatggcttatgaatatacttatggaaaagaaacttgtattttttgtgattgattgccttgcttgtgaactgtagagtaaggatgagttgggaaagtatggaactgcagggtagcctggttcattgttataggaaataaatttggaaccattagactgacactgctacaaattgttggccttgggcgacttatgttgtatgttcctgaatcgctgcattttgaatatgttgctctttccacatc

SEQ ID NO: 1042 - DNA, 837 bp, Avena sativa
ccggacacgccgttgaaccgggcgaccaatccctccccagccaccaccggctgaccgccgccaccgcggaaggaggagcaggagccagtagaggagtcgggaactcgggatgggcgacgagcgcgtgaaggcggaggcgctgcagatcctgggcctcttccaggtgctcccccgcctcgtcgtcttcgacctcgactacaccctatggcccttctactgcgagtgccgctccaagagggagtcgccgagcctgtaccggcacgccaagggcatcatgtgcgcgctcaaggagaagggggtcgacatggcgattgcgtctcgctcccctacctccgacatcgcaagggtttttattgacaagctggagctccagcccatgttcgttgcccaggaaatatactccagctggactcacaagacggagcatttccaaaagatccagagaaaaactggggttccatacaagtctatgctcttctttgatgacgaggacaggaatattgaatcggtatcaaaaatgggagttacaagtgttctagtggacaacggagtgaatcttgacatgtttaagttgggccttagtaacttcgctactgctgccgctgctgcagcagcaccacaggacaagtaaccttactgtacaagtagaaacgacatacgacgaacttgtggcttatgaatatacttatggaaaagaaacttgtattttttgtgattgattgccttgctcgtgaactgtagagtaaagatgagttgggaaagtatggaactgcagggtagcctggttcattgtaataggaaataaatttggaaccattagactggcagtgctacagt

SEQ ID NO: 1043 - DNA, 881 bp, Triticum aestivum
acctgccccagccgaacgccgttgaaccgggcgaccaatccctccctgccgccggcgagcaatctccgccaccgccgccgccgcagcagcagcagaagcagctcggccgtccgggatgggcgacgagcgcgtgaaggcggaggcgctgcagatcctgggcctgttccaggtgctcccgcgcctcgtcgtcttcgacctcgactacaccctgtggcccttctactgcgagtgccgctccaagagggagtcgcccagcctgtaccgccacgccaagggcatcatctgcgcgctcaaggagaagggggtcgacatggccattgcgtcgcgctcgcccacctccgacatcgccagggtcttcatcgacaagctcgagctccagcccatgttcgtcgcacaggaaatattctccagctggactcacaagacagagcatttccaaaagatccacagaaaaactggggttccatacaagtccatgctgttctttgacgatgaggacaggaatattcaatcggtatcgaaaatgggagttacgagtgttctagtaaacaacggattgaatctcgacatgtttaagttgggcctcagtaatttcgctactactgttgctgcatctgaacccgcacctgcaccagaggacaattaaccttatattgtacaagtaaaaacagcagacagggaaaacgcccatgatttacggatacttgtgaaaaataaacctgtatttcttgtagttgattgcccttgctcatgggcagtaaagcaaggatgactactgctgaaaccattctgtgtgtaagtttgtgttacttgagtgcgttccttgtgaaaggaaatgaatttggaaccatttgattgacgatgttatagattgtttggcc

SEQ ID NO: 1044 - DNA, 919 bp, Brachypodium distachyon
actccgttgaaccgagcgaccaatccggcctgaccaaccggcgagagaccgcaggagcaggcgagcagcatcagccaggagagggcgggatgggcgacgagcgcgtgaaggcggaggcgctgcagatcctgggcctcttccaggtgctaccccgcctcgtcgtcttcgacctcgactacaccctatggcccttctactgcgagtgccgctccaagagggagtcgccgagcctttatcggcacgccaagggcatcgtgtgcgcgctcaaggagaaaggggtcgacatggcgattgcgtctcgctcgcccactccggacatagccacggccttcattggcaagctagagctccagcccatgttcgtcacacaggaaatattctccagctggactcacaagacagagcatttccaaaagatccagagaaaaaccggggttccctacaagtccatgctcttctttgatgacgaggacagaaatattgaatcggtatcaaaaatgggagttacaagtgttctggtggaaaatggattgaatcttgacatgtttaaattgggcctcagtaactttgctagtaatgttgctgccactcaagacaagtagagacatcacacaaaggaaaaagtttatgaatactcgtgaaacattgaacttgtatttattgcataattgattgcccttgctcatgagcagtatttgtgtaatgatgacttcagaaagtaggaaactgtggcaattgttgttcagaaatagtttccaatccttgtcaatggaaaacaataaagttggaaacccttgattggtactgctgtgatgttggccaacatatgctggacgctcccatttctcctttggatttagttacgctgtactttacacaaacagcggtacctaattttctttaacggaagaacagtact

SEQ ID NO: 1045 - DNA, 871 bp, Triticum aestivum
acctgccccagccgaacgccgttgaaccgggcgaccaatccctccctgccgccggcgagcaatctccgccacggccgccgcagcagcagcgaggagaggaggaggggtccggccggccgggatgggcgacgagcgcgtgaaggcggaggcgctgcagatcctgggcctgttccaggtgctcccccgcctcgtcgtcttcgacctcgactacaccctgtggcccttctactgcgagtgccgctccaagagggagtcgcccagcctgtaccgccacgccaagggcatcatgtgcgcgctcaaggagaagggggtcgacatggccattgcgtcgcgctcgcccacctccgatatcgccagggtcttcattgacaagctcgagctccagcccatgttcgtcgcacaggaaatattctccagctggactcacaagacggagcatttccaaaagatccacagaaaaactggggttccgtacaagtccatgctgttctttgacgacgaggacaggaatattcaatcggtatcgaaaatgggagttacaagtgttctagtaaacaacggattgaatctcgacatgtttaagttgggcctcagtaatttcgctactactgttgctgcacctgaacccacacctgcaccagaggacaagtaaaccttattgtacaagtaaaaacagcagacggggaaaacgcccatgatttacggatacttgtgaaaaataaacatgtatttcttgtagttgattgcccttgctcctgggcagtaaagcagggatgactactgctgaaaccattctgtgtgtaagcttgtgttacttaagtgcgttccttgtgaaaggaaattaatttggaaccatttgattgacgatgtt

SEQ ID NO: 1046 - DNA, 921 bp, Triticum aestivum
cctgccccagccgagcgccgttgaaccgggcgaccaatccctccctgccgccggcgagcaatctccgccacggccgccgcagcagcagcgaggagaggaggaggggtccggccgtccgggatgggcgacgagcgcgtgaaggcggaggcgctgcagatcctgggcctgttccaggtgctcccccgcctcgtcgtcttcgacctcgactacaccctgtggcccttctactgcgagtgccgctcgaagagggagtcgcccagcctgtaccgccacgccaagggcatcatgtgcgcgctcaaggagaagggggtcgacatggccattgcgtcgcgctcgcccacctccgacatcgccagggtcttcattgacaagctcgagctccagcccatgttcgtcgcacaggaaatattctccagctggactcacaagacggagcatttccaaaagatccacagaaaaactggggttccgtacaagtccatgctgttctttgacgacgaggacaggaatattcaatcggtatcgaaaatgggagttactagtgttctggtaaacaacgggttgaatctcgacatgtttaagttgggcctcagtaattttgctactactgctgctgcacctgaacccgcacctgcaccagaggacaagtaaccttatattgtacaagtaaaaacagcagacagggaaaacgcccatgatttacggatacttgtgaaaaataagcctgtatttcttgtagttgattgcccttgctcatgggcagtaaagcaaggatgactactactgaaaccattctgtgtgtaagcttgtgttacttgtgaaagtgcgttccttgtgaaaggaaatgaatttggaaccatttggttgacgatgttaagattgtttggccacctttgctgaatgctcatttatcgttacatt

SEQ ID NO: 1047 - DNA, 944 bp, Triticum aestivum
accggccccagctttggctcggaaaaaaaaaaaaaaaacctgccccagccgagcgccgttgaaccgggcgaccaatccctccctgccgccggcgagcaatctccgccacggccgccgcagcagcagcgaggagaggaggaggggtccggccgtccgggatgggcgacgagcgcgtgaaggcggaggcgctgcagatcctgggcctgttccaggtgctcccccgcctcgtcgtcttcgacctcgactacaccctgtggcccttctactgcgagtgccgctccaagagggagtcgcccagcctgtaccgccacgccaagggcatcatgtgcgcgctcaaggagaagggggtcgacatggccattgcgtcgcgctcgcccacctccgacatcgccagggtcttcattgacaagctcgagctccagcccatgttcgtcgcacaggaaatattctccagctggactcacaagacggagcatttccaaaagatccacagaaaaactggggttccgtacaagtccatgctgttctttgacgacgaggacaggaatattcaatcggtatcgaaaatgggagttactagtgttctggtaaacaacggattgaatctcgacatgtttaagttgggcctcagtaatttcgctactactgttgctgcacctgaacccgcacctgcaccagaggacaagtaaccttatattgtacaagtaaaaacagcagacagggaaaacgcccatgatttacggatacttgtgaaaaataagcctgtatttcttgtagttgattgcccttgctcatgggcagtaaagcaaggatgactactactgaaaccattctgtgtgtaagcttgtgttacttggaaagtgcgttccttgtgaaaggaaatgaatttggaaccatttggttgacgatgttaaagattgtttggccaacttttgctgaatgct

SEQ ID NO: 1048 - DNA, 919 bp, Hordeum vulgare
gtcgtcgtcgccatatcctttctttgtacctgccccgccgttgaaccgggcgagcaatcccctccctgccgccggcgagcaatccccgccaccaccaccgcagcagcagcagcagaagaagcagtgccggacgtccgggatgggagacgagcgggtgaaggcggaggcgctgcagatcctgggcctgttccaggtgctcccccgcctcgtcgtcttcgacctcgactacacgctgtggcccttctactgcgagtgccgctccaagagggagtcgccgagcctgtaccgccacgccaagggcatcatgtgcgcgctcaaggagaagggggtcgacatggccatcgcgtcgcgctcgcccacctccgacatcgccagggccttcatcgacaagctcgagctccagcccatgttcgtcgcgcaggaaatattctccagctggactcacaagacagaacatttccaaaagatccacagaaaaactggggttccctacaagtctatgctcttctttgacgatgaaaacaggaatattcaatcggtatcaaaaatgggagttactagtgttttggtagacaacggattgaatcttgacatgttcaagttgggcctcagtaatttcgctactactgttgttgcacctgcaccagcaccagagaacaagtaaccttattgtataagtagaaacaacagacgggggaaacaccaatgactcatggataattgtgaaaaaaataaacttgtatttcttgtaatcgattgctcataggcagtagcgtaaggatgactattttggtaagttagggaactgctactgctgaaaccattctgcgtgtaagcttgttatacttgattggcaatgttgaagattgtttagccaacttttgttgaatgcttattgatcgccacattttgaatatat

SEQ ID NO: 1049 - DNA, 1031 bp, Triticum aestivum
tgacggccgagcggccgcgcattcctggcctctcgtccgtccatcttctcgctaacccaccgacgtacctctctatccacccagctccccgcggatattttctcctcacaaacatctcgctgccggggcaggccaccgtcgcgcgcggcataatagcacggcgctttcagcctcctcctccaccaccggcaccgcccgcgcaattaacaccaccgctaacgagcgcggccgcggcataacaatacacaccaccagtacgctctggcagcagtagcatcggccggcgcgcttgtgcggagaggtggatcgatcgacatgtcgaggccgagcaggagcgacgcgcacctgtccccggtggacgaggcggtgagggtggacgaggtgcgggggtactacgacggcgcggcgcccaagcgccactccaagccttcccgcagcgaccactccgccgtgtacaccgacgcgctcgccggccccggcgccgacggctcccaccccgagctcgacaagttccaggacctcgaagcccactccgagaaactggtgtgcgagggcgggaaggcgggcgaggagttcgtggagacggagtactacaaggacctcggctgcgtcggcaagcagcatcacacgactgggacgggcttcatcaaggtggacaggcccgccggcgcctcgttcgagctctcggaagacccggatgcgacggagcgccatgcttcctccaaggggaaccccgccacaaacgagtggatctcgtcagcggacacggtgtatcaggaggagtcagacaagcccaacagaagcgacagctgagccgggcaatggtctacagactacagccaaacatcatacatcagatgcgtgtgtcttccggttaaatcggctattaaaaaattaagggcgcgtattcgtgtatttgttattgggattcttgtgaggttctatctactctacttgtcaaactcgtgggtcgttttgggagcctgtgttgtggaactgaatgaagtacaggaaataaatcagaagtatgt

SEQ ID NO: 1050 - DNA, 1044 bp, Triticum aestivum
tgacggccgagcggccgcgcattcctggcctctcgtccgtccatcttctcgctaacccaccgacgtacctctctatccacccagctccccgcggatattttctcctcacaaacatctcgctgccggggcaggccaccgtcgcgcgcggcataatagcacggcgctttcagcctcctcctccaccaccggcaccgcccgcgcaattaacaccaccgctaacgagcgcggccgcggcataacaatacacaccaccagtacgctctggcagcagtagcatcggccggcgcgcttgtgcggagaggtggatcgatcgacatgtcgaggccgagcaggagcgacgcgcacctgtccccggtggacgaggcggtgagggtggacgaggtgcgggggtactacgacggcgcggcgcccaagcgccactccaagccttcccgcagcgaccactccgccgtgtacaccgacgcgctcgccggccccggcgccgacggctcccaccccgagctcgacaagttccaggacctcgaagcccactccgagaaactggtgtgcgagggcgggaaggcgggcgaggagttcgtggagacggagtactacaaggacctcggctgcgtcggcaagcagcatcacacgactgggacgggcttcatcaaggtggacaggcccgccggcgcctcgttcgagctctcggaagacccggatgcgacggagcgccatgcttcctccaaggggaaccccgccacaaacgagtggatctcgtcagcggacacggtgtatcaggaggagtcagacaagcccaacagaagcgacagctgagccgggcaatggtctacagactacagccaaacatcatacatcagatgcgtgtgtcttccggttaaatcggctattaaaaaattaagggcgcgtattcgtgtatttgttattgggattcttgtgaggttctatctactctacttgtcaaactcgtgggtcgttttgggagcctgtgttgtggaactgaatgaagtacaggaaataaatcagaagtatgttcagtttgtgtta

SEQ ID NO: 1051 - DNA, 843 bp, Triticum aestivum
ccgcccgcgcaattaacaccaccgctaacgagcgtggccacggccacggcctagcaatacacaccaccagtacgctccggcagcagtagcatcggccggcgcgcttgtgcggagaggtcggtcgagcgacatgtcgaggccgagcaggagcgacgcgcacctgtccccggtggacgaggcggtgagggtggacgaggtgcgggggtactatgacggcgcggcgcccaagcgccactccaagccctcccgcagcgaccactccgccgtgtacaccgacgcgctcgccggccccggcgccgacggctcccaccccgagctcgacaagttccaggacctggaagcccactccgagaaactggtgtgcgagggcgggaaggcgggcgaggagttcgtggagacggagtactacaaggacctcggctgcgtcggcaagcagcatcacacggccgctgagctgaatcgtggtcgatggacgtggtgcagactggcacgggcttcatcaaggtggacaggcccgccggcgcctcgttcgagctctccgaggacccggatgcgacggagcgccatgcttcctccaagggaaaccccgccacaaacgagtggatcccgtcagctgacacggtgtatcaggaggagtcagacaagcccaacagaagcgacagctgagccgggcaatggtctacactctacagccaacatgatcagatgcgtgtgacctccggttaaatcggctattaaaaaaattaagggcgcgtattcgtgtatatctgccatttgttattgcgattcttgtgaggttctatctactacttgtcaaactcgtgggtcgttttgggagcctgt

SEQ ID NO: 1052 - DNA, 894 bp, Avena sativa
cgctttcgatcggcctccgccaccggcacgcaaccgcgctgaatcaataccgccgctaacgagcgctgccgctgccgcgcgaggaataactataacgcggcaggcacaagtacaagtagccgtagccgtagccgtagcatcggcgcgatcgagctggtgagtggagacatcgtcaatgtcgaggccgagcaggagcgacgctcacctgtcccccgtggacgaggcgatgcgggtggccgaggtgcgggagtactacgacgacgccgcgcccaagcgccacaccaagccctcccgcagcgagcactccgccgtctacaccgacgacgcgctcgtcgactcctcccacccggagctcgacaagctccacgagctcgaagcccacaccgagaaactggtgtgcgagggcggcaaggcgggggaggagttcgtggagacggagtactacaaggacctcggcggcgtcgacaagcagcaccacacgaccgggacgggcttcatcaagatggacaagcccaccggcgcctcgttcgagctctccgaggacccggacgcatcggagcgccacgcttcctgcaaaggaaatcctgccaccaacgagtggatcccgtcggccgacacggtgtatgaggcgtcagacaagcccaacagaagcgacagctgagctgaggaacagacatcagaagcggtgtatgatttccactggcaccaaagaagaaaccactcccgtcaaattggttggtcgctcacaaattaaggacgcgtatacgtgtctttcctattcgtcgttcagatttgagattcttgtggcattgtactcgtaaagcttgtgcatcgatttggaaaccgctgtgttgtggaagtgaactgcaggaaataaagcagaagttgctgatg

SEQ ID NO: 1053 - DNA, 869 bp, Avena sativa
cgctttcgatcggcctccgccaccggcacgcaaccgcgctgaatcaataccgccgctaacgagcgctgccgctgccgcgcgaggaataactataacgcggcaggcacaagtacaagtagccgtagccgtagccgtagcatcggcgcgatcgagctggtgagtggagacatcgtcaatgtcgaggccgagcaggagcgacgctcacctgtcccccgtggacgaggcgatgcgggtggccgaggtgcgggagtactacgacgacgccgcgcccaagcgccacaccaagccctcccgcagcgagcactccgccgtctacaccgacgacgcgctcgtcgactcctcccacccggagctcgacaagctccacgagctcgaagcccacaccgagaaactggtgtgcgagggcggcaaggcgggggaggagttcgtggagacggagtactacaaggacctcggcggcgtcgacaagcagcaccacacgaccgggacgggcttcatcaagatggacaagcccaccggcgcctcgttcgagctctccgaggacccggacgcatcggagcgccacgcttcctgcaaaggaaatcctgccaccaacgagtggatcccgtcggccgacacggtgtatgaggcgtcagacaagcccaacaggagcgacagctgagctgaggaatgatctacagccatcagatgcagcgtctgatttccactccggtcaattggtcgcaagcaaattaaggacgcgtatacgtgtctttcctattcgtcgttcagatttgagattcttgtggcattgtactcgtaaagcttgtgcatcgatttggaaaccgctgtgttgtggaagtgaactgcaggaaataaagcagaagttg

SEQ ID NO: 1054 - DNA, 735 bp, Brachypodium distachyon
gagagcgatcgagatgtcgaggccgagcaggagcgacgcgcacctgtcccccgtggacgaggcgacgagggtggccgaggtgcgggagtactacgacgacgcggcgcccaagcgccacaccaaaccttcccgcagcgagcactccgccgtctacgccgacgcgctcgccgacgactcccacccggagctcgacaagctccagcagctcgaagcccacaccgggaaattggtttgcgagggcggcaaggcgggagaggagttcgtggagacggagtactacagggatctcggctgcgtcggcaagcagcaccacacgactgggactggtttcatcaagatggacaagcctactggcgcctcgtttgagctctccgacgacccggatgcaaccgagcgccacgcctcttgcaaaggaaatcctgccacaaacgagtggatcccttcagctgacacggtgtatctggcgtcagacaagcccagcagaagcgacagctgagaactgatctgaaacatccgatgtgtatgactatgctttctaccagcaaagatgaaaccactatggttaaattgggtattcacaaattaaggacgcatatgtgtgtctttgcaattcgattattcgttattgagattcttgtgaggtttgtatttctaagacttgtgcatcgctttggaagcctgtgttctacaaatgagtactggaaataaagcagagaagctgcctttacattatct

SEQ ID NO: 1055 - DNA, 1586 bp, Zea mays
caaatcgcgctgtaggttccctacagcctttcccctgaaaaaaaaattaccccccggacctcctcctccgatcggcttcctcctcccagtcccgaaccgcacgcgctcgatttcccgcaccccctctagcctctagcggccatgtcgcccgccgccgccaccacaaccttcgtcgcaatctccatcgccgtccccaaccctaccgctccatcccgcggtcgcgtgcgccttccgctaggcggggtccccgctgctccacgccgcgccgtcgcctctatggcagtgtccgcccccaggtccggcgccgccacctcgtttctcgagcgccgcgagtcggagcgcgctctccactttgtcaaataccagggcctcggcaacgacttcataatggtggacaacagggattcgtcggtgccgaaggtgacgcccgaggaggctgcgaagctgtgcgaccgaaacttcggcattggcgccgacggtgttatcttcgtcatgccgggggtcaatggtgccgactacaccatgagaatcttcaactctgatggcagcgaaccagagatgtgtggtaatggagtccgttgcttcgctcggtttatagccgagattgaaaatctgcaggggacaaatagattcactattcatactggtgctggaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaaattgggcctaaatttgagcatcatgaaatgtttcctgctcgcacaaacacagaattcgtacaggttttgtctcgctcacacctcaaaatgcgggtctgggaacgtggtgctggagcaactcttgcctgtggtactggtgcttgtgcagtggttgttgcagctgttcttgagggtcgagctgagcggaaatgtgtagttgatttgcctggcgggccattggaaattgagtggagggaggatgacaatcatgtttacatgactggtcctgcagaggtcgtcttttatggatctgttgttcactaggtactggggaccaagatagaagggttggctgccactcagagcttgtgagattggttatagtatccatgaaacagagtgttctggtaccagtacacttgttcagatattcttaattatgattgcttgatttgggtagcagtagaggcttccttttgaagcattctagtgttcaccttttgtactcctttagtttgtcaggtttgaacactacatgggtaacatgtctttcccaccattttctgtttcttttctttgtaagtgaacgccaatgcagttttagtattgttttctatagatttgtcttgatgcactgggcttactacttattttctggtatgaatgctgcctatttcctgaaaatcgcaatcatctaaagtgcttct

SEQ ID NO: 1056 - DNA, 1563 bp, Zea mays
caaatcgcgctgtaggttccctacagcctttcccctgaaaaaaaaattaccccccggacctcctcctccgatcggcttcctcctcccagtcccgaaccgcacgcgctcgatttcccgcaccccctctagcctctagcggccatgtcgcccgccgccgccaccacaaccttcgtcgcaatctccatcgccgtccccaaccctaccgctccatcccgcggtcgcgtgcgccttccgctaggcggggtccccgctgctccacgccgcgccgtcgcctctatggcagtgtccgcccccaggtccggcgccgccacctcgtttctcgagcgccgcgagtcggagcgcgctctccactttgtcaaataccagggcctcggcaacgacttcataatggtggacaacagggattcgtcggtgccgaaggtgacgcccgaggaggctgcgaagctgtgcgaccgaaacttcggcattggcgccgacggtgttatcttcgtcatgccgggggtcaatggtgccgactacaccatgagaatcttcaactctgatggcagcgaaccagagatgtgtggtaatggagtccgttgcttcgctcggtttatagccgagattgaaaatctgcaggggacaaatagattcactattcatactggtgctggaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaaattgggcctaaatttgagcatcatgaaatgtttcctgctcgcacaaacacagaattcgtacaggttttgtctcgctcacacctcaaaatgcgggtctgggaacgtggtgctggagcaactcttgcctgtggtactggtgcttgtgcagtggttgttgcagctgttcttgagggtcgagctgagcggaaatgtgtagttgatttgcctggcgggccattggaaattgagtggagggaggatgacaatcatgtttacatgactggtcctgcagaggtcgtcttttatggatctgttgttcactaggtactggggaccaagatagaagggttggctgccactcagagcttgtgagattggttatagtatccatgaaacagagtgttctggtaccagtacacttgttcagatattcttaattatgattgcttgatttgggtagcagtagaggcttccttttgaagcattctagtgttcaccttttgtactcctttagtttgtcaggtttgaacactacatgggtaacatgtctttcccaccattttctgtttcttttctttgtaagtgaacgccaatgcagttttagtattgttttctatagatttgtcttgatgcactgggcttactacttattttctggtatgaatgctgcctatttcctgaaaa

SEQ ID NO: 1057 - DNA, 1495 bp, Zea mays
taaaaacaaaaaattcaggtttatgtaccggtgacagcgaccgcgacaggtcctctcccccggaccgcacccgctgtagccgccatgtcgtccgccgccgccacagcctttgccggagtctccgtcgccaccccgaacctcaccactccatttcgcggtcgcgtgcgccttccgctacgcggggtctccgctgccccacgccgcgccgtcgcttcgatggccgtgtccgcccccaggtccggcgccgccgcctcgttcctggagcgccgcgagtccgagcgcgctctccacttcgtcaagtaccagggcctcggcaatgacttcattatggtggacaacagggattcgtcggtgccgaaggtgacgccggaggaggccgcgaagctgtgcgaccgaaacttcggcattggtgccgacggcgtcatcttcgtcatgccaggggtcaatgatgccgactacaccatgaggatcttcaactctgacggcagcgagccagagatgtgtggtaatggagtccgttgctttgctcggtttataggcgaacttgaaaatctgcaggggacacatagcttcactattcatactggtgctgggaagatcattcctgaaatacaaagtgatgggcaggtaaaggttgatatgggagagcccatcctttctggagcagacatccccacaaaactggtagctaccaagaacaaagctgttatccaagctgagttggcagttgagggcttaacatggcatgtcacatgtgttagcatgggcaacccccactgtgtcacatttggggcaaacgagttaaagaccttgcagatcgacgatttaaaactcagcgaaattgggcctaaatttgagcatcatgaaatgtttcctgctcgcacaaacacagagtttgtacaggttttgtctcgctcacacctcaaaatgcgagtctgggaacgtggtgctggagcaactcttgcctgtggtactggtgcttgtgcggtggttgttgcagctgttcttgagggtcgagctgagcggaaatgtgtagttgatttgcctggcgggccattggaaattgagtggagggaggatgacaatcatgtttacatgactggtcctgcagaggccgtcttttatggatctgttgttcactaggtactggggagtggggaccaagatagaagggttggctgccactcaaagcttgtgagattggttacaatatccatgaaactgaatgttctggtgccagtacactcgtttagatattttaaattatggttgcttgatttgggtagcagtagaggcttccttttgaagcattctagtgttgtccaccttttgtactcctttagtctgtcaggtttgaactacattgttagcatgtctttccaaccattttctgtttcttttctttgcaagttaacgtcaatgcagcttcagtattgttttctacagatttatcttgatgcactgcagaatgaatgggcttactagtttgctggta

SEQ ID NO: 1058 - DNA, 1634 bp, Zea mays
tgttaaaaacaaaaaattcaggtttatgtaccggtgacagcgaccgcgacaggtcctctcccccggaccgcacccgctgtagccgccatgtcgtccgccgccgccacagcctttgccggagtctccgtcgccaccccgaacctcaccactccatttcgcggtcgcgtgcgccttccgctacgcggggtctccgctgccccacgccgcgccgtcgcttcgatggccgtgtccgcccccaggtccggcgccgccgcctcgttcctggagcgccgcgagtccgagcgcgctctccacttcgtcaagtaccagggcctcggcaatgacttcattatggtggacaacagggattcgtcggtgccgaaggtgacgccggaggaggccgcgaagctgtgcgaccgaaacttcggcattggtgccgacggcgtcatcttcgtcatgccaggggtcaatgatgccgactacaccatgaggatcttcaactctgacggcagcgagccagagatgtgtggtaatggagtccgttgctttgctcggtttataggcgaacttgaaaatctgcaggggacacatagcttcactattcatactggtgctgggaagatcattcctgaaatacaaagtgatgggcaggtaaaggttgatatgggagagcccatcctttctggagcagacatccccacaaaactggtagctaccaagaacaaagctgttatccaagctgagttggcagttgagggcttaacatggcatgtcacatgtgttagcatgggcaacccccactgtgtcacatttggggcaaacgagttaaagaccttgcagatcgacgatttaaaactcagcgaaattgggcctaaatttgagcatcatgaaatgtttcctgctcgcacaaacacagagtttgtacaggttttgtctcgctcacacctcaaaatgcgagtctgggaacgtggtgctggagcaactcttgcctgtggtactggtgcttgtgcggtggttgttgcagctgttcttgagggtcgagctgagcggaaatgtgtagttgatttgcctggcgggccattggaaattgagtggagggaggatgacaatcatgtttacatgactggtcctgcagaggccgtcttttatggatctgttgttcactaggtactggggagtggggaccaagatagaagggttggctgccactcaaagcttgtgagattggttacaatatccatgaaactgaatgttctggtgccagtacactcgtttagatattttaaattatggttgcttgatttgggtagcagtagaggcttccttttgaagcattctagtgttgtccaccttttgtactcctttagtctgtcaggtttgaactacattgttagcatgtctttccaaccattttctgtttcttttctttgcaagttaacgtcaatgcagcttcagtattgttttctacagatttatcttgatgcactgcagaatgaatgggcttactagtttgctggtatgaatgttgcctatttcctggaaatcgttgtcatctaaagtgcttctgacaaaagacagcatgggttattggttatgactcactgctaatttcacctgcaacaattaataaagtgtcacattctgtgcttatataa

SEQ ID NO: 1059 - DNA, 1430 bp, Panicum virgatum
ctcatgcacccgcaccctcgctcttgtggcaatgtcgccagccgccgccaccaccttcttcgccgccgcagccaccgtcgcggcgcccaccgccccgtttcgcgcctgcgtcctacttccgctccgcgggggccccggtgcccctcgccgcgccgtcacctcgatggccgtttccaccccgaggtccgccgccgccgcctcgttcctcgagcgccgcgagtccgagcgcgccctccacttcgtcaagtaccagggcctgggaaacgacttcatcatggtggacaatcgggattcgtctgtgccgaaggtgactcctgaggaagcggcgaagctgtgcgaccggaacttcggcattggcgccgacggcgtcatcttcgtcatgccggggtccaatggcgcggactacaccatgaggatcttcaactccgacggcagcgagccggagatgtgtggtaatggagttcgttgctttgctcggtttatagctgagcttgaaaacctgcagggaacacatagcttcacgattcatactggtgctggattgatcattcctgaaatacaaagtgatgggcaggtaaaggttgatatgggcgagcccatcctttctggaccagagatccccacaaaactgctagctaccaagaacaaagctgttgtccaagctgaattggatgttgagggcagaacatggcatgtaacatgtgttagcatgggcaaccctcactgtgtcacatttggtgcgaaggacttaaaggtcttgcaggttgatgatctaaaacttagtgaaattgggcctaactttgagcatcatgaaatgtttcctgctcgcaccaacacagaatttgtacaggttttgtctcgctcacacctcaaaatgcgagtttgggagcgtggtgctggagcaactctcgcttgtggtactggtgcttgtgctgttgttgttgctgctgttcttgagggccgagctgagcggaaatgcatagttgatttgcctggtggaccattgaaaatagagtggagggaggatgacaaccatgtttacatgactggtccggcagaggccgtcttttatggatctgttgttcactaggtactggggaccaagacagaacggttagctacccactgagagcttgtgagattgattaccagtacacctgttcagatattcttaattatggtttctttatttgggtagcattagaggcttccttgtgaagtattctagtgttgttcacctttattgtactcttactctgtcaggtttgaacactacattggtagcatacctatccaaccattttctgtttcttttctttggcaataagcggatgtcaacgcatagtttcagtattgttgcctacagatctaccttgatatactgcagcatgatttggcttactagttaattgctgagatgaatggtgcct

SEQ ID NO: 1060 - DNA, 1480 bp, Zea mays
accgctccatcccgcggtcgcgtgcgccttccgctacgcggggtccccgctgctccacatcgcgtcgtcgcctctatggcagtgtccgcccccaggtccggcgccgccacctcgtttctcgagcgccgcgagtcggagcgcgctctccactttgtcaaataccagggcttcggcaacgacttcataatggtggacaacagggattcgtcggtgccgaaggtgatgcccgaggaggccgcgaagctgtgcgaccgaaacttcggcattagcgccgatggatctttgtcatgccgggggtcaatggtgccgactacaccatgaggatcttcaactctgatggcagcgaacgagagatgtgtggtaatggagtctgttgcttcgctcggtttatagccgagattgaaaatctgcaggggacaaatagattcactattcatactggtgctggaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaaattgggcctaaatttgagcatcatgaaatgtttcctgctcgcacaaacacagagtttgtacaggttttgtctcgctcacacctcaaaatgcgagtctgggaacgtggtgctggagcaactcttgcctgtggtactggtgcttgtgcggtggttgttgcagctgttcttgagggtcgagctgagcggaaatgtgtagttgatttgcctggcgggccattggaaattgagtggagggaggatgacaatcatgtttacatgactggtcctgcagaggccgtcttttatggatctgttgttcactaggtactggggagtggggaccaagatagaagggttggctgccactcaaagcttgtgagattggttacaatatccatgaaactgaatgttctggtgccagtacactcgtttagatattttaaattatggttgcttgatttgggtagcagtagaggcttccttttgaagcattctagtgttgtccaccttttgtactcctttagtctgtcaggtttgaactacattgttagcatgtctttccaaccattttctgtttcttttctttgcaagttaacgtcaatgcagcttcagtattgttttctacagatttatcttgatgcactgcagaatgaatgggcttactagtttgctggtatgaatgttgcctatttcctggaaatcgttgtcatctaaagtgcttctgacaaaagacagcatgggttattggttatgactcactgctaatttcacctgcaacaattaataaagtgccacattctgtgctt

SEQ ID NO: 1061 - DNA, 1284 bp, Pennisetum glaucum
cagccaccgtcgcctccctcgccgccccatcccgcggctgcgtccgccttccggtccgcgggggtcccggcgcccctcgccgggccgtcgcctcgatggccgtttccacccccaggtccgccgccgcctcgttcctcgagcgccgcgagtcggagcgcgccctccacttcgtcaagtaccagggcctgggaaacgacttcatcatggtggacaatagggattcgtcggtgccgaaggtgactccggaggaggcggcgaagctgtgcgaccggaacttcggcattggtgcagacggcgtcatcttcgtcatgccggggaccaatggcgcggactacaccatgaggatcttcaactccgacggcagcgagccagagatgtgtggtaatggagtccgttgctttgctcggtttatagctgagcttgaaaacctgcagggaacacatagcttcacaattcatactggtgctggactgatcattcctgaaatacaaagtgacgggcaggtaaaggtcgatatgggcgagcccatcctttctggaccagacatccccaccaaattgctagctaccaagaacaaagctgttgtccaagctgagttagaagttgagggctcaacatggcatgtaacatgtgttagcatgggcaaccctcactgtgtcacatttggtgcaaatgacttaaaggtcttgcaggtcgatgatctaaaacttagtgaaattgggcctaaatttgagcaccatgaaatgtttcctgctcgcaccaacacagaattcgtacaggttttgtctcgctcacacctcaaaatgcgagtttgggagcgtggtgctggagcgactcttgcttgtggtactggtgcttgtgcagttgttgtttctgctgttcttgagggccgagctgagaggaaatgtgtagttgatttgcctggcggcccattggaaatagagtggagggaggatgacaatcatgtttacatgactggtccagcagaggccgtcttttatgggtctgttgttcactaggtactggggaccaagatagaagagcttccactgagagcttgtgagattggttacaatatccatgaaaccgaatgttctggtaccagtacactttcggatatttttaatttggtttcttagtttaggctgcattagaggcttcctcatgaagcattctagtgttgttcactttttgtattagtctgtgtcaggtttgaagcatacattggtaacatacctatacaaccattttatgtttcctttctcggcaataagtgaattttag

SEQ ID NO: 1062 - DNA, 1500 bp, Brachypodium distachyon
tcgtcgccatgtcgcccgccgccgccgccgccgccgccacagccaaatccttcgctgccaactttgccgcctccaccgccccctcctcccgggtccgccccaacctttcgctccgcggaacccccgccccacgccgagccgtcgcctcgatggccgtgtccgccccaaagtcccccgccgccgcctcgttcctcgagcgccgcgagtccgagcgcgccatccacttcgtcaagtaccagggcctcggcaacgacttcatcatggtggacaacagggattcgtccgtgccgaaggtgacccccgaggaggcggcaaagctgtgcgacaggaactttggtatcggtgccgacggcgtcatcttcgtcatgccgggggtcaatggtgcggactacaccatgaggatcttcaactccgacggcagcgagccggagatgtgtggtaatggagttcgttgctttgctcgttttatagcggagcttgaaaatctacagggaacacatagcttcaaaattcatactggtgctggattaatcattcctgaaatacaaaacgatggcaaggtaaaggtcgatatgggccaacccatccttaatggaccagatgttcccacaaaactgccatccacgaagaatgaagctgttgttcaggctgaattggcaattgatgggttagtgtggcatgtaacatgtgttagcatgggcaatcctcattgtgttacctttggtgcaaaagagttgaaggttttgcatgttgatgatctgaagcttagtgatattgggcctaaatttgagcatcatgaaatgtttcctgctcggaccaacaccgaatttgtacaggtcttgtctcgctcacacctcaaaatgcgagtttgggagcgcggtgctggagcaactctggcttgtgggactggtgcttgtgcagttgttgttgcagctattcttgagggccgagctgaacggaaatgtgtagttgatttgcctggcgggccactggaaattgagtggagggaggataacaatcatgtttacatgactggtcctgcagaggctgtcttctatggatcagttgttcactaggtaccgggcccaagatagaacagtttgccataaattggagcctgatagatttgattataaggtctatcaaatgctgttctggtaccagtgccactccctttgatgttctcaattatggtattcagtgttcactacgggtagcacaagaggtttccttttgaagcattctgggcgttcttaaccttttgttttcctccggcctgtcaacatcatgttagaactatatgtggattagatctgtcctgccttctttggtaataagttgagactgcctattcataatttgaatattgtgtctcgtgtccacacatttatcttgatctactgcagaatggtcgggcttacctgttatttgttgaggtagatattgtctatttgggtatttcgagaaactgctatatactagtggacttctgatttctga

SEQ ID NO: 1063 - DNA, 1463 bp, Avena sativa
aacccctcccgctctcgcacccgtcgcgatgtcgcccgccgccgccgcccgagtcacatccttcgctgccaccttctccgcctccacagccccctcctcccgcggcctcctccaccgtccgttccgcgggacccccgcccaccgccgcgccgtcgcctcgatggccgtgtccgctcccaggtcgtcggccgccgcctcgttcctcgagcgccgggagtccgagcgcgcgctccacttcgtcaagtaccagggcctcggcaacgacttcatcatggtggacaacagggattcggctgagccgaaggtgacacccgaggatgcggctaagctgtgcgaccggaacttcggtatcggtgctgatggtgtcatattcgtcatgccgggggtcaatggtgcagactacactatgagaattttcaactctgacggcagtgagccggagatgtgtggcaatggagttcgttgctttgcccgttttatagctgagattgaaaatctaaaaggaacacatagcttcaaaatacatactggtgctggactaatcattcctgaaatacaaaatgatggcaaggtaaaggttgatatgggtcaacccatccttaatggacctgatgttcccacaaaactgccatccaccaagaatgaagctgttgttcaagctgaattggcaattgatgggttagcatggcatgtaacctgtgttagcatgggcaatcctcactgtgtcacgtttggtgcaaaagagttaaaggatctgcatgttgatgatttgaagcttagtgatattgggcctaaatttgagcatcatgaaatgtttcctgctcggaccaacacagaatttgtacaggtcttgtctcgctcacacctcaaaatgcgagtttgggagcgtggtgctggagcaactcttgcttgtgggaccggtgcttgtgcggttgttgttgcagctgttcttgagggccgagctgaacggaaatgtgtagttgagttgcctggcgggccactggaaattgagtggagggaggataacaatcatgtttatatgactggtcctgcggaggctgtcttctatggatccattgttcactaggtactgagggtggagatggaagggtttgccataactcggagcctgaaatattgatcataaggtctatcgaaccactgtcctggtaccagtgccaccccctcttaataatggctgcttactatgggcaaaactgggggaacactgggaagcagtagaggcttccatttgaggcattctaggcgatttttacttcttaatcttctgtactctttctgtccttcagtctatcgcgttagaaccctgtgtgaattatggatctgtccagcttgtgctgtgtatgcatggcttaatattgctatctacaattttatcttgatttactgcaaaatgttgggctcgtaccagttaattggtgagatctatgttgtttatttcg

SEQ ID NO: 1064 - DNA, 1554 bp, Triticum aestivum
ccacgcgtccgcagtgggccaacgtgtcacatggagcccgcttgcatagagcagaaagctccccgtcattagccggcagcgacggcgacagggaccctcccccaaacccctccccgctctcgcactcgtcgccatgtcgcccgccgccgccgccgccagagccacatccttcgctgccaacttcaccacctccaccgccccctcctcgggcggtcgcctcctccgtccgttctgtgggaatccgcgcccccgccgcgccgtcgcctcgatggccgtgtccgctcccaagtcgccagccgccgcctcgttcctcgagcgccgcgagtccgagcgcgcgctccacttcgtgaagtaccagggcctcggcaacgacttcataatggtcgacaacagggattcggccgtaccgaaggtgacaccggaggaggcggcgaagctatgcgaccgaaactttggtattggtgctgatggcgtcatcttcgtcctgccgggggtcaacggcgcggactacactatgaggatattcaactccgatggcagcgagccggagatgtgtggcaatggagttcgttgctttgctcgctttatagcggaggttgaaaatctacagggaacacatagcttcaaaatccatactggcgctggattaattattcctgaaatacaagacgatggaaaggttaaggttgatatgggcgaacccattctttatggaccagatgttcccacaaaactgccatccaccaagaatgaagctgttgtaaaagcggaattggcaattgacgggctagcatggcatgtaacctgtgttagtatgggcaatcctcattgcatcacgtttggttcaaaagagttgaaggttctgcatgttgatgatttgaagcttagtgatattgggcccaaatttgagcatcatgaaatgtttcctgctcggaccaacactgaatttgtggaggtcttgtctcgctcacacctcaaaatgcgagtttgggagcggggtgctggagcaactcttgcttgtgggactggtgcttgtgccgttgttgttgcagctgttcttgagggccgagctgaacggaaatgtgtagttgatttgcctggtgggccattggaaattgagtggagggaggataacaatcatgtttacatgactggtcctgctgaggctgtcttctacggatctgttgtacactaggtgctggggacgaagatggaagggttacataactcagagcctgaaaaaatgattacaaggtctctcaaaacactttcctggtaccagtgtccctcccttcttgataatgactgctcactgtgggcaaaaacgagggaatgctatgggcagaattagaggctttcttttgaaccaatttaggtgtattttacattttaaccttttgtactccttcagtatcatgttagaaccctgtgttgggttatggatctgtcctgtcttctttctttgctaataagcttgggctgcctatgcatagcttgaatattgttgtctacaaatttaccttgatttactgcataatgattgggcttatctgt

SEQ ID NO: 1065 - DNA, 1576 bp, Triticum aestivum
  misc_feature (1552)..(1552): n is a, c, g, or t
cagtgggccaacgtgtcacatggagcccgcttgcatagagcagaaagctccccgtcattagccggcagcgacggcgacagggaccctcccccaaacccctccccgctctcgcactcgtagccatgtcgcccgccgccgccgccgccagagtcacatccttcgctgccaacttcaccacctccaccgccccctcctcgggcggtcgcctcctccgtccgttctgtgggaatccgcgcccccgccgcgccgtcgcctcgatggccgtgtccgctcccaagtcgccagccgccgcctcgttcctcgagcgccgcgagtccgagcgcgcgctccacttcgtgaagtaccagggcctcggcaacgacttcataatggtcgacaacagggattcggccgtaccgaaggtgacaccggaggaggcggcgaagctatgcgaccgaaactttggtattggtgctgatggcgtcatcttcgtcctgccgggggtcaacggcgcggactacactatgaggatattcaactccgatggcagcgagccggagatgtgtggcaatggagttcgttgctttgctcgctttatagcggaggttgaaaatctacagggaacacatagcttcaaaatccatactggcgctggattaattattcctgaaatacaagacgatggaaaggttaaggttgatatgggcgaacccattctttatggaccagatgttcccacaaaactgccatccaccaagaatgaagctgttgtaaaagcggaattggcaattgacgggctagcatggcatgtaacctgtgttagtatgggcaatcctcattgcatcacgtttggttcaaaagagttgaaggttctgcatgttgatgatttgaagcttagtgatattgggcccaaatttgagcatcatgaaatgtttcctgctcggaccaacactgaatttgtggaggtcttgtctcgctcacacctcaaaatgcgagtttgggagcggggtgctggagcaactcttgcttgtgggactggtgcttgtgccgttgttgttgcagctgttcttgagggccgagctgaacggaaatgtgtagttgatttgcctggtgggccattggaaattgagtggagggaggataacaatcatgtttacatgactggtcctgctgaggctgtcttctacggatctgttgtacactaggtgctggggacgaagatggaagggttacataactcagagcctgaaaaaatgattacaaggtctctcaaaacactttcctggtaccagtgtccctcccttcttgataatgactgctcactgtgggcaaaaacgagggaatgctatgggcagaattagaggctttcttttgaaccaatttaggtgtattttacattttaaccttttgtactccttcagtatcatgttagaaccctgtgttgggttatggatctgtcctgtcttctttctttgctaataagcttgggctgcctatgcatagcttgaatattgttgtctacaaatttaccttgatttactgcataatgattgggcttatctgttaattggtnagatttggtattaaaaaaaaaaaa

SEQ ID NO: 1066 - DNA, 1862 bp, Oryza sativa
ctcctgatcccccctcccacccgcacgccctcgccgccatgtcgtccgccaccgccgccgccaccgccaccatcgccgccgccgccgcgaagctcgccgccacccccgcccccgccccctcccggcgccgcctcacgctccgcgggaaccccaccgcgcgccgctgcgtcgccgcgatggccgtgtccacccccaggtcggccgccgccgccgcgttcctcgagcgccgcgagtcggagcgcgccctccacttcgtcaagtaccagggccttgggaacgacttcatcatggtggacaatagggattcggccgtgccgaaggtgacgccggaggaggcggcgaagctgtgcgacaggaacttcggcgtcggcgccgacggtgtgatcttcgtcatgccgggggtcaatggcgcggactacaccatgaggatcttcaactcggacggcagtgagccggagatgtgtggcaatggagtccgttgctttgcccggtttatagctgagcttgaaaacctacagggaacacatagcttcaaaattcacactggcgctgggctaatcattcctgaaatacaaaatgatggcaaggtaaaggttgatatgggccagcccattctctctggaccagatattccaacaaaactgccatccaccaagaatgaagccgttgtccaagctgatttggcagttgatggctcaacatggcaagtaacctgtgttagcatgggcaatccacattgtgtcacatttggcacaaaggagctcaaggttttgcatgttgatgatttaaagcttagtgatattgggcctaaattcgagcatcatgaaatgtttcctgcccgcaccaacacagaatttgtagaggtcctgtctcgctcacacctcaaaatgagagtctgggagcgtggtgctggtgcgacgcttgcttgtggaaccggtgcttgtgcagtagttgttgcagctgtcctcgagggtcgagctgaacggaaatgtgtagttgatttgcctggtggaccattggaaatcgaatggagggaggatgacaatcatatttacatgactggtcctgcagaggctgtcttctatggatctgctgttcactaggtaccagggaccaagctggaaaagtttaccgcaactgggagcctgagagattgagtataaggtctatcaaattggtgttttggtaccagcacaacccctcttgattcttaattgcgcctgtggcctgcttactatgggcagaattacggggttctttcaaacaaatctactattttaaatcttttctgcttctttagtttgtcaggtttgaaccctatattggtagtaaatctctcctactttttttttgttccttcctttggcaataaacccttgctgtcttaagtgcataactgcatgtgcatttgagttttttgtctacagatatcctgatttactacagaatgattgagcatgtgtgttatttggcaagatggttgttgcctgctcccaggaaatatctgtatatcaaattgcatgggtaataggtcgtggttaattgacttgtgaaactatcatttatgtgccacatcacatagatgatttttgctctgactgacttaaagtagcagttcttcattccaacctgactccttgtgttcgtgttatttgtagaattgatcatccttgatcaggaagggttaagtaaaaatgttacatttatctacgcccttaattgtgtttgctagttgatatttctagtattcaggagctgacatctttctaataattaccatgtaccctacaaatataaaatgtccaagaaacatcatttcacatgagttgataattgatagtccattgtgattagagagagag

SEQ ID NO: 1067 - DNA, 1370 bp, Hordeum vulgare
ccaaacccctccccgctctcgcactcgtcgccatgtccgccgccgccgccagagtcacatccaacttcaccaacttcaccacctccactgccccctcctcgggcggtcgcctcctccgtccgttccgtgggactccgccctcccgccgcgccgtcgcttcgatggccgtatccaccccaaggtcgccatccgccgcctcgttcctcgagcgccgcgagtccgagcgcgccctccacttcgtcaagtaccagggcctcggcaacgacttcataatggtcgacaacagggattcggcagtgcccaaggtgacgccagaggaggcggcgaagctgtgcgacagaaactttggtgttggtgctgatggcgtcatcttcgtcatgccggggatcaacggtgcggactacactatgaggatattcaactccgatggcagcgagcctgagatgtgtggcaatggagttcgttgcttcgctcgctttatagcggaggttgaaaatcttcagggaacacatagcttcaaaattcatactggggctggattaattatccctgaaatacaagatgatggaaaggttaaggttgatatgggccaacccattctgcatggaccagatgttcccacaaaactgccatccaccaggaatgaagctgttgttcaagctgaactggcaattgacgggtcaacatggcatgcaacctgtgttagcatgggcaatcctcattgcgtcacgtttggttcaaaagagttaaaggttctgcaggttgatgatctgaagcttagtgatattgggcccaaatttgagcatcatgaaatgtttcctgctcggaccaacactgagtttgtacaggtcttgtctcgttcacacctcaaaatgcgagtttgggagcgcggtgctggagcaactcttgcttgtgggactggtgcttgtgcagttgttgttgcagctgttcttgagggccgagctgaacggaaatgtatagttgatttgcctggtgggccattggaaattgaatggagggaggataacaatcatgtttacatgactggtcctgcggaggctgtcttctacggatctattgtacactaggtgctggggacgaagatggaagggtttacttaactcagagcctaaaaataaggtctctcaaaccactttcctggtaccagtgtcactccgttactgtgggcaaaaacgagggaatgctattggcagtactagaggctttttttggaagcattttaggtgtactttacattttaaccttttgtactccttcagtatcatgttagaaccctgtgctgggttatggatctgccctgtcttctttatttgctaataagtgggctgcctatgcataacttgaatatt

SEQ ID NO: 1068 - DNA, 1533 bp, Leymus cinereus x Leymus triticoides
  misc_feature (36)..(38): n is a, c, g, or t
cgaacccctccccgctctcgcactcgtcgccatgtnnnccgccgccgccgccgctagagtcacatccttcgccgccaacttcaccacccccactgccccctcctcgggcggtcgcgtcctccgtccgttccgtcggaatccgcgcccccgccgcgtcgtcgcctcgatggccgtgtccgctcccaagtcgccagccgccgcctcgttcctggagcgccgcgagtccgagcgcgccctccgcttcgtcaagtaccagggcctcggcaacgacttcataatggtagacaacagggattcggccgtgccgaaggtgacaccggaggaggcggcgaagctgtgcgaccgaaacttcggtgttggtgctgatggcgtcatcttcgtcatgccgggggccaacggcgcggactacactatgaggatattcaactccgatggcagcgagccggagatgtgtggcaatggagttcgttgcttcgctcgcttatagcggaggttgaaaatctacagggaacacatagcttcaaaatccatactggcgctggattaattattcctgaaatacaagacgatggaaaggttaaggttgatatgggccaacccattctttatggaccagatgttcccacaaaactgccatccaccaagaatgaagctgttgttcaggccgaattggcaattgacgggttagcatggcatgtaacctgtgttagcatgggcaatcctcattgcatcacgtttggttcgaaagagttaaaggttctgcatgttgatgatttgaagcttagtgatattgggcccaaatttgagcatcatgaaatgtttcctgctcggaccaacactgaatttgtagaggtcttgtctcgctcgcacctcaaaatgcgagtttgggagcggggtgctggagcaactcttgcttgtgggactggtgcttgtgcagttgttgttgcagctgttcttgagggccgagctgaacggaaatgtgtagttgatttgcctggtgggccattggaaattgaatggagggaggataacaatcatgtttacatgactggtcctgcagaggctgtcttctacggatctgttgtacactaggtgctggggacgaagatggaagggtttacataactcagagcctgaaaaaatgattacaaggtctctcaaaacactttcctggtaccagtgtccctcccttcttgataatggctgctcactgtgggcaaaaacgagggaatgctatgggcagaactagaggctttcttttgaaccaatttaggtgtattttacattttaaccttttgtactccttcagtatcatgttagaaccctgtgttgggttatggatctgtcctgtcttctttctttgctaataagcttgggctgcctatgcatagcttgaatattgttgtctacaaatttaccttgatttactgcataatgattgggcttacctgttaattggcgagattcggtattatcaggaaggtgttgtatatgaatgggcttcagattgctgacatcatgggctattagtca

SEQ ID NO: 1069 - DNA, 1393 bp, Pseudoroegneria spicata
caccacctccactgccccctcctcgggcagtcgcctcctccgtccgttccgtgggaatccgcgcccccgccgcgccgtcgcctcgatggccgtgtccgctcccaagtcgccagccgccgcctcgttcctcgagcgccgcgagtccgagcgcgcgctccacttcgtcaagtaccagggcctcggcaacgacttcataatggtcgacaacagggattcggctgtaccgaaggtgacaccggaggaggcggcgaagctgtgcgaccgaaactttggtgttggtgctgatggcgtcatcttcgtcatgccgggggttaacggtgcggactacactatgaggatattcaactccgatggcagcgagccagagatgtgtggcaatggagttcgttgctttgctcgctttatagcggaggttgaaaatctacagggaacacatagcttcaaaatccatactggcgctggattaattattcctgaaatacaagacgatggaaaggttaaggttgatatgggccaacccattctttatggaccagatgttcccacaaaactgccgtccaccatgaatgaagctgttgtaaaagccgaattggcaattgacgggttagcatggcatgtaacctgtgttagtatgggcaatcctcattgcatcacgtttggttcaaaagagttgaaggttctgcatgttgacgatttgaagcttagtgatattgggcccaaatttgagcatcatgaaatgtttcctgctcggaccaacactgaatttgtagaggtcttgtctcgctcacacctcaaaatgcgagtttgggagcggggtgctggagcaactcttgcttgtgggactggtgcttgtgcagttgttgttgcagctgttcttgagggccgagctgaacggaaatgtgtagttgatttgcctggtgggccattggaaattgagtggagggaggataacaatcatgtttacatgactggtcctgcagaggctgtcttctacggatctgttgtacactaggttctggggacgaaaatggaagggtttacataactcagagcctgaaaaaaaatgattacaaggtctctcaaaacactttcctggtaccagtgtccctcccttcttgataatggctgctcactgtgggcaaaaacgagggaatgctatgggcagaactagaggctttcttttgaaccaatttaggtgtattttacattttaaccttttgtactccttcagtatcatgttagaaccctgtgttgggttatggatctgtcctgttttctttctttgctaataagcttgggctgcctatgcatagcttgaatattgttgtctacaaatttaccttgatttactgcataatgattgggcttacctgttaattggtgagattcggta

SEQ ID NO: 1070 - DNA, 652 bp, Triticum aestivum
ccacgcgtccgggctgcctgccatgtgggcctcgccagggaggctgccggcgatggaggaggaggaggaggagtgcgaggcggacgcgggccgccgggcgccgatggcgtcctgctggggccgcttcggcctggcggcgctgtggcaccggctccggcaccttttcctggcgcggcggagggcgcggcacggccgctccatcctcggcgccggcgggctcaactacgacccgctgagctacgcgcagaacttcgacgacagcagcctggagctccacgagccggacttcacggccaggttcgcgccggcccgcaacgcctgctcgcccaggcgggcatgacgacgcgccacttctcggcgccccggtggcatacggaggatcccttttgccacttcctggcgcccttgtgcgcccctttgagtggtaaaaaggctttatttaatccacgtattttcggataaatgtacatgtacatgtcatgcggatgacgcaagtagttttcatttttcttcgcgggtgtaagtattcgtgtggtgttcttccaaaagaaagaaaacagcgggggttgtgatgaactgcataggagccagtcagagcatgtctggttggttatcaaaaattcggaaaaagttcctcctgaatagatttcta

SEQ ID NO: 1071 - DNA, 638 bp, Hordeum vulgare
cggcacgaggcctcactccattcaacactcctcctccctcccccttctctctctctctcccactctgctggtcggccagaggctgcctgccatgtgggcctcgccggggaggctgccggcgatggaggaggaggaggagtgcgaggcggacgcgggccacagggcgccgatggcgtcgtgctggggccgcttcggcctggcggcgctgtggcacaggctccggcaccttttcctggcgcggcggagggcgcggcacggccggtccatcctcggcgccggcgggctcaactacgacccgctcagctacgcgcagaacttcgacgacagcagcctcgagcaccacgagcctgacttcacggccaggttcgcgcccgcccgcaacgccagctcgccacggccggtatgacgacgcgccgctcctcggcgccccagtggcggatggagaaccctctttcccacttcttggcgcctttgtgagccttttgagtggtaaaaaggctttatttaattatttagtccacatgtttctcggatcaatgtacatgtacatgtcatatggatgacgcaagtagttttcgcttttattcacgggtgtaaatattgttctccaaaagaaaatgaaaaatactattagtaga

SEQ ID NO: 1072 - DNA, 644 bp, Hordeum vulgare
cggcacgaggcctcactccattcaacactcctcctccctcccccttctctctctctctcccactctgctggtcggccagaggctgcctgccatgtgggcctcgccggggaggctgccggcgatggaggaggaggaggagtgcgaggcggacgcgggccacagggcgccgatggcgtcgtgctggggccgcttcggcctggcggcgctgtggcacaggctccggcaccttttcctggcgcggcggagggcgcggcacggccggtccatcctcggcgccggcgggctcaactacgacccgctcagctacgcgcagaacttcgacgacagcagcctcgagcaccacgagcctgacttcacggccaggttcgcgcccgcccgcaacgccagctcgccacggccggtatgacgacgcgccgctcctcggcgccccagtggcggatggagaaccctctttcccacttcttggcgcctttgtgagccttttgagtggtaaaaaggctttatttaattatttaatccacatgtttctcggatcaatgtacatgtacatgtcatatggatgacgcaagtagttttcgcttttattcacgggtgtaaatattgttctccaaaagaaaatgaaaaatactattagtagagatttt

SEQ ID NO: 1073 - DNA, 3096 bp, Solanum phureja
ggttcaaagcccaattctctttctctctcatccagctacggccgaaaacctagatctgattcactaccggagcctgaaaaactcgtcggcttggaaattcctatctgggttttgctcagaattgaatttcggtaattgggttattctgaaaattcaaaatttcctacagccttgagcttctggatattgatggcgaccccagaaaccacagctactccagcaacccccactgagaataatgagatagtgccgaaaaatgagatgattcatgagcatggtgatgaaatggtgccgcaaaatgagatgatacatgagcacagccatgagattgtgctggaaaatgagatgatacatgagcacagccatgagattgtgccggtaaatgagatgatacacgagcacagccatgagattgtgccggaaaaggagatgatacatgagcatagtcatgagattgtgccggaaaatgagatgatacatgagcacagtcacgagacagtgccgcaaaatgagatgatacatgagcatagtcatgagatggtgccagaaaatgagatgacacatgagcacagtcacgcgatggtgcgggaaaatgagatgacacatgagcataatcacgagatggtgccagaacatgagatgatgcatgaacatagtcatgagatggtgccggaacatgagatgatgcatgaacatagacatgagatgatgccggaacatgagatgatgcatgaacatcatatggtgcttgggaatgagatagtccccagcaatgagatggtcccggatgatgagatgatcccactaaatgagatggtccttgctgaaccacaacccaactatatagaaacacctccaaacaatccagaaacacagcccagcaagcgtaggaagaagaagtcaatagtttgggaacacttcaccattgaaaacgttggcagtggaactagaagggcacaatgtaagcagtgcaagcaatcatttgcatatagtacaggttcaaaagtagctggcactagtcacctgaaacgccatattgccaaaggaacctgtccagtagtcctacgtaaccaacagaacaatcaattgagcccgtatagtacacctcctaagatgagtggatatggtggtagtactgatgcaccaaaacggcgttataggactgcatctgctccttaccttgcttttgatcctgaccggtgccgtcaagagatctctaagatgatcatcatgcacgactatccccttcacatggttgagcatccaggctttcttgcttttgttcagaatctgcaacctcgttttgatatggtgagcttcaacactgtgcaaggagattgtgtggcaacttatcttagagagaagcaagcaattcagaaggtgattgagggagtgcctgggcgtatctgcttaacgctagatatgtggtcctcctgctacactgtgggctatgtgttcataaccgggcagtatattgacagtgagtggaaaattcacaggaaaatactcaatatcatcatggaaccatatccagattctgagacggctttcagccacgctgttgccgcttgcctttctgactggagtatggaaggtaagttattttctgtcactattaatcaaccgttgggtgatgctgctgttgataatcttagagctttactatctgtgaagaacccgcttgtgctcaatggtcagttgttggtcggaagttgtcttgctcgaactttaagcagcattgcccaaggtgcatttaagcttttgcaagaaactgttaagaaagtaagagatagcgtcaagtatgtgaaaacatcagaatttcacgaggaaaagtttattgagctcaaacagcagcttcaagtgccaagcacaaagactttggctcttgatgaccaaactcaatggaacacaacatatgagatgttgttagctgcatcagagttaaaggaagtgttttcatgcttggatacatctgatcccgattacaaggatgccctgacaatggaagattggaagcaagttgaggttctttgtacttacttgaaaatcctcttcgacaccgccaatcttctgaccgcaccaacaattccaacaaccaacacattcttccatgaagcatggaagattcaattggaactggctcgtgctgcagtaagtgaagatccatccataagcagtcttaccaaaacaatgcaagaggagtttgataaatactggaagagttgttgtctaatattagctattgccgtagtaatggatccacgcttcaaaatgaaacttgtcgaattcagttttacgaaaatatatggtgaagaagctgccacctatgtgaagttcgttgaggagggaatccacgagctcttccttgaatacgtggcacttcctctgcctctgaccccagcttatgctgaagaggtaaatgatgggactttgaagcaggagaatggtgggggcggacttacagattttgatgcctacattatggagacaacaagccagcagtcaaggtcagagcttgatcaatatttggatgagtccttgttgcctcgtgttcacgagtttgacgttgtggggtggtggaaactgaacagaatgaagtacccaactctgtcaaaaatggctcgtgacatcttgtccgttccagtttctactgtaacagctgattctgtgtttagcactataggcaaagagatggatcgctacaggtgttccttgcgacctgagaccgtggaggccctcatctgcgccaaggattggcttcaaaatgcatcagtaaatactttacatgcaccaataaaaatggaagtcccgatttaagttttttctgtgatgttaaatacttgtttagaatagcctttgtagctgatttctgttttctttgagactgttataacatttgtctcctcctccgtgtcatccgagaatcgactttcttgtatcataatttggtatcactagagacttactggagagtttagttgcgattttcgatgtctttttttcgttagtgtctgaatgcatgaaagcagttttattctggtgcatgatatgagtatgtatgtttatacagttgtgttgcttatctatgttctatat

SEQ ID NO: 1074 - DNA, 982 bp, Solanum phureja
agtctcttgaggagcaacaatggcgggactcactaatctcaagctatctctgtttcccaattcttgttcactctcctcttcttcctctctttcctcaaacccatttcttgtttctacctccattttccgcagaacatcccacagcttcccaaagatattcgcgttttcgagcaatgatattaaagtgggcagcaacattgaagtggatggatctccttgcaaggttatagagtttcttcatgtaaagcctgggaaaggggctgcattcgtgaggaccacattgcgcaactatgtaacagggaacagcgttgagaaaactttccgagctggaagtaagatagaagaggcaaatatctacaaggagacaaagcaattcacctacaaggatggtgcccagtatgtcttcatggatctgacctcttatgaagaatatcgtctaaatgaaaaagatgttggagataaagcaaagtttctaaaagagggcatggactgcactttgcttttctggaacgggaaggtgatcgactttgaattgcctataacagtaaagttgacagtggtggacgttgatccaggcgtcaaaggtgacactgcccaaggtggatcaaagccagcaaccctcgataccggtgcaattgttagtgttccattattcataaatagaggggaggaaattatggttgatactagaaatggacaatacatgagccgcgcttaggttgcttcaggatacaattttgttacaactgaaactttttgtatctgtatgtgttagaacctagtatttatttgcaggtgtaacattagaggtccccattgagaatgctattggaaaccttctgttttagtgtacaaatgggaaagaaaagtaatccttgttttactgccaatttaccttccaaacacaactctaaaaatattgtgagcagtgaaacattgggtgaagttttaatatgtgtttggttataatttttggcttgaa

SEQ ID NO: 1075 - DNA, 865 bp, Solanum tuberosum
ggcgggactcactaatctcaagctatctctgtttcccaattcttgttcactctcctcttcttcctctctttcctcaaacccatttcttgtttctacctccattttccgcagaacatcccacagcttcccaaagatattcgcgttttcgagcaatgatattaaagtgggcagcaacattgaagtggatggatctccttgcaaggttatagagtttcttcatgtaaagcctgggaaaggggctgcattcgtgaggaccacattgcgcaactatgtaacagggaacagcgttgagaaaactttccgagctggaagtaagatagaagaggcaaatatctacaaggagacaaagcaattcacctacaaggatggtgcccagtatgtcttcatggatctgacctcttatgaagaatatcgtctaaatgaaaaagatgttggagataaagcaaagtttctaaaagagggcatggactgcactttgcttttctggaatgggaaggtgatcgactttgaattgcctataacagtaaagttgatagtggtggatgttgatccaggcgtcaaaggtgacactgcccaaggtggatcaaagccagcaaccctcgacaccggtgcaattgttagtgttccattattcataaatagaggggaggaaattatggttgatactagaaatggacaatacatgagccgtgcttaggttgcttcagatacaattttgtaacaactgaaactttttgtatctgtatgtattagaacctagtatttatttgcaggtgtaacattagaggtccccattgagaatgctattggaaacgttctgttttagtgtacaaatgggaaagaaaagtaatccttgttttactgc

SEQ ID NO: 1076 - DNA, 735 bp, Capsicum annuum
ccgttttccagtcccactgaaaacctcttgactagcaaacaatggcgggactccccaatctcaagctctctctctttcccaattcctgctcactctcttcttcttcttcctctctttgctcaaatccattcattgtctctacctccattttccgcagaacaccctaccgcttcccaaagtttcttcatgtaaagcctgggaaaggggctgcatttgtgaggaccacattgcgcaattatataacagggaacagtgttgagaaaactttccgagctggaagtaagatagaagaggcaaatatctacaaggagacaaagcaattcacttacagggatggtgcccagtatgtcttcatggatctgattacttatgaagaatatcgtctaaatgaaaaagaagttggagataaagcaaagtttctaaaagagggcatggactgcaatttgcttttctggaacgggaaggtgatcgactttgaattgcctataacagtaaagttgacagtggtggacgttgatccaggtctcaaaggtgacactgctcaaggtggatcgaagccagcaaccctagacaccggtgcagttgttaatgttccattattcataaatagaggggaggaaattatggttgatactagaaatggacagtacatgagccgtgcataggttgctttggatacatttttgtgataactgaaacttttttgtatctgtacgtattagaacttagtatctg

SEQ ID NO: 1077 - DNA, 827 bp, Nicotiana tabacum
  misc_feature (583)..(583): n is a, c, g, or t
  misc_feature (660)..(660): n is a, c, g, or t
  misc_feature (677)..(677): n is a, c, g, or t
cgtttcaacccgaattttccacagaacatcccaccgtttccctaagatatatgcgtatctagcaatgatattaaagtaggcagcaacattgaagtggatggagctccttgcaaggttatagagtttcttcatgtaaagcctgggaaaggggctgcatttgtgaggaccacattgcgcaattatgtaacagggaacaccgttgagaaaactttccgagctggaagtaagatagaagaggcaaatatctacaaggaaacaaagcaattcacttacaaagatggtgcccagtttgtcttcatggatctgaccagttatgaagaatatcgtctaaatgaaaaagttgttggagataaagcaaagtttctaaaagagggcatggactgcagtttgcttttctggaatggaaaggtgatcgactttgaattgcctataacagtgaagttgacagtggtggatgttgatccaggtctcaaaggtgacactgcacaaggtggatcaaagccagcaaccgttgacaccggtgcagttattaatgttccgttattcataggaaggggagaggaaattttggtggatactaganacggacaatacatgagtcgcgcaaaggaggcttgagataagttttgtagcaagtggaaattttggtatcataatgtnttaaaatcaagtgttanccggagttacgttaggacttcactgcagatgctcattgacacttttgttttccaccgatttgagtagacaatgaagtgatgtataaattggaggtaaaaattatcaggtagatagtctgttgtattgaagagaaggtgtttattacagta

SEQ ID NO: 1078 - DNA, 1193 bp, Solanum phureja
gtactcaattgcctttttcatcggagtttttaccattactgctactatattacactccaatcgcaatacggaaaagtagcggtaccggaaaatgtgctccactaaacaaaaccagaagcagaacctccaccataagcgctccgtcgtgcctacctctacttccgccgcaggcggtgaaggtggcggtggtggggactggagggaagaatccataaccggcggatcactaaagcatgtggatttggacaagggaaaaaacggttgggcatcaccgccgggagacctattcaatctgcgagggccaaactacttaacgaaaaaggtgaaagtaccttctggcgcgtggcttctacagcctgccggagtcgattggctccgatctaactccaagctcgaccacgtcctggctcgacacgacaaccgtgtgatgaacgcgctgaagaaatctcactctgaaggcaagtctatgaaaaccttcatagtcgccgtgaatctccaagtccctgggcgtgaccaacacagcgcggttttctacttcgctacaaacgacgacgagccgctcgaaccgggttctctcctctatcggttcgtcaacggcgatgatgcgtatcgtaacagcagatttaagatcgtgaaccggatcgtgaaaggaccgtggatcgtgaaagccgcagttgggaattactcagcttgtatactcggtaaagctttgaattgctactatcatagaggccctaattacttagaaatcgacgtggatatcggtagctcagcgattgctagcgctattttgcacttggcgttagggtcggtaacgtcggtgacgatcgatatgggttttctggtggagtcacagacggaggaagagttgccggaaaagctatttggggcagttaggatttgtcaaatggagatgagctcagctacgtttattgatacgacgtcatcaaggaaggtattacccactgctaatttacataatcctagcaatagtagcagagtccaagctgaggaggtcggtgaaaacaaagatgattaagaagaaattaaaacaaaattacttgatattattccctctcttaatgtcgagggaaattgttggtggaatccatgtagatagatgactaagcttaagctttccttgtttaataaaaattcatctcttcctttcattaactatcatttcagttcca

SEQ ID NO: 1079 - DNA, 1262 bp, Solanum tuberosum
catcggagttttaccattactgctactatattacactccaatcgcaatacggaaaagtagcggtaccggaaaatgtgctccactaaacaaaaacagaagcagaacctccaccataagcgctccgtcgtgcctacctctacttccgccgcaggcggtgagggtggcggtggtgggggctggagggaagaatccataaccggcggatcactaaagcatgtggatttggacaatggaaaaaacggttgggcatcaccgccgggagacctattcaatctgcgagggccaaactacttaacgaaaaaggtgaaagtaccttctggcgcatggcttctacagcctgccggagtcgattggctccgatctaactccaagctcgaccacgtcctggctcgacacgataaccgtgtgatgaacgcgctgaagaaatctcactctgaaggcaagtctatgaaaaccttcgtagtcgccgtgaatctccaagtccctgggcgtgaccaacacagcgcggttttctacttcgctacaaacgacgatgagccgctcgaaccgggttctctcctctatcggttcgtcaacggcgatgatgcgtatcgtaacagcagatttaagatcgtgaaccggatcgtgaaaggaccgtggatcgtgaaagccgcagttgggaattactcagcttgtatactcggtaaagctttaaattgctactatcatagaggccctaattacttagaaatcgacgtggatatcggtagctcagcgattgctagcgctattttgcacttggcgttagggtcggtaacgtcggtgacgatcgatatgggttttctggtggagtcacagacggaggaagagttgccggaaaagctatttggggcagttaggatttgtcaaatggagatgagctcagctacgtttattgatacgatgtcgtcaaggaaggtattacccactgctaatttacataatcctagcaatagtagcagagtccaagctgaggagaacggtgaaaacaaagatgattaagaagaaattaaaacaaaattacttgatattattctctctcttaatgttgagggaaattgttggtggaatccatgtagatagatgtctaagcttaagctttccttgtttaataaaaattcatctcttcctttcattaactatcatttcagttcaactttcccctacttataatttactaattttgatcaatactattggcaattagaaaattaacaaaacaagaagcactatataaatataaa

SEQ ID NO: 1080 - DNA, 2633 bp, Sorghum bicolor
tttactctagtccactaggagccgctcctccgcctcccgttgtccccctccctccacctgactgtctcagtccccctcggccttctcccctccacacggcgtcgcccgctcccctcccctctttcgccggcgccgacgatgaacggaggcggcggcgggcggcggcggtactcctcggagcagctcctcttcgacgtccccaccaatgccggtgccgccgcccggtgggcgcagcagcgcggcggggtgcggcgcggggacggggagatcttcgtgtcggtggagcccgcgacgccggcgcggctgcgcggaggggacgctgcagctggggattcgccgggacagaggcagcagctcagtcccgggttgctcgatctccatgcgttcgacaccgagctaatccccgattttcaagtaccagggatgtatgatggtgcccaaaagtttggctatggaggaggtttagatgaatctgatatgagattcacagcaaacaagctgatgagcaagtctactgtttttcctgatggtaactatctgaaggccttcactgagaaagaaaaggcagcacctgtcgcaaaaatcaaagtggtggtgcgcaaaagaccacttaacaaaaaggaagtgtcaaagaaggaagaagatatcatagacattgaacaaaactctctgactgtccatgagactaaacttaaggttgaccttactgaatatgtcgaaaagcatgagtttgtatttgatgctgtcttagatgaagatgtttcaaatgatgaggtttatcgtgaaacagtggagcctgtggttcctgcaatttttaatcgaacaaaagcaacttgttttgcttatggacaaactggtagtggaaagacgtataccatgcgtccccttccactcaaggcttcccaagatatcttgaggttaatgcaccatacgtatcgaaaccaaggatttcagttgtatgttagcttctttgagatatatggtggtaaattgtttgaccttctcaatgataggagcaaactttgcatgagagaggatggcaagcaaaaggtttgtattgttggtttgcaagagtatagagtctctgatgttgagactatcaaggagttgattgaaaaaggcagtgctaccagaagtactggcacaaccggtgcaaatgaagagtcatcgaggtctcatgccattcttcagcttgctattaaatgccgtgtggatggcaatgactccaaaccacccagaccagtcggcaagttgtcatttattgaccttgctggcagtgagcgtggtgctgatacaactgacaatgataaacaaacaagaatcgagggtgctgagatcaataaaagtttgcttgccttaaaggagtgcattagagcactcgacaatgatcagactcacattcctttccgaggtagcaaattaactgaagtcttgcgggactcgttcattggagactcacgcactgtcatgatatcatgcatttctcctagttctggctcttgcgagcatactctgaacacattgagatatgctgatagagtgaagagtttgtcaaagggaagcaatgccaagaaagatgtatctttggcagtgcctatgagagagtcgagtccttccccactgacttcagttgtaccttcattctctgcatctgaggtgatgaatgatatcaccgagagaagtaattttggttggcccaagcagcagtatgttaaagaacagcctgctccaacattcgctgaacgaatgcccaaggtgaaggattcggtggagttcacatcatcatatggtgcttattcgaagcaacaaagaagcaagggctttgtggcaccaaacatggctgaagtaccagatataatgtaccagcagggaaggcaaccaacaaggaaggctagagataccacttttgggaaggatatgagaaattccgttacttacccaactagaagggttgagccagatgaagatgagcatctaaataatcttctccaggaagaggaagacttggttagtgctcataggaagcaggttgaagagactctagacatcctcaaagaggaaatgaacatattaggcgaagcggatcagcctggcttccaacttgacgactacctcggaagactaagcagtatactctcccagaaggcggctggaattgtggacctacaggctcggttggagcagttccagaggcttttgaatgagaacaacgtgctgctatatgatcagagcccttgatcgtagttccgtcggattcatctgttgccttggtgccaccggaaaatgtgggcactggtgatttctacccagagtctcaggtggcggcaacctatgcggtgttgcttgctgtggccttgatgctgcaattgttacccataggtggcagtgaaacgcagaactagatggctagttcacagcctgttgccatggtctttggcatggccggccgggcaacctattttctactagagttgctccatccttgtgttcccgcgctccatccattgtgtatatcttatatttttttccgtgtcacatgaatgctatattatttgtagctcaacaaatacaattttctcccctttctgatgtatgaagttttccggagtgaatggtatcatcccctttctaaa

SEQ ID NO: 1081 - DNA, 2560 bp, Zea mays
gcctcccgttgtcccctccatcagtcccctcgtccttctcccctctccacacggcgtcgcggctcccctcattcgccggcgtcgacgatgaacggaggcagccggcggcagcggtactcctcagagcagctcctcttcgacgtccccgccaatgccggtgccggccggtgggcgcagcagcgtggcggggtgcgtcgcggggacggggagatcttcgtgtcggtggagcccgcgacgccggcgcggctgtgcggaggggacgccgcggccggggactcgccgggacagaggcagcagctcagtcccgggttgctcgacctccatgcgttcgacaccgagcttattcccgattttcaagtaccaggaatctatgatggtgcccaaaagtttggctatggaggaggtctagatgaatctgatatgagattcacatcaaacaagatgatgagcaagtctactatttttcctgatggtaactatctgaaggccttcactgagaaagaaaaggcagcacctgtcgcgaaaatcaaagtggtggtgcgcaaaagaccacttaacaaaaaggaagtatcaaagaaggaagaagatattgtagacattgaacaaagatcaaactctttgactgtccatgaaactaaacttaaggttgaccttactgaatacgtcgaaaagcatgagtttgtattcgatgctgtcttagatgaagatgtttcaaatgatgaggtttatcgtgaaacagtggagcctgtagttcctgcaatttttaatcgaactaaggcaacttgttttgcttatggacaaaccggtagtggaaagacttataccatgcgcccccttcctcttaaggcttcccaagatgtcttgaggttaatgcaccatacctatcgaaaccagggatttcagttgtatgttagcttctttgagatatatggtggcaaattatttgaccttctcaacgataggagcaaactttgcatgagagaggatggaaagcaaaaggtttgtattgttggtttgcaagagtatagagtgtctgatgtagagactatcaaggagttgattgaaaaaggcagtgctaccagaagtactggcacaaccggtgcaaatgaagagtcctcaaggtctcatgccattcttcagcttgccattaaacgccgtgtggatggcaatgactcgaaaccacccagaccagtcggcaagttgtcatttattgaccttgctggcagcgagcgtggtgctgatacaactgacaatgataaacaaacaagaatcgagggtgctgagatcaataaaagtttgcttgccctaaaggaatgcattagagcgcttgataatgatcagactcacatacctttccgaggtagcaaattaactgaagtgctgcgtgactcattcattggagactcacgcactgtcatgatatcctgcatttctcctagttctggctcttgcgagcatactctgaacacattgagatatgctgacagagtgaagagtttgtcaaaaggaagcaacgccaagaaagacgtgtctttggcagtgcctttaagagagtcgaactcttccccactgccttcagttgtaccctcattctctgcatctgaggtgatgaacgatatcaccgggagaagcaatttcggttggcccaagcagcagtatgttaaagaacagcctgctccaacatttgttgaacgaatgcccaaggcaaaggatgcggtggagttcacatcatcaaatatagctgaagtaccagatataatgtaccagctgggaaggcagccatcaaggaaagatgtcactttggcgaacaatatgagaaattccgttgcttacccaactagaagggttgaaccagatgatgatgatgagcatctaaataatcttctccaggaagaggaagaattggttagtgctcataggaagcaggttgaggagactctggacatcctgaaagaggaaatgaacatattaggcgacgcggatcagcctggcttccaactcgatgactacatcacaagactaagcagtatgctctcgcagaaggcggctgtgatcgtggacctacaggctcgtctggagcagtttcagaggcttttgaacgagaacaatgtgctgctatatgctcagagcccttgaccgtagctccgtcggattcatctgttgccctgttgccaccggaaaaggtgggcactggtgatgagtctcgggcggcaacctgtgcgttgttgctgtggccatggtgctgctactgtaatccgtcggtgccagtgaaacgcggaactagatggctagttcacagcatgttgccatgcttctttggcatggccggcccggcaacctattttgtactagagttgctgcatccttgtgttcctgcgccccatccaatgtgtatatctcatatttgtccgtgtcacatgaatgctctgttatttgtagctcaacagatacgtttttctccccctttctgaattctgatgtatgaagttttccagagtgtatggtatcatcccgttatacacagcttttcttggatctttattagaaggaattctatgcc

SEQ ID NO: 1082 - DNA, 2560 bp, Zea mays
gcctcccgttgtcccctccatcagtcccctcgtccttctcccctctccacacggcgtcgcggctcccctcattcgccggcgtcgacgatgaacggaggcagccggcggcagcggtactcctcagagcagctcctcttcgacgtccccgccaatgccggtgccggccggtgggcgcagcagcgtggcggggtgcgtcgcggggacggggagatcttcgtgtcggtggagcccgcgacgccggcgcggctgtgcggaggggacgccgcggccggggactcgccgggacagaggcagcagctcagtcccgggttgctcgacctccatgcgttcgacaccgagcttattcccgattttcaagtaccaggaatctatgatggtgcccaaaagtttggctatggaggaggtctagatgaatctgatatgagattcacatcaaacaagatgatgagcaagtctactatttttcctgatggtaactatctgaaggccttcactgagaaagaaaaggcagcacctgtcgcgaaaatcaaagtggtggtgcgcaaaagaccacttaacaaaaaggaagtatcaaagaaggaagaagatattgtagacattgaacaaagatcaaactctttgactgtccatgaaactaaacttaaggttgaccttactgaatacgtcgaaaagcatgagtttgtattcgatgctgtcttagatgaagatgtttcaaatgatgaggtttatcgtgaaacagtggagcctgtagttcctgcaatttttaatcgaactaaggcaacttgttttgcttatggacaaaccggtagtggaaagacttataccatgcgcccccttcctcttaaggcttcccaagatgtcttgaggttaatgcaccatacctatcgaaaccagggatttcagttgtatgttagcttctttgagatatatggtggcaaattatttgaccttctcaacgataggagcaaactttgcatgagagaggatggaaagcaaaaggtttgtattgttggtttgcaagagtatagagtgtccgatatagagactatcaaggagttgattgaaaaaggcagtgctaccagaagtactggcacaaccggtgcaaatgaagagtcctcaaggtctcatgccattcttcagcttgccattaaacgccgtgtggatggcaatgactcgaaaccacccagaccagtcggcaagttgtcatttattgaccttgctggcagcgagcgtggtgctgatacaactgacaatgataaacaaacaagaatcgagggtgctgagatcaataaaagtttgcttgccctaaaggaatgcattagagcgcttgataatgatcagactcacatacctttccgaggtagcaaattaactgaagtgctgcgtgactcattcattggagactcacgcactgtcatgatatcctgcatttctcctagttctggctcttgcgagcatactctgaacacattgagatatgctgacagagtgaagagtttgtcaaaaggaagcaacgccaagaaagacgtgtctttggcagtgcctttaagagagtcgaactcttccccactgccttcagttgtaccctcattctctgcatctgaggtgatgaacgatatcaccgggagaagcaatttcggttggcccaagcagcagtatgttaaagaacagcctgctccaacatttgttgaacgaatgcccaaggcaaaggatgcggtggagttcacatcatcaaatatagctgaagtaccagatataatgtaccagctgggaaggcagccatcaaggaaagatgtcactttggcgaacaatatgagaaattccgttgcttacccaactagaagggttgaaccagatgatgatgatgagcatctaaataatcttctccaggaagaggaagaattggttagtgctcataggaagcaggttgaggagactctggacatcctgaaagaggaaatgaacatattaggcgacgcggatcagcctggcttccaactcgatgactacatcacaagactaagcagtatgctctcgcagaaggcggctgtgatcgtggacctacaggctcgtctggagcagtttcagaggcttttgaacgagaacaatgtgctgctatatgctcagagcccttgaccgtagctccgtcggattcatctgttgccctgttgccaccggaaaaggtgggcactggtgatgagtctcgggcggcaacctgtgcgttgttgctgtggccatggtgctgctactgtaatccgtcggtgccagtgaaacgcggaactagatggctagttcacagcatgttgccatgcttctttggcatggccggcccggcaacctattttgtactagagttgctgcatccttgtgttcctgcgccccatccaatgtgtatatctcatatttgtccgtgtcacatgaatgctctgttatttgtagctcaacagatacgtttttctccccctttctgaattctgatgtatgaagttttccagagtgtatggtatcatcccgttatacacagcttttcttggatctttattagaaggaattctatgcc

SEQ ID NO: 1083 - DNA, 2653 bp, Oryza sativa
tctctcccccctccactctctcttcctccctctcctcggaaggagcccctgaatccccaccccagcctcgccggcgacgatgaacgggggcggtcgccggcgatactcctcggagcagctcatgttcgacgtccccgccaatgccgggggcggcgccggcaagtggggccagcgcggtggggtgcggcgcggggatggggagatcttcgtgtcggtggagccgacgacgccggcgcggctgcggggaggggaggcggcggctgcggcggcgggggagtcgccggggcagaggcagcagctcagccccgggctgctcgatctccacgccttcgacaccgagcttatcagcgattttcaagtgccagggattggcatgtatgatggtgcccaaaaatttggctatggcaatggaggctttgatgattcagacccaaccttcgctccaaataaacagatgagcaaatccactgtttttgctgaaagtaatttcctcaaggccttccctgagaaagagaaggcagctcctgttgcgaaaatcaaagtggtggtccgcaaaagaccacttaataagaaggagatatcaaagaaagaagaagatatcatagacattgaacaacagtcgaactccttgactgttcatgagaccaaactcaaggttgacctcactgaatatgttgagaaacatgaatttgtgtttgatgctgtcctagatgaagacgtttcgaatgatgaggtttatcgagaaacagtggaacctgttgttcctgctatttttaatcgtacgaaagctacctgttttgcttatggacaaactggtagtggaaagacctacaccatgcgtccactgcctctcaaggcctcccaagacattctgagattgatgcatcatacatatcgcaatcaaggctatcagttattcgtgagcttctttgaaatatatggtgggaaattatttgatcttctcaatgaaaggagtaaactttgcatgagggaggatgggaaacagaaagtttgcattgttggtttacaagagtatcgggtgtctgatgttgaaaccataaaggagttgattgagaaaggcaatgccaccagaagtaccggtactactggtgcaaatgaagagtcatcaagatcccatgccattcttcagcttgctattaaaaagcgtgttgatggcaatgactcaaaaccacccagattggctggcaagttgtcgtttattgaccttgctggcagtgagcgtggtgctgatacaacggacaacgacaaacaaacaagaattgaaggagctgagatcaataaaagtttgcttgctttaaaggaatgcatcagagcactagataatgaccagacccacattccatttcgaggaagcaaattaactgaagttttgcgggattccttcattggggactcacgcactgtcatgatatcatgcatttctcccagctctggttcttgtgaacatactctgaacacattgagatatgctgatagggtgaagagtctgtcgaaaggaagcaacaccaagaaagatttgtctttggctgctgcacctttaagggagtcaagtccttccctattggcttcagctgtgccctctttctcatcagccgaggtgatgaatgatatcactgaaaggagcaactttggttggaccaagcaacagtatgtcaaagagcaccaagcaccaacatttgtggatagaatgcaaaaggtgaaagaagataccgaatttagtctgtcaaatggtggttatttcaaggaacaaagaacaaagggtagtgtgccagtgggcatagctgaagtacctgatacagtgtaccagcagggaaggcaaccaactaggaaggctcgtgatttaacttcagacaataatatgagaaattccattgcttatccaattattagaagggttgtaccagatgaagatgagcatctgaacgaactcctccaggaagaggaagatttggtgtctgctcatcggaagcaggtggaagagaccctagacatgatcaaagaggagatgaatttattagttgaagcggatcaacctggcaaccaactagacgactacatcacaagactaagcggtatactctctcagaaagctgccggaattgtcgacttacaggcacgtcttgcgcagttccagaggcgcttaaacgagaataatgtgctgctatatgcccaatgcccttgatcaaaggaagtacctatttgtgatgagaataacgtgcagtatatctgtataccagagcccttgatcagaggagttgcctatttgtcttcactacgaggctaatcagaaaagttggctgtgccactgtttgctggtatgctccgtagagatgcggccttgcctggccaatacagctgcagttcagaacccatagacgcaagacaaacgcagaactagatggctagtttactgcactttgggatcggccgacttcgtaagctatttgtacccgagttgcgccagttgtgtccttctgttacatccttgtgtatatcgtgcaaatcgtgtcgtcacaggattgtcctgttatttgttgctcaacaaatacacttttttttgtctgatgtatgatgaattcagagttttgtgataatccattttgcacccaaacgaagctgattctgtggttga

SEQ ID NO: 1084 - DNA, 2703 bp, Brachypodium distachyon
tttcctttactccaccctgctacgactcgctccgcctcccgttgtcccccagccctgctcttctccgctccccctttcctgccttcctcactccccagcccacacagggcagcacccgcctccgaggcccacctcgccggcgacgatgaacgggggcgggcgacggcgctactcctcggagcagctcctcttcgacgtccccgccaatgccgctgctgctggcggtgtcggcaggtggacccagcgaggtgcggtgcggcgcggggacggggagatcttcgtgtcggtggacccggcgacgccgtcgcggttgcgcggaggggacggggcagccgtggggtctccggggcagaggcagcagttcagccccgggctgcttgatctccacgcctttgacacggaacttatacctgatgtaagacgacagctgcatttctagaagaaattgtttcttttcaagtacaagggatgtatgatggtgctcaaaagtttagctctgccaatggagtgggctttgatgattctgatgtaagcttcgctacaaataagcagataagcaagtccactgtttttgccgagagtaactacctcacggcctttcctgagaaagagaaggtggctcctgttgccaaaatcaaagtggtggtgcgcaaaagaccattaaacaagaaggaaatatctaagagggaagaagatatcatagacattgaacaaagttcaaattctttgactgtccatgagactaaacttaaggttgacctcactgaatatgttgaaaagcatggatttgtatttgatgctgttttagatgaggatgtttcaaatgacgaggtttaccgcgaaacagtggaacctgtggttcctgctatttttaaccgtacaaaggcaacttgttttgcgtatggacaaactggtagtgggaaaacgtacaccatgaggccacttcctttgaaggcctcccaagacattttgagactaatgaaccatacatatcgcaatcagggctttcagttattttttagtttctttgagatatatggtgggaaattatttgatcttctaaacgaaaggaataaactttgcatgagagaggatggaaagcagaaagtttgcattgtcggtttacaagagcacagggtatctgatcttgaaactatcaaggagttgatcgaaagagggaatgcaaccagaagtaccggtacaactggtgcaaacgaggagtcctctcgatctcatgctattcttcaacttgctattaaaaggcgtgttgatggaaatggctccaagccacccagattggctggcaagttgtcgtttattgacctggctggcagtgagcgtggtgctgatacaaccgacaacgataaacaaacaagaattgagggcgctgagatcaataaaagtttgctcgccttaaaggaatgtatcagagcgcttgataacgatcagactcatattcctttccgaggcagcaaactgactgaagtgttgcgagattcattcattggagactcacgcactgtcatgatatcatgcatttcccccagttctggttcttgtgagcatactctgaacacattgagatatgctgatagggtgaagagtctgtcaaaaggaagcaacagcaagaaagatgtgcctttggcttctgcacctttacgagagtcaagtccttccccattgccttcactggtaccctctttctctgcagctgaggtaatgaatgatatcactgaaaggaataattttggttggcctaagcaacagtacgccaaagaacagccagcgccatcgtttgtggatagaatgcccaaggctagggaaaatatggagtttagtttgtcaaatggtggttattttaatggacaagaaaccaaaggtgcttcagcaacaggtatagctgtagtaccagacacaatgtaccagcagggaaggcagcaggcacgtaagggtagagatccagcttcagagaataacatgagaaattctattgcctacccagtcagaagggctgccgtggatgaagatgaccatctgaatgatctccttcaggaagaggaggatttagtgagcgctcacagaaagcaagtggaagagaccctggatataattaaagaggagatgaacttactagttgaagcagatcagcctggcaaccaactcgacgactacgttacacgacttagcagtatactctcacagaaagctgctggaatcgtggatttgcaagatcgtctggcacagttccagaggcgcttaagtgagaacaacgtgctgctatgttccgagagcccttgatcaaaagagtagcctattttggtctctactgcgagggtaatgtggaacttgggggacacagccagagtcaaatcagcatgtgactatgtgagctatgtgaggtcttctgcaccccagccaacgcagatgcgccgttgcagttctgaacccataagatgtggcaaatggagaactagacggctagttcattgctgttttccgtggccaactccgtaacctatttgtacctgagttgcgcccttgtgttcgtgtgctccgtactcccattcgatccatgtgtatgtgtatatccgtctctcatgagttgtcctgctatttgttcatcagcaaatatgctttttttgtccgatgtgtagatttccgagagtcattgtcttccattttgcagtcccgcatatctcattt

SEQ ID NO: 1085 - DNA, 741 bp, Triticum aestivum
cgcataggataggccagaacccaaatccacagccatggcgctcctcctgtcccccaccgtctccttcatcgccccctccccctcttccgctcctcgtgcccgagctctctccagctccaccgccaccgccgccagcaataatgccttcccttacctcgcctcgagacttcagtgcaagaccggcgcctcagtcagccatgtttctcttgccaagaaaatgcccgtagttgtccacgcctctgcagaggctggtgcaactgataccgcggagcaaccagagaagccaaaaccagcggcttcgatcgaggacatgccgctcgagtccaagcagcagatgatcctggagcagagggcacggatgaaggtggccaagaagttgaggcagcggcgcaagcggctcgtccaaaagaggcggctgaggaagaagggcaggtggccaccgtccaagatgaagaagctcaagaatgtctgaccggcacatgatgtcggacagctggtccgtaccattcctttgtaaacctacgtgttgcgttcctctaatgcattggtgtttgtttggtttgtacaatttttctgttctgaaacacataatcggttataatgcaattaaatttttaccataatgaaacctttttgcgtgtccatagcagcagattgatgtgctgttatctgtggttagtctatgttgtacaactgtctgtctgaagcaagttttgggatgttttatttctaaaaaaaaaa

SEQ ID NO: 1086 - DNA, 615 bp, Triticum aestivum
ccagaacccaaatccacagccatggcgctcctcctgtcccccaccgtctccttcatcgccccctccccctcttccgctcctcgtgcccgagctctctccagctccaccgccaccgccgccagcaataatgccttcccttacctcgcctcgagacttcagtgcaagaccggcgcctcagtcagccatgtttctcttgccaagaaaatgcccgtagttgtccacgcctctgcagaggctggtgcaactgataccgcggagcaaccagagaagccaaaaccagcggcttcgatcgaggacatgccgctcgagtccaagcagcagatgatcctggagcagagggcacggatgaaggtggccaagaagttgaggcagcggcgcaagcggctcgtccaaaagaggcggctgaggaagaagggcaggtggccaccgtccaagatgaagaagctcaagaatgtctgaccggcacatgatgtcggacagctggtccgtaccattcctttgtaaacctacgtgttgcgttcctctaatgcattggtgtttgtttggtttgtacaatttttctgttctgaaacacataatcggttataatgcaattaaatttttaccataatgaaa

SEQ ID NO: 1087 - DNA, 684 bp, Triticum aestivum
agaacccaaatccacagccatggcgctcctcctgtcacccaccgtctccttcctcgccccctcctcctcctccgctcctcgtgcccgagctctctccagctctgccgccaacaataatgtcgtcccttacctcgcctcgagacttcagtgcaagaccggcgcctcagttagccatgtttctcttgccaagaaaatgcccgtagttgtccacgcctctgcagaggctggtgcaactgatgccgcggagcaaccagagaagccaaaaccagcggcttctatcgaggacatgccgctcgagtccaagcagcagatgatcctggagcagagggcacggatgaaggtggccaagaagctgaggcagaggcgcaagcggctcgtccagaagaggcggctgaggaagaagggcaggtggccaccgtccaagatgaagaagctcaagaatgtctgaccggcacatgatgttaaacggctggtctttaaacctccgtgttgcgttcctctaatgcattggtgtctgtttggtttgtacaatttttctgttctgaaacacataatcggttatagtgcagttaactatattaccataatgaaatgaaacctttttgcgtgtccatagcagcggattgatgtgcttttaaccaattttagtctatgttgtacaactgtctgtctgaagcacgtttt

SEQ ID NO: 1088 - DNA, 744 bp, Triticum aestivum
ggccagaacccaaatccacagccatggcgctcctcctgtcacccaccgtctccttcctcgccccctcctcctcctccgctcctcgtgcccgagctctctccagctctgccgccaacaataatgtcgtcccttacctcgcctcgagacttcagtgcaagaccggcgcctcagttagccatgtttctcttgccaagaaaatgcccgtagttgtccacgcctctgcagaggctggtgcaactgatgccgcggagcaaccagagaagccaaaaccagcggcttctatcgaggacatgccgctcgagtccaagcagcagatgatcctggagcagagggcacggatgaaggtggccaagaagctgaggcagaggcgcaagcggctcgtccagaagaggcggctgaggaagaagggcaggtggccaccgtccaagatgaagaagctcaagaatgtctgaccggcacatgatgttaaacggctggtctttaaacctccgtgttgcgttcctctaatgcattggtgtctgtttggtttgtacaatttttctgttctgaaacacataatcggttatagtgcagttaactatattaccataatgaaatgaaacctttttgcgtgtccatagcagcggattgatgtgcttttaaccaattttagtctatgttgtacaactgtctgtctgaagcacgttttgggatgttttctgtaaaattttaatttatttcaaacatgatattggaaaaaaaaaa

SEQ ID NO: 1089 - DNA, 579 bp, Pseudoroegneria spicata
ctgtcccctaccgtctccttcctcgccccctcctcctcctccgctccgcgtgcccgagttctctccagctccaccgccacggccgccattaataatgtcgtcccttacctcgcctcgaggcttcagtgcaagactaccgcctcagtcagccatgtttctcttgccaagaagatgcccgtagttgtccacgcctctgcagaggctggtgcaactgatgcggcagagcaaccagagaagccaaaaccagcggcttcgatcgaggacatgccgctcgagtccaagcagcagatgatcctggagcagagggcacggatgaaggtggccaagaagctgaggcagcggcgcaagcggctcgtccaaaagaggcggctgaggaagaagggcaggtggccgccgtccaagatgaagaagctcaagaacgtctgaccggcacatgatgtcggacagctggtctgtgccgtttctctgtaaacctacgtgtttcgttgctctaatgcattggtgtttgtttcgtctgtacaatttttctgttctgaaacacataatcggttataatgcaattaaatctttaccataatg

SEQ ID NO: 1090 - DNA, 715 bp, Hordeum vulgare
cagaacccaaatccacagccatggcgctcctcctgtccccaaccgtctccttcctcgccccctccccctccccctcctcctcctccgctcctcgtgcccgagctctctccagctccaccgccaccgccaccgccaccagcaacaatgtcgccccttaccacgcctcgagacttcagtgcaagactaccgcctcagtcagccatgtttctcgtgccaagaaggtgcctgtggttgtccacgcctctgcagaggccggtgcaactgatgcggcggagcaaccagagaagccaaaaccagcggcttcgatcgaggacatgccgctccagtccaagcagcagatgatcctggagcagagggcacggatgaaggtggcgaagaagctgagacagcggcgcaggcggctcgtccaaaagaggcggctgaggaagaagggcagttggccgccgtccaagatgaagaagctcaagaacgtctgaccggcacatgatgtcggacagctggtccgtaccgttcctctgtaaacctacgtgtttcgttcctctactgcattggtgtttgttcccattgtacaatttttctgttctgaaacacataatcggtcataatgcaattaaattttcaccataatgaaacctttttgtttgtccatagcaacagattgatgcgctgttatttgtggttagtctatgttgtacaactgtctgtctgaagcaag

SEQ ID NO: 1091 - DNA, 716 bp, Hordeum vulgare
ccagaacccaaatccacagccatggcgctcctcctgtccccaaccgtctccttcctcgccccctccccctccccctcctcctcctccgctcctcgtgcccgagctctctccagctccaccgccaccgccaccgccaccagcaacaatgtcgccccttaccacgcctcgagacttcagtgcaagactaccgcctcagtcagccatgtttctcgtgccaagaaggtgcctgtggttgtccacgcctctgcagaggccggtgcaactgatgcggcggagcaaccagagaagccaaaaccagcggcttcgatcgaggacatgccgctccagtccaagcagcagatgatcctggagcagagggcacggatgaaggtggcgaagaagctgagacagcggcgcaggcggctcgtccaaaagaggcggctgaggaagaagggcagttggccgccgtccaagatgaagaagctcaagaacgtctgaccggcacatgatgtcggacagctggtccgtaccgttcctctgtaaacctacgtgtttcgttcctctactgcattggtgtttgttcccattgtacaatttttctgttctgaaacacataatcggtcataatgcaattaaattttcaccataatgaaacctttttgtttgtccatagcaacagattgatgcgctgttatttgtggttagtctatgttgtacaactgtctgtctgaagcaag

SEQ ID NO: 1092 - DNA, 676 bp, Avena sativa
tcactcacctcgcacaagcttatccctccaggtggaggtggtcttcttccgcaaaggataggccagagcccaaatccgcacccatggcgctcctcctatccccaactgtctccttcctcgcctcctcatctgcctctcctcctcgtgtccgagcactctccaacccttccgcggccaacaatgctgtccccttctccgccccgagactgcagtgcaagaatactgcctccttcagccatgtatcactttccaagaagatgccggtaactgtccatgcctccgcagaggctggttcaactgatgcagcagagcaaccggagaagccaaaaccagcggcttcggtcgaggacatgccgctcgagtccaagcagcagatgatcctggagcagagggcacggatgaaggtggccaagaagctgaggcagcggcgcaggcggctcgtccaaaagagacggctgaggaagaagggcaggtggccgccatccaagatgaagaagctcaagaatgtctgaccggcacatcatgtcagacagccggcgctgccgttctgctgtaaaccggcgtgttttgttcctccaatgctctctttgcttaactgatgcattggtgtttgtttcgtctgtacaattttgttgttctgagacacactgctggtataatgcaattaaaatttatg

SEQ ID NO: 1093 - DNA, 676 bp, Avena sativa
tcactcacctcgcacaagcttatccctccaggtggaggtggtcttcttccgcaaaggataggccagagcccaaatccgcacccatggcgctcctcctatccccaactgtctccttcctcgcctcctcatctgcctctcctcctcgtgtccgagcactctccaacccttccgcggccaacaatgctgtccccttctccgccccgagactgcagtgcaagaatactgcctccttcagccatgtatcactttccaagaagatgccggtaactgtccatgcctccgcagaggctggttcaactgatgcagcagagcaaccggagaagccaaaaccagcggcttcggtcgaggacatgccgctcgagtccaagcagcagatgatcctggagcagagggcacggatgaaggtggccaagaagctgaggcagcggcgcaggcggctcgtccaaaagagacggctgaggaagaagggcaggtggccgccatccaagatgaagaagctcaagaatgtttgaccggcacatcatgtcagacagccggcgctgccgttctgctgtaaaccggcgtgttttgttcctccaatgctctctttgcttaactgatgcattggtgtttgttttgtctgtacaattttgttgttctgagacacactgctggtataatgcaattaaaatttatg

SEQ ID NO: 1094 - DNA, 785 bp, Triticum aestivum
  misc_feature (115)..(115): n is a, c, g, or t
  misc_feature (121)..(121): n is a, c, g, or t
  misc_feature (145)..(145): n is a, c, g, or t
  misc_feature (147)..(147): n is a, c, g, or t
  misc_feature (180)..(180): n is a, c, g, or t
  misc_feature (201)..(201): n is a, c, g, or t
  misc_feature (222)..(222): n is a, c, g, or t
  misc_feature (234)..(234): n is a, c, g, or t
  misc_feature (252)..(252): n is a, c, g, or t
  misc_feature (264)..(264): n is a, c, g, or t
  misc_feature (270)..(270): n is a, c, g, or t
tgccaatataacccgccaccccgcccgagtcccacgcacgcccacagctccacacatcgccacggtcttcttggttcctccgtccacagctagccagcccctccgctccgctccnccaccngcagccaaatggcgaagctgctgncngccggcgtcgcgttcctcctggccctcgccgcngcggcggcgctggccccgtcnccggcctcggccttgaagggngccggcgggctnggcctcggcggcgcggcngcggccgtggtnatgcgncggggcgggcggacgtgccggggcacggtgggcgagtgcatggagtacttcggcgtggacggcgagggcgagagcgaggtggcggcgatggccggcaagcggcgggtgctgcaggacgggtccgggtacatcggctacgacgcgctgcggcgggacaacgtgccgtgctcgcagcgcggtgcctcctactacaactgccagcccggagccgaggccaacccctactcccgcggatgcagcgccatcacccagtgcaggggctgatccccttcattaaaccctgcttcattccttcttaccacctgcatgcctcatcaattagtattgctatctatctgtaacgtaatgtaatgtaatgtaattacaagaagaagatcaaacacttcttgacgatgcttgatcaatcatcactggtgggggtggtgtggtcaatcgtaccgtacggatcactggaggaggcgtggttaattatcgtgtcatttgtgcctattgggtgaaagtaattaagcttacgc

SEQ ID NO: 1095 - DNA, 961 bp, Hordeum vulgare
ccacagctacacacatcgccacggtcttcttggttcctccgtccacagccagccagctccgctccaccacctgaagccaaatggcgaagctgctaccagccgcagtcgcgttcctcctggccctcgccgccgcggcggcgctggccccgtcctcggcctcagcgttcacgacgaccgtgaacggcgccggagagcttggccttggcggcgcagcggccgtggtgatgcgccggggcgggcggacgtgcaggggcacggtgggcgagtgcatggagtacttcggcgtggacggcgagggcgagggcgaggtggcggccatggccggcaagcggcgggtgctgcagggcgggagcgggtacatcggctacgacgcgctacggcgggacaacgtgccgtgctcggagcgcggggcctcgtactacaactgccagcccggcgccgaggccaacccctactcccgcggatgcagcgccatcacccagtgcaggggctgattcattaaacccttcttcatgtcctcttacctgcatgcctcatcaactagcagtactagtagtactatctatctgtaatgtaacgtaacgtaattacaagaagaagatcaaaacactagttgatgatgcttgatcaatcatcactggctggtgtgatcaatcgtactgtacgtatcactgggggaggcatggttaattattgtgtcatttgtgtctatttgggtgaaagtaattatgcttacgcattttggtgcatctgaattcggttgtgcctaaataattgcagaggcctttgcaaaaaaaaaaaaaaaaacccgacatagtctcagaacagccatgccacgcatgttggtcctggctaattcttctggctgcctttcccaggctgacagacttggtccgactgcttgacaccacggggaacgtcaacgctggcgggaattatcagctcccggaaacaacttagg

SEQ ID NO: 1096 - DNA, 949 bp, Hordeum vulgare
acatcgccacggtcttcttggttcctccgtccacagccagccagctccgctccaccacctgaagccaaatggcgaagctgctaccagccgcagtcgcgttcctcctggccctcgccgccgcggcggcgctggccccgtcctcggcctcagcgttcacgacgaccgtgaacggcgccggagagcttggccttggcggcgcagcggccgtggtgatgcgccggggcgggcggacgtgcaggggcacggtgggcgagtgcatggagtacttcggcgtggacggcgagggcgagggcgaggtggcggccatggccggcaagcggcgggtgctgcagggcgggagcgggtacatcggctacgacgcgctacggcgggacaacgtgccgtgctcggagcgcggggcctcgtactacaactgccagcccggcgccgaggccaacccctactcccgcggatgcagcgccatcacccagtgcaggggctgattcattaaacccttcttcatgtcctcttacctgcatgcctcatcaactagcagtactagtagtactatctatctgtaatgtaacgtaacgtaattacaagaagaagatcaaaacactagttgatgatgcttgatcaatcatcactggctggtgtgatcaatcgtactgtacgtatcactgggggaggcatggttaattattgtgtcatttgtgtctatttgggtgaaagtaattatgcttacgcattttggtgcatctgatttcggttgtgcctaaataattgcagaggcctttgcaaaaaaaaaaaaaaaaacccgacatagtctcagaacagccatgccacgcatgttggtcctggctaattcttctggctgcctttcccaggctgacagacttggtccgactgcttgacaccacggggaacgtcaacgctggcgggaattatcagctcccggaaacaacttagg

SEQ ID NO: 1097 - DNA, 892 bp, Brachypodium distachyon
ccgacgcaaccatggcaaagctgctagcagcgatcctcttcctggccgcggccctcttggcggcgctcgctccttcgtcgtcatcggcggcgacggccatgggcagcggcggcggcgtggcggcggcggtggtattgcggcggggcgggcggacgtgccggggcacggtgggggagtgcatggagttcttcggcgtggacggcgagggcgaggaagaggtcgcggccatggcggggaagcggcgggtgctgcaggacgggtccgggtacatcggctacgacgcgctgaagcgggacagcgtgccgtgctcccagcgcggggcgtcctactacaactgccagcccggcgccgaggccaacccttactcccgcggctgcagcgccatcacccagtgcaggggctagctagttccttccgtctcgatcttctgataatcacccgcaatgtagttctactggtgctgcagtgtgtaattgccagaattaagatcaatcgcttctgcaagatgtcttgatcggtcgtgcttgctctggagcggtgaatcgatttgaagtggtaaattaaccaaccggtttgttgtggaatttctctctttttgggtgaaaagtagcaaggttggttaaggtttgtgtaacttttgttctgcgtgcattttggtgtctctgactttgtgcagacgtttgattgatgtttgcctcagttttaagttttaactgctgcaccattccggcccatggcgtaatccctttggtgaagaaatgtggagtactagtataaatttttccttttattggttgtgatgtactacgaaattctgtgggattggcatgccgattcctggagcccttttctgaaaagaaacatcaatgtctctcgagttgagctgtctttt

SEQ ID NO: 1098 - DNA, 409 bp, Triticum aestivum
gctttcttggttcctccgtccacagcgagccagctccgctccaccacccgcagccaaatggcgaagctgctgccggccggcctcgcgttcctcctggccctcgccgcggcggcggcgctggccccgtccccggcctcggcctcggccttgaagggcgccggcgggctgggactcggaggcgcggcggccgtggtgatgcgccggggcgggcggacgtgccggggcacggttggcgagtgcatggagtacttcggcgtggacggcgagggcgagggcgaggtggcggcgatggctggcaagcggcgggtgctgcacgacgggtccgggtactcggctacgacgcgctgcggagggacaacttgcgtgctcgcaccgcggcgcctcctactacaactgccaacccggcgcc

SEQ ID NO: 1099 - DNA, 2950 bp, Solanum phureja
gtcttcgttctctccttttatcgcactgaaaataccttcagatttacttttaactgtttgtgacggtgaaatgaatcagaaccgttaaactttatagatgcttttgaaagccctccgagtcttccatttcatcttcatcttctatttctctctttctgatacccactgggcactgtgaaactaatctgttcattgaatcgttgatttatagagacggagagagaggtttcagctgattgattgtgctttggaggtgtggaaatttgttgtttgtggaagaagaggagattggatttaatcggagattgaagtagtgaaaaaacatgaatgcagttggcaggcaaagatctggaacatcgacggggcatcaccagaggcaatactctgataacttcctggagacttcatctaatggaagatggcttcaatcagctggtcttcagcatcttcaaacttcaaataataatgttcctcaggctccacaggaatatggatactatggtggagctcaagggtcgagaatgcttagaggtgcacagaggacatatagtggaggaagcgatctctttgcggagcctttgacgccgccgggaaatcatcgacagtcaagccagagaaggaatggtgacgaagaagtctatcccaatgagttcagtcctggactcttagatctacactcattggatactgagcttttaccagagatgcctgttgctggtttgtatgatgctccttccatgcatcactttgctcgagcaaaaagctttgatgactcggagcaattccttgcaaacaacaagcaaactggtagagttcggggattgccagagagtaatgtctctaagagttttgctgttgataaagacaaggccagcaatgtcgcaaagatcaaagtggtggtgcgtaagcgaccactaaacaaaaaggaattaacgaagaatgaagaagacatcgttgaaacacgtttcaactctctagtagtccatgaaactaaactaaaggttgatctgactcaatatgttgagaagcatgagtttgtctttgatgctgtgctaaatgaggaggtttcgaatgatgaggtataccatgaaacagtggagcccattgtcccaataattttccaacgcacaaaagctacttgctttgcgtatgggcaaacaggaagtggcaaaacgtataccatgaaaccactacctctgagggcatctagggatcttttgaggctcattcatcatacataccggaaccagggttttcaattgtttttcagtttttttgagatatatggtggaaagctctatgacttgcttaatgatcggaagaaactttgcatgagagaggatggtaaacaacaagtatgtatagttggattgcaagaatacagggtctctgatgtggagatgattaaggagctcattgacagaggaaatgcaactagaagtactggcaccactggtgccaatgaggaatcatctaggtcacatgctattctccagctttctgttaagaggtcagctgacggtagcgaatctaaacctccccgtgttattgggaagctctccttcatagaccttgcaggaagtgaacgtggtgcagacacaactgataatgataagcaaaccagaattgaaggagcagagattaataaaagtttgctggcactaaaggaatgcattagagcccttgacaatgatcaaaaccatattccttttagaggcagtaaattaactgaagtgctgagggactcttttgttggaaatagtcgtactgttatgatatcttgcatttccccaaatgcaggatcttgtgagcatactttaaatacattaagatatgctgacagggtgaagagtctttcaaaagggaacaactcaaagaaggacgtctcatcctcaacattgaatctgaaggagtcgacaacattatctttttctgcagttgtaccttctacatcaacatttgaagatgataccggtgattcatggcctgaacaaattgacaaagatgaatatgatgaagatttctatgtacaagagaagccaatgtggaagaagaatgagaagcttgatggttacactatctccaattcagaagataaaatgaagagagcaaatgctcagacaaagtggaaggagccacctagaacagaggcaaagtattcaaactcggatgatgatctgaatgctctcctaaaggatgaggaagatcttgtgaatgcgcatcggaaacaagtggaggaaacaatggacattgttcgagaggagatgaatctattagttgaggcagatcaaccagggaaccagctggacaattatatttctcgattaaatgcaatcctttcacaaaaggctgctggcatcctagagttgcagaaccagttagctcattttcaaaaacgtctaaaggagcacaatgttcttgtatcttctggcaactgaagctctaattcagtatgcatacaaaattccgatgttgtgcacatttgctttgggacgaggtgttgttgtagatccactaatggacccataggtgttggtgtagaaaacatgtggcttgcaaaaattcacatgctggtttcttcagaagagtttttgaagccttctgttaagttacacaagaatcttgtcattgtttattcattttctcatttgaaaagaaaaaaatacgatagatgctttggcatggctttaaggctttctgttgctaagattattatttgttgattgatctgccgagtggaagaggcatttgctatgttttgggggcacaaatttgtttaatctggtcctgcctgcaaagtctatcatagatgactggtggaggatctggccaagtctggtgtaattgattgtacaattgctatattttcattgtagctgtgtgccatgagccacatgcatcaacatattgctacgaaatgagctcttggaatctactcaattactagaga

SEQ ID NO: 1100 - DNA, 2112 bp, Nicotiana tabacum
atgaatgcagtaggacggcaaagatctggaacgtcgacggcgcatcaccagcggcaatactccgataacttcctggagaactcatccaatggcagatggcttcaatcagctggtcttcaacatcttcaaacttcaaatacctctattcctcctccacaggattatggatactatggtggagctcaaggctcgagaatgtatagaggtgcacagaggacttacagcggaggaagcgatctctttgcggagcctttgacgccgccgggtaatcctcgacagtcaagccagcggaggaacggtgatgaagaaatatctcccaatgagttcagtcctggactcttagatctacactcattggatactgaacttctacctgagatgcctgttgctggcttgtatgatgctccttccatgcatcattttggtcgagcaaaaagctttgatgactcggagcaattccttgcaaacaacaagcaaactggtcgagttcggggcttaccagagagtaatgtttctaagagttttgctgttgataaagaaaaggccagcaatgttgcaaagatcaaagtggtggtgcgtaacgaaccactaaacaaaaaggaattggcaaagactgaggaagacatcgttgaaacacgtttcaactctctagtagttcatgaaactaaactcaaggttgatttgactcagtatgttgagaagcatgagtttgtctttgatgctgtgctaaatgaggaggtttcaaatgatgaggtataccatgaaacagtagagcccattgtcccgataattttccaacgcacaaaagctacttgctttgcatatggacaaacaggaagtggcaaaacgtataccatgaaaccactacctctgagggcatgtagggatcttttgaggctcattcatcatacttaccggaaccagggctttcaattgtttttcagcttttttgagatatatggaggaaagctctttgatctccttaatgatcggaagaaactttgcatgagagaggatggtaaacagcaagtttgtatagttggattgcaagaatacagagtctcagatgtggagatgattaaggagctcattgacagaggaaatgcaactagaagtactggcaccactggtgcaaatgaggaatcttccagatcacatgctattctccagctttctgttaagaggtcagctgatggcagtgaatcgaaacctcctcgtgttattggaaagctctccttcatagaccttgcaggaagtgaacgtggtgcagacactactgataatgataagcaaaccagaatcgaaggagcagagattaataaaagtttgctggcactgaaggaatgcattagagcgctggacaatgaccaaaaccacattccttttagaggcagtaaattaactgaagtgctgagggactcttttgttggaaatagtcgtactgttatgatatcttgcatttcccctaatgcaggatcttgtgagcatactttaaatacattaagatatgccgacagggtgaagagtctctcaaaagggaacaactcaaagaaggacgtctcatcctcaacattgaatctgaaggagtcaacaaatttatctttttctgcagttgtaccttctacatcaacatttgaagatgatacaggtgattcatggcctgaacaaactgataaagatgaatatgatgaagatttctatgaacaagagaagtctatgtggaagaagaatgagaagcttgacagttacagcatctccaattcagaagataaaatgaagagaacaaatgttcagacaaagtggaaggagccacctagaacagaggcaaagtattcaaactcggacgatgatctgaatgctctcttaaaggaagaggaagatcttgtgaatgcccatcggaaacaagtggaggaaacaatggacattgttaaagaggagatgaatctattagttgaggcagatctaccagggaaccagctggatgattatatttctcgattaaatgcaatcctttcccaaaaggctgctggcatcctgcagttgcagaaccagttagctcattttcaaaaacgtctaaaggagcacaatgttcttgtatcttctggccactaa

SEQ ID NO: 1101 - DNA, 2264 bp, Manihot esculenta
gtagtgatgagtagagagcaaaagagaggaaagcaagagaaaggctctgatgtggccgagaaagttgtagttgcagttaaggcatctaaggagattcctaagactgccttggtgtgggctttgactcatgtcgtgcatgctggcgactgcattactttgcttgttgttgtcccttcacagagttcaggtcgaaagctatggggtttccctagatttgcaggggactgtgccagtggtcaccggaagtctcattcaggagcaacctctgagcagaagtgcgatattacagattcctgctcccagatgatccttcagctccacgatgtttatgatccaaacaagatcaatgtgaagataaagatcgtttctggctcaccttgtggggcagtggctgcagaagccaagagggcgcaggccaattgggttgtattagacaagcagctaaagcatgaggaaaaacggtgcatggatgaactgcaatgcaacatagtcgttatgaaacgttcccagccaaaggttcttcgcctgaatttggttggatcatcgaaggaagctgaaagtgtgggtaaattgccttctgaaccagatgaagcttctggggaacatactaaaaataaaaatgattcttcagattcaattcgaggacctgttgtgaccccgacaagcagtccagagctagggacaccatttactgccactgaagttggaacatcatcagtgtcgagtgatcctggaacttcaccattttttacctcggaaacaaatggagacctgaagaaagaggaatccctaattgttaaggaaaatagggatgttgatgaatctagttcagacacagatagtgaacacttatcatcagcttcagcaagtttgaggtttgagccatggatgggagaattcattagttctcacattcaatcctcacgacgtatggaggaagtctcacaaagaagtaccaatatggcgcaagaatcaacaactaaagccttgctagagaagttctcaaagcttgatagacaaattggagctggaatgtccaactacaggacagatttagagttaagcggaaatgtgagagaagcaacatcattgtccagaaatgcccctcccggaccccctcctttgtgctcaatatgccaacacaaggcacctgtttttggaaaacctccaaggtggttcagctatgctgagttggagcttgcaactggtggattctcgcaagctaatttcttggcagagggtgggtttggatctgttcacaggggcgtattgccagatggtcaggcagttgctgtcaagcaacacaaattggctagttcacagggggatcttgaattttgctccgaagttgaagttctgagctgtgctcagcatcggaatgttgttatgctgattggattttgcattgaagacaaaaggaggttgttggtatatgaatatatatgcaatggttcactcgattctcatctttatgggcgtcatcgggagccattggagtggtctgcacgccagaaggttgctgttggagctgctagaggattgcgctatcttcatgaagaatgcagagtgggttgcattgtccaccgtgatatgcgcccaaacaatatcctcattacccatgattttgaaccactggttggggattttggccttgcaaggtggcaacctgatggagatacaggtgtagaaactagagtcattggaacatttgggtacttggctccggaatatgcccaaagtggccagataactgaaaaagctgatgtctattcgtttggggttgtattggttgagcttgttacaggaaggaaagcagtagatctcaaccggcccaagggccagcagtgtctaactgaatgggcacgcccactgttggaggaatatgccatagatgaactgattgacccccggcttgggaactgctactcagagcaggaggtttactgcatgcttcatgcagcatcattatgcatacggcgagatcctcactctagacctcgcatgtcacaggttctccgcatactagaaggtgacatgctaatggatgcaaattacacgtcaacacctgggtatgatgtgggtaaccggagtggtcggatttgggtagaacggcagcagcaacattatagtggtccgatgtcaaatgaggctgtggaagggttcagtaagctttctttggacacactaaggccagtcttctgggaaagggataagggcagaaagatctcatatgaagaagatctatgaaaattggggaaaaatac

SEQ ID NO: 1102 - DNA, 4085 bp, Theobroma cacao
atttatttccattttggcgctcttctttctttctttctttattttattttaagtgaaataaattaatatttatccgtactcgttcattgagcttgcttgtttttattgttgctgagatgatgtgaaagaacaagaggacgaagaagaagaagaagaagcagcagtgtgagttaaaaaataatataatattaaaatggaaacaaatgagtaactatttcgtgtctgggtacgaaacctgttgtttcccatgttttttcattgccaaaaacctattcaactaagttagcctttcttttcctttttttcttcttttttctttcttttttctttcgatcaaagtttcttcctttttgtcgatgggcatctgggtttttgttcgaaaacaattttatggtgcttgaattgttagaaagtttactggactggaacttggtttgtggcttgaatttgaggctttaaatgggtgcttctcttttccttttaaagtttcaaatttgaggtctgttagtagttgtgaagattcaacagtcaaatccatctacaagaaagctactggctcgcaactataccttctattgtcatcattgtgatttgatcgtctttgtatggacgcctccacaagagaatcaaagaccagaagtttttgttctgtttctgtcaagaactgaacagaaaaaggaggggaaactgatctttggatccaaaaatacacagctcatttttcttgttttatagctgttactttcactggtttgactccgtgatttgaaccccttacacaaaaaaaagaagcaaagtagttgtgttatatagatgcatttaggttcactttttcaggtagctgtcgctttgcagttcatgtcaaacattgactaaagtttcacaagaaagtgaaactaagaggtctttagtgtgggggtttttttggaagggtgagcgattcctgaggagttcatgtgaatcagtgaaaagggtcttgtcattggtgctggtatctgtctgtctctctgcagattatctggaatggaatagttagccatgtcggttgtacatgccctagaatccagtatggtgggggcagatcaataatgcaaatgttttgttttgtttgtgcctttttaagacatgtttttttggcctctaccatgataattggtattaagataggcttttaagagttgaatctgttaaggaagtttcatagaaattctttgtgccaaatgagtcgagagcagaagaagggaaagcaggaaaagggtggaacggatgtggccgagaaagttgtggttgctgttaaggcatcgaaagaaattcctaagactgctctggtttgggctttgactcatgttgttcaacctggagattgcattacgttgcttgttgttgtaccttcccatggttcaggtagaaaatggggttttcctagatttgctggggactgcgccagtggtagccggaagtctcaatcaggatcaagttcagagcagaaatctgatatcactgattcctgctcccaaatgatcctccagctccatgatgtttatgatccaaacaagattaatgtcaagataaaaattgtttctggatcaccatgcggagctgtagctgcagaagccaagctagcccaagctagttgggtagtattggacaagcagctaaaaaatgaggaaaaacgctgcatggaggagttgcaatgcaacatagtggttatgaagcgttcacaggcaaaagttctccgcttaaatctggttggatcacccaagaaggaagctgatgcttcttgtcaattaaattctgagatggatgaaaggtctgaaaagcatcccaaaagcaaaaatggatcatctggttctattagaggcccggctgttactccaactagtagtccagagctagggacaccatttactgctactgaagcaggaacttcttcagtgtcaagctctgatccaggcacttcaccttttttcatctcagaagggaatggagacctgaagaaagaggaatcaattgtcatcaaggaaaatcaggatcttgatgaatctagttcagacacagagagtgaaaatttatccttatcttcagcgagtttaaggttccaaccatggataacagaatatcttacttctcatcatcgatcctcacagcacctagaagaaacttcaggtagagctaatgacagggctcaagcttcaacaacaaaagccttgctggagaaattttcaaagcttgatagagaagctggaattggaatatcaagctttaggagtgatactgaatttagtggaaatgtgagagaagcaatttcattatccagaaatgcccctcctggccctcctccattgtgttcaatatgtcagcataaggcacctgtttttggaaaacccccaagatggtttacctatgctgagttggagcttgcaactggtggattttcacaagctaatttcttggctgagggtgggtttggatctgttcatagaggagtactcccagatggccaggcaattgcagtcaagcaacacaaattggcaagttctcagggagatcttgagttctgctcagaagtggaagtcctcagctgtgctcagcacaggaatgtcgttatgcttattgggttctgcattgaggatagaaggcggctgctggtttatgagtacatatgcaatggatccctagattctcatctatatgggcgtcaccgggaacctttagaatggtctgcacggcaaaagattgctgtaggagctgctagaggtctgagatatcttcatgaagaatgcagagttggctgcattgtgcaccgtgacatgcggccgaacaacattctcatcacccatgattttgaacctttggttggtgattttggccttgcaagatggcagcctgatggtgatactggagtggaaacaagagtaatcggaacatttgggtatttggcaccggaatatgctcaaagtggccaaatcacagaaaaagctgatgtttattcctttggagtggtgttaattgaacttgttactggacgaaaagctgtggaccttaataggccaaagggccagcaatgtctaaccgaatgggcacgcccacttttggaagaatatgctatagatgaattggttgacccaagattgggtgattgctattcagaacatgaggtctattgcatgcttcatgcagcatcttcatgcataaggagggatcctcattctaggcctcgcatgtcacaggtgctgcgcatattggaaggcgacatgctcatggacacaaattacacatcaccaggatatgatgtagggaaccgcagtgggcggatatgggcagagcaaaaacagcattacagtggacctctggtaaatgaggcatcggaagggttcagtggtaagctctccctggaagggctaaggccaggaaccaggaggaagtcctgtgaagaagatttgtaagaagctcagctttcgagtttatttttacacgcatggtacgctgaaaatatttgtggccttttttgttatattttcatttgttccaatgccatcttcattttgcttttgtatagtagtagtattggaagcaagggtaatagggtttttgtaattctttttggaaatggcgatggttggtgaatatgccttctaattaaatcaatgaagcagctcgaggaatatcatatggttctctctttctctctctctcacgtgtctatgggtttgtgattttgtttgatagtgaatggcaggacagttgacagatcttttgaatcttgttggtgggcaaaagttgaatgtcttggcacttgattgtaaggtggttgtttcccatttttgatacttgttagcagccaaaagtggtctgaggttttgtcttgcatctacaagcaaacaaaacttaggaaaacatgagactgactgtaaaaagcattcgactagagggtgaggtgagggtgaaacatccttatctaccctgtaaatttctttcttttgaaatttcaaactttattgaaacttaccctgctcttctcccgatgacaagtctgagagatttgcagaagacaggccattaaagaatcaagcaggattcctttt

SEQ ID NO: 1103 - DNA, 3592 bp, Ricinus communis
aaggaaagagacacgaatataatatttatagcacagaggaagaagaagaagaagatgatattttcttttttgtgctcatctctacaaacaaattgtatgcgaaaaatttgtttacttgtttctttatagggaaagcctaaagattttcgcgctccctcagcttttcactctctgtttctattatgactacgtgacttgtttccaattttagggagagtaatggtgtttgatgcttaagagaacttaaattgaaggtctttttctttttaaaaaaataaaattagaaaagggaaagattccatagtcaaatccaccagtaagaaagcttgagttttgtgaatgatcttgtatagtcttgtatttggacaaaggtacacatagagaatctattcttctcagcactggctcaatctcaatctgggatctcgctgttatttttttaaccgtttgggagctgttcttttacacttcttttgaccatctgattgaagggggctcaaaaagcaatgctagttttgtaatggcagatagtcagtctttggctctgttgtgtctttttccatttcgccaattagtgttctgtggattctttcttgtgtaactttttttttttaagtagaagaagagcaagctgagttcttttttctgtttcattctttgtcaaatttgtgccaagcggaatttcttgccttttgaactgaaagggtactatctggatcctgaagatttcttgttactatctgtggatcaagaaagaaagacaacttctgaattgcgtttgttctcttgtgatgggaatatggatgaaatggtgaaaatggtcttgtcaatggaggcatctcttcttctgttataactctgggaagggtatggttgtcggtggtacatgttttattgaatccaacatggtgggggcagagcaataatgcgtgatacttctttttgtgtctttaaggctttttttctttgttggggtctctcgatgggttttttgaaaatctgatctattgaaggcacaaagaggaggatttatatacaattgtgagtggtggtaatagtagttatgagtagagagcaaaagagaggaggaaagcaagagaaaggcggctcagatgtcgccgtgaaggttgtagttgccgtcaaggcatccaaggaaattcctaagactgccttagtgtgggccttgactcatgttgttcaagctggggactgcattactctgcttgttgttgtcccttctcatagtccaggtcgaaaattatggggtttcccaagatttgccggggactgtgctagtggtcaccggaagtctcattcaggagctacctcagagcagaggtgcgatattactgattcttgctcccagatgatccttcagcttcatgatgtttatgatccgaataagatcaatgtgaagataaaaattgtttctggatcaccttgtgggtcagtggctgcagaagccaagagagcgctggccaattgggttgtattagacaaacagctgaagcatgaggaaaagcgttgcatggaagaactacagtgcaacatagttgttatgaaacgtacccagccaaaggttctccgcttaaatttggttggaacatcaaaggaagcagaaagtgctatccctttaccttctgaactggatgaggctcctgataaacaaaccaaaaataaaaatgattcctcagattctattcgaggaccggttgtgactccaaccagcagtcctgagttaggcacaccatttacagctactgaagttggaacatcatctgtgtcaagtgatcctggaacttctccattttttatctcagacacgaatgcagacctaaagaaagaggaatcattagtcattaaggaacatggggatgttgatgaatctagttctgacacagacagcgaacatttatctacagcttcagcaagtttgaggttcgaaccatggataggagaaatcctcagttctcatattcaatcctcgcgacacatggaagaaggtccacaaagaagaaccagtatggctcaagcatcaacaactaaagctttgctagaaaagttctcaaaacttgatagacaaactggaattggaatgtcgaactataggactgactcagacttgagtggaaatgtgagagaagcaatatcattatccagaaatgcacctcctggcccccctccgctgtgctcaatatgtcaacataaggcacctgtttttggcaaacctccaaggtggttcagctatgctgagttggagcttgcaactggtggattttcacaagctaacttcttggcagagggtggttttggatctgttcacagaggtgtgttaccagatggacaggcagttgctgtcaagcaacacaaattggctagctcgcagggggatcttgaattttgctcagaagtagaagtcttaagctgtgctcaacataggaatgttgttatgttgattgggttctgtattgaggacaaaagaaggctgttggtatacgaatatatatgcaatggatcactagattcgcatctatatgggcgtcatcgggagccattagagtggtctgcacgtcagaggattgctgtgggggctgctcgagggttgcgctatcttcatgaagaatgcagagtaggttgcattgtccaccgtgacatgcggcctaacaacatcctcattacccatgattttgaaccactggttggggattttggcctggcaagatggcagcctgatggcgatactggtgttgagacaagagtgattggaacatttgggtatttggctccagaatatgctcaaagtggtcaaataacagaaaaggctgatgtttattcctttggggttgtattggttgagcttgtgacaggaagaaaagcagtggatcttaaccggcccaagggccagcaatgcctcactgaatgggcacgtcctctgttggaagaatatgccatagatgaactgattgacccacaactagggaacaactactcagaacaggaggtttactgcatgctccatgcagcatcattatgcatacgccgggatccgcactctaggcctcgcatgtcacaggttctgcgcatacttgaaggtgacatgctcatggattcgaattatgcttcaacacctgggtatgatgtgggaaaccggagcggccgaatttgggccgagcagcagcaccagcaccagcaccaccaacaacattacagtggtccgctggcaaatgaggcattagaagggttcagtaaactctctttagatacgctacggccagctttctgggaaagggagaaggctagaaggatttcatgtgaagatgatttgtaaagtgttaatcaaccataaacttgtatggtacgctaaatatatccctggccttttttgcattcagtatttgtaatttcttttttgccctaaatagtttggttcagtgccatctagattttgatttgtatagtagaagggaaagtagggttagtaatgctgtgtaattcttttggtaaatgatagaagcttattaaatgctaatgatggtattagtgaaaatacaatttccctttaaatcaatgaagaagcttcagcctttcaggt

SEQ ID NO: 1104 - DNA, 3295 bp, Citrus clementina
ggttgctgttgcacactgtgtaatatataaactcttccaaatttcacttcattttcgctctttcactctcatgactaaatctggctctgggtgcttagcaatggtttgattttgttgaaaattgagtttgctttaccagtttaaaagaatcaatagtcaaatccagcaacacaaaaagcttcgatgtttgtatagtaaataaacccttctctcttgtcattcaatgatttgatgagtctttggccggacactgagacaacagaatctactctgcgcatacactgttttcccatttctgatattggatttccttaccacctgtagtttggctgttctttcacatctgttgactttatttactgatttggaggatcaaaagcaatatactagagtgatatatacaccaaaagaatatctagatcatcaagattgcggcacccatttggggaacatatcaaaagatgagctggtgaaggtggcttctgtcatttgtgtgcttcttgagggattcatgtgaatcagttaaaacggtcttgtcatttctgaaaatttgttgtctctacaattgcctggatggaacgagattacgtgattgaagttgtcggatcaaagatggtgtgggcacaccaataatgcacaatatgttcatttgtgtctaaaagacacattttttagcctctttcatacgtattggatgatgggttttcagaattgaaaatattaagggaaggaagtttcacagaaattctttatggcaatgagtggagaagtgaaaaaagggaagcaggagaaaggtagttccgatgtggctgagaaggtggttgttgctgttaaggcatcaaaagagattcctaggactgccctcgtttgggctttgactcacgttgttcaaccaggggactgcattacgctgcttgtggttgtcccttcgcatagttccggtagaagattttgggttttccccagatttgcaggtgactgtgccagtggtcaccggaagtctttttcaggaacaatctcagaacagagaggtgatattacagattcttgctcgcagatgatccttcagcttcatgatgtttatgatccaaacaagattaatttcaagattaaaattgtttctggatcaccttgtggagcggtggcagcagaggccaaaaaggctcaagctggttgggttgttttagacaaacagcttaaacatgaggaaaagtgctgcatggaggagttgcaatgcaacatagtggttatgaagcggtcacaggctaaagttcttcgcttgaatttggttggaacatccaagaaagaagctggagttgcttgcccattgccttctgacccagatgaatcatttgaaaaggatccaaagaacaaggacagttcttcgggttccatcaggggacctgttgtgactccaactagcagtccagagctagggactccatttactgcaactgaagctggaacttcatcagtgtcaagctcagatcctggaacttcaccattttttatctcaggaattaatggagatttgaagaaggaatcatcagtcattagggaagaccggaatcttgaagactctagttcggacacagacagtgaaaatttgtctgtgtcatcggccagtatgaggttccaaccatggatgacagagtttcttagatctcatcatcagtcatcacaccagatggaagaagaatgctctagaagaactaataataagactcaagcatcgacaactaaagctttgcttgagaagttctctaggctcgatcgagatgctggagttggaatgtcaagctatcggactgacttggaattcagtggaaacgttagagaagcaatatcactatccagaaatgcgcctcctggccctcctccattgtgctcaatatgtcaacataaggcgccggtatttggcaagccaccaaggtggtttagctatgctgaattggagcttgctaccggcggcttttcacaagccaatttcttggcagaaggtgggtttggatctgttcataggggggtactgccagatggtcaggcagttgctgtcaagcaacacaaattggctagttctcaaggggatcatgaattttgctcagaagtggaagttctgagttgtgcccagcacagaaacgttgttatgttaattggattctgtattgaggacaggaggaggttactggtttatgaatatatatgtaatgggtctctggattctcatctatatggatgtcatcaagagccattagaatggtctgcacggcaaaagatcgctgtgggagctgctcgaggtctgcgatatcttcatgaagaatgcagagtgggctgcattgtgcatcgtgacatgcgaccaaataacatccttctcacccatgattttgaaccactggttggagattttggccttgcaaggtggcagcctgatggtgacatgggtgtggaaacaagagtaattggaacatttgggtatttggcgccggaatatgctcaaagtggccagattactgaaaaagctgatgtctattcatttggtgtggtattagttgagcttgttactggacgaaaagcagtggacctcaaccgaccaaagggccaacaatgtcttactgaatgggcacgtccgcttcttgaagaatatgctatagatgaactggttgacccaaggctagggaatcactattctgaacatgaagtatattgcatgcttcatgctgcatctttgtgtataaggcgcgatcctcattccaggccccgcatgtcacaggtgcttcgcatattggaaggtgacacggtcatagacacttacatgtcaacacctgggtatgatgttggcagccggagtggacggatctgggtagagcagcagcagcatcagcaacagcaactaccttatagcggtcccttgatgaatgaggctttggaaggatttggtaggaagctcccccttgattcgctaaaggcagccttttgggaaagggataaggccagaaggacctcccgtgaaaatgatctgtaaagagcttacctttcatatcaactagtagctgctaaatacgtattttggtccttttgtaatccccccttttacccagttctaggttctttctatttttttcccaatgtccatctatattttgctcatgtatagtggtagggaaagtaggcaaagttaagcttttgtaattctttcgaaaaaatggaggaagctgagagtatcatgttcttagttctatctcatctgtgtgccttttggctaaatcaattaagccttacatggattatgccttca

SEQ ID NO: 1105 - DNA, 3223 bp, Citrus sinensis
agactaaatctggctctgggtgcttagcaatggtttgattttgttgaaaattgagtttgctttactagtttaaaagaatcaatagtcaaatccagcaacacaaaaagcttcgatgtttgtatagtaaataaaccccttctctcttgtcattcaatgatttgatgagtctttggccggacactgagacaacagaatctactctgcgcatacactgttttcccatttctgatattggatttccttaccacctgtagtttggctgttctttcacatctgttgactttatttactgatttggaggatcaaaagcaatatactagagtgatatatacaccaaaagaatatctagatcatcaagattgcggcacccatttggggaacatatcaaaagatgagctggtgaaggtggcttctgtcatttgtgtgcttcttgagggattcatgtgaatcagttaaaacggtcttgtcatttctgaaaatttgttgtctctacaattgcctggatggaacgagattacgtgattgaagttgtcggatcaaagatggtgtgggcacaccaataatgcacaatatgttcatttgtgtctaaaagacacattttttagcctctttcatacgtattggatgatgggttttcagaattgaaaatattaagggaaggaagtttcacagaaattctttatggcaatgagtggagaagtgaaaaaagggaagcaggagaaaggtagttccgatgtggctgagaaggtggttgttgctgttaaggcatcaaaagagattcctaggactgccctcgtttgggctttgactcacgttgttcaaccaggggactgcattacgctgcttgtggttgtcccttcgcatagttccggtagaagattttgggttttccccagatttgcaggtgactgtgccagtggtcaccggaagtctttttcaggaacaatctcagaacagagaggtgatattacagattcttgctcgcagatgatccttcagcttcatgatgtttatgatccaaacaagattaatttcaagattaaaattgtttctggatcaccttgtggagcggtggcagcagaggccaaaaaggctcaagctggttgggttgtattagacaaacagcttaaacatgaggaaaagtgctgcatggaggagttgcaatgcaacatagtggttatgaagcggtcacaggctaaagttcttcgcttgaatttggttggagcatccaagaaagaagctggagttgcttgcccattgccttctgacccagatgaatcatttgaaaaggatccaaagaacaaggacagttcttcgggttccatcaggggacctgttgtgactccaattagcagtccagagctagggactccatttactgcaactgaagctggaacttcatcagtgtcaagctcagatcctggaacttcaccattttttatctcaggaattaatggagatttgaagaaggaatcatcagtcattagggaagaccggaatcttgaagactctagttcggacacagacagtgaaaatttgtctgtgtcatcggccagtatgaggttccaaccatggatgacagagtttcttagatctcatcatcagtcatcacaccagatggaagaagaatgctctagaagaactaataataagactcaagcatcgacaactaaagctttgcttgagaagttctctaggctcgatcgagatgctggagttggaatgtcaagctatcggactgacttggaattcagtggaaacgttagagaagcaatatcactatccagaaatgcgcctcctggccctcctccattgtgctcaatatgtcaacataaggcgccggtatttggcaagccaccaaggtggtttagctatgctgaattggagcttgctaccggcggcttttcacaagccaatttcttggcagaaggtgggtttggatctgttcataggggggtactgccagatggccaggcagttgctgtcaagcaacacaaattggctagttctcaaggggatcatgaattttgctcagaagtggaagttctgagttgcgcccagcacagaaacgttgttatgttaattggattctgtattgaggacaggaggaggttactggtttatgaatatatatgtaatgggtctctggattctcatctatatggatgtcatcaagagccattagaatggtctgcacggcaaaagatcgctgtgggagctgctcgaggtctgcgatatcttcatgaagaatgcagagtgggctgcattgtgcatcgtgacatgcgaccaaataacatccttctcacccatgattttgaaccactggttggagattttggccttgcaaggtggcagcctgatggtgacatgggtgtggaaacaagagtaattggaacatttgggtatttggcgccggaatatgctcaaagtggccagattactgaaaaagctgatgtctattcatttggtgtggtattagttgagcttgttactggacgaaaagcagtggacctcaaccgaccaaagggccaacaatgtcttactgaatgggcacgtccgcttcttgaagaatatgctatagatgaactggttgacccaaggctagggaatcactattctgaacatgaagtatattgcatgcttcatgctgcatctttgtgtataaggcgcgatcctcattccaggccccgcatgtcacaggtgcttcgcatattggaaggtgacacggtcatagacacttacatgtcaacacctgggtatgatgttggcagccggagtggacggatctgggtagagcagcagcagcatcagcaacagcaactaccttatagcggtcccttgatgaatgaggctttggaaggattcggtaggaagctcccccttgattcgctaaaggcagccttttgggaaagggataaggccagaaggacctcccgtgaaaatgatctgtaaagagcttacctttcatatcaactatattctgctaaatacgtattttggtccttttgtaatccccccttttacccagttctaggttctttctattttttcccaatgtccatctatattttgctcatgtatagtggtagggaaagtaggcaaagttaagcttttgtaattctttcgaaaaaatggaggaagctgagagtatcatgttcttaattctatctcatctgtgtgccttttggctaaatcaattaagccttacatggattatgccttc

SEQ ID NO: 1106 - DNA, 3083 bp, Fragaria vesca
taagggctagatggcttggcaattattcattggatctaaattgacgcaatgatttggctggttttaccttttggggagctattcttttcaccaatattgactcagtgatttgagggatcaagaacagggccactgttgtgaaggcaactatacctgtgtgtcgttttgcatctcctttttctctaggcgtcagaaaagtgtaaaatcactacagtgcctttatcaggagttcttgctttcagggccataaagggtatctggaaatctcaatattgttaccgttttgggagcattgatgctttgtttgcactggttgaagtgactgaaagcagagcaagggaggacctcaagtgggtttggtttggtttgattcttgaggattataggtgaattggtaacaagggtcttttcaaattgggtctgtggctactgctaggcggctagagggaagatttagcatgtctgctagtacatgcctgcgaatctagcactgtggaggcaatactagttttggaaatgtgcttttgttcttgttgtagtgcgtgtgggaataattgagggcagcatttgatagcctgagagttttaaggtggcaaaacaaaatttggtgctaattttgcaatgagtcgagaacagaagagggtgaaacaggagaaaggctccgatgacgctgagaaggttgtggttgcggttaaggcgtccaaggagattcccaagactgctctggtttgggcattgactcatgttgttcaacctggagattgcattacactgcttgtggttgtgccatcccaaagttcaggtagaaaatggggcttcccaaggtttgcaggggactgtgcgagtattaacaagaagtctcagccaggaacaacctcagagctgaagggtgatatctcagattcttgctctcagatgatccttcagcttcatgaagtttatgatccaaataagataaatgtcaagataaagattatttctggatcaccttccggctctgtggctgtagaggccaagagagctcaagctagttgggttgtgttagacaaacaccttaaacctgaagaaaaacggtgcatggaagagctgcagtgtaacattgtggttatgaagcgttcccagccaaaagttcttcgcttgaatttgaatggttcgccgaagaaggatgctgaatctggctgtcaggtagcttctgagcttgaaagatccgaaaaacataccaaaaagaacaataattctttaagttccttacgaggaccggatgtgactccaactagtagtccagagctagggacaccttttacagctactgaggcaggaacttcatcagtgtcaagttcagatccaggaacttcaccttttttcatttctggagttaatggagataaaaagaaagaggaatcaatggtcggtaaagaaaatcaggtccttgatgacagcagttcagatacagatagtgagtgtttatctacatcttcaggaagtaggaggttccaaccatggatagcagagtttctaaattctcatcatcaatcctcacaacacacagaaagttcacacagaactaatgataatcctaatggaccgagtaccaaagctttgcttgcaaaaatctcaaaacttgaaagagatgctgaaatcggaatgtccaattatagaagtgacatggacttcagtggaaatctaagagaagcaatttcactgtctagaaatgcgcctccaggcccccctccattgtgttcgatatgccaacacaaggcacctgtgtttggaaaacctccaaggtggtttagctatgcagagctggagcttgctacggggggattttcacaggccaacttcttggctgaaggagggttcggttctgttcatagaggggtgctaccagatggccaggctgttgctgtcaagcaacacaaattggctagttctcaaggggatcaagagttttgttcagaagttgaagtcctgagctgtgctcagcaccgaaatgttgtaatgttgattggcttctgtattgaggacaaaagaagattgctcgtttacgaatacatatgcaatgggtcattagattctcatctatatagacgaaatcgtgagcctttagaatggtctgcacggcaaaaaattgctgtgggagctgctcgagggctgcgttatcttcatgaagaatgtagagtgggttgtattgtgcaccgtgacatgcggcccaacaacatcctaatcactcatgattttgagccactggttggggattttggccttgcaaggtggcaacctgatggagacctgggtgtggacacgagagttattggaacattcggatatttggcgcctgaatatgctcaaagtggtcaaatcacagaaaaagctgatgtttattcctttggggtggtgttggtggaacttgttactgggcgaaaagcagtggacctaaaccggccaaaagggcagcagtgtctcactgaatgggcacgcccactgttagaagaatatgtgattgatgaactagttgaccctagcctggaaagcttttcagaacacgaggtttattgcatgctgcaagccgcctctctttgcatacggcgtgatcctcaaactaggcctcgcatgtcacaggttctgcgtatactagaaggcgacatggtaatggactcaaattacatgccaacacccgggtatgatgttggatgccggagtggtaggatttggtcggagcaccagcagaaggaacaatatagtggacccctggatgaggcattggaggggtacggaaagctctctcttgaaaattcgaggctagctttctgggagagggacaaggcaaggaggacttcttcatgtgaagaccatctgtaaagcactcaaccttttagaattttacatatatggtagaatgactacttatgtgctcgtttttgtaaggtaatccatgttccttatgtcttcttacaatgccacctgcatttcttctgtatagtaaaggaagaggatagccaggaggtgttgtaagtttttgatatctaaggaaaaccaagaaccacgttagtcgtgctcaaaactccttgatccaaattgagaag

SEQ ID NO: 1107 - DNA, 2733 bp, Quercus alba
atatcgcgagaacaaaaaaaacctgtgaaaagtgaggggcttgctttcaagaagagggtgttttttgagtgaattggtgaaaagggtcttgtcattgttgggcctgctctgctagtgatgaatggaattgtgagcatgccggttgtacatgtcctggaatcgaacaagaattgaatctgttgaaggaggagcttttggtttgaatttgtgggtgctcccatgagtcaagaacagaagcaagggaagcaggagaaaggctctgatgatgccgagaaggttgttgttgctgttaaggcatcgaaggaaattcccaagactgctctggtgtgggccttgacccatgttgttcaacctggggattgcattacattgcttgtggttgttccttcacaaggttcaggaagaaaactttgggttttcccaagatttgctggtgactgtgccagtggtcaccggaggactcattcaggtgcaagttcagatcagaaatgtgacattacagatacttgctcccaaatgatccttcaactacatgatgtttatgatccaaataagataaatgtcaagataaaaattgtttctggatcaccttgtggtgcagttgctgcagaggccaagagagctcaagccagttgggttgtactagacaaacagctcaaacatgaggaaaaacgatgcatggaagagttgcagtgcaacattgttgttatgaagcgttcccagccaaaagttctccgcttgaatttggttggttcatctaagaagcattctgaagtagcctgcccattaccctcagagatagacaaagaatctgaaaagaatcctaaaaagaagaatgattctttaagttctattccagggccggtagtgactccaactagtagtccagagctagagacaccatttacagccactgaagctggaacttcctcagtttcaagctcagatctaggaacttcaccttttttcatctcaaagatgaatggggatcttaagaaagatgattcattagtcattgaagagaatgaggatcctgataatactagttccgatgcagacagtgagcacttaacttcatcttcaagaagtttgaggttccaaccatggatgggtgaatttataacttctaattttcagtcctcacaagatacggatagaagctcacagagaccttttcataagcctcaagcattaatgtccaaaactttggtagagaagtactcaaaacaggatggagaacctggaattggaatgcagcactacagaactgatatggacttcaatggaaatgttagagaagcagtttcgctatcgagaaatgcacctcctggcccccctccattgtgttcaatctgtcaacacaaggcacctgtctttggaaaacctccaaggtggtttagctatgctgaattggagcttgctactggtggattttcaaaagccaatttcttggctgaaggagggtttggatctgttcacagaggtgttctaccagatggtcaggtagttgctgtcaagcaacacaaattggctagttcccagggggatgttgagttttgctcggaagtagaagttttgagttgtgctcagcaccgaaatgttgttatgctgattggtttctgtatcgaggacagacgaaggttgctggtttatgaatttatatgcaatgggtcactggattctcatctatatggacgacatcaggagccattagaatgggctgcacgtcaaaagattgccgtgggagctgcacgggggcttcggtatcttcatgaagaatgcagagtgggttgcattgtacaccgtgacatgcggccaaacaacatcctcatcacccatgattttgaaccactggttggtgattttggcctagcaaggtggcagcctgacggagatatgggtgtggacacaagagtaattggaacgtttggatatttggctccagaatatgctcaaagtggccaaatcacagaaaaagctgatgtttactcctttggggttgtattggtggagctggttacaggaagaaaagcagtggaccttaaccggcccaagggccagcagtgtcttactgaatgggcacgcccattattggaagattgtgccattgaggaactggttgatccacagttagggaatcactattcagaacaagaggtcttttgcatgctgaacgctgcatcattatgcatacaacgggatcctcattctaggcctcgcatgtcacaggtgctccgcatactagaaggtgatatggtcatggatgcaaattacatttcaacacctgggtatgatgtggggagcaggagtaatcggatttgggtggagcagcagcagcagcaacaacattacagtggtcccctattaaatgaggcaattgaagggtttagtgggaagctgtctcttgaaaattcaaggcaatcttattgggaaagggacaaggcaagaacttcatgtgctgatgatttgtaaaaaagtctcagccatttagaattacatgcttagaatgctaaacatgtactttgccctttttgtattttcttctcccactcatatatttttgtccaatgacatctagattttgcttctgtacagtaggaagggtagtaggaaatagcaaggttttgtaattctttgggaaatgaagtgaagttaaaaccaccaaaatggccatgctcatatcttcagtgaaatacgtttttagttaaatgtcaagatagcagctctcaggaa

SEQ ID NO: 1108 - DNA, 2326 bp, Prunus persica
tgatgcagaatttggtaatgagtcgagaacagaagcgggtgaggcaagagaaaggctccgatgacgccgagaaggttgtcgtggccgttaaggcgtccaaggaaattcccaagactgctctggtgtgggccttgactcatgttgttcaacctggagattgcataacactgcttgtggttgtcccctctcaaagttcaggtagaaaattttggggcttcccaagatttgcaggggactgtgccagtggtaaccggaagtctcattcaggaacaacctcagagctcaagtgtgatatttcagatacctgctctcagatgatccttcagctgcatgaagtttatgatccaaataagataaatgtcaagataaagattatttctggctcaccttctggttctgtggctgtagaggccaagaaagctcaagccagttgggttgttttagacaagcatcttaaacatgaggaaaaacactgcatggaagagctgcagtgcaacattgtggttatgaagcgttcccagccaaaagttcttcgcttgaatttgaatggatcttctaagaaggaacctgaattggctcgttccttgccttctcagcttgatgaagggactgataaacatcccaagaagaagaatgactctttgaattccattcgagggcctgttgtgactccaactagtagtccagagctagggactccatttacagccactgaggctggaacttcatcggtgtcaagttcagatccaggaacttcaccatttttcgtttcagaaataaatggagacatgaagaaagaggaatcattagttagtaaagaaaacaaggttcttgatgacagtagttcagacactgacagtgaaaacttatcaacatcttcagcaagtatgaggttccaaccatggatagcagaatttcttaattctcatcgtccatcctcgcaacacatggaagaaagttcacacagaactaatgataattctaaagcatccactaccaaagctttgctagagaaattttcgaaactcgataaggatgctggaattggaatgccaaattatagagctgacatggagttcagtggaaatctgagagaagcaatttctctgtctagaaatgctcctccagtccctcctccattgtgttcaatatgtcaacacaaggcacctgtgtttggaaaacctccaaggtggttcagctatgcggagctggagcttgctactggaggattttctcaagccaattttttggctgaaggtgggtttggctctgttcatagaggggtgctaccagatggccaggctgttgctgtcaagcaacacaaattggctagttctcagggggatcaagagttttgttccgaagtagaagtcctgagctgtgctcagcaccgaaatgttgtcatgttgattggcttctgtattgaggacaaacgaagattgctggtctatgaatatatttgcaatgggtcattagattctcatctatacaggcgacatcgcgagcctttagaatggtctgcacggcaaaagatcgctgtgggagcagctcgaggactgcgatatcttcatgaagaatgcagggtgggttgcattgtgcaccgtgacatgcggccaaacaacatcctcatcacccatgattttgagccactggttggggattttggccttgcaaggtggcagcctgatggggacacaggcgtggacacaagagttattggaacatttggatatttggctcctgaatatgctcaaagtggccaaatcacagaaaaggctgatgtttattcctttggggtggtgttggtggaacttgttactgggcgaaaagctgtggaccttaaccggcctaaggggcagcaatgcctcacagaatgggcacgcccattattggaagaatatgccattgatgacctgattgacccaagacttgacaacttctattcggaacaagaggtttattgcatgctgcatgctgcctctctatgcattcggcgggatcctcaatctaggcctcgcatgtcacaggttttgcgtatgctagaaggtgacatggtaatggacacaaattacgcatcaacacccgggtatgatgtggggtgccggaatggtcatgatgtgggatgccggagtggtcggatttggtcagagcatcaacagcagcaccaaccgcaggagaaggaacgctatagtggtccactactagatgaaccgatggaagggtataagaagctctctcttgagaacgtacggccaggtttttgggaaagggacaaggcaaggaggacttcatctgaacaccatttgtaaagcgctagccttttaga

SEQ ID NO: 1109 - DNA, 3492 bp, Gossypium hirsutum
gattgttctttaaaaatagttataatataactctaaaatatatccattttcttacccttcttttcttgttttgaaatgaaaaattttagagcataaaaattagtgtgatgttaaagaagaaggaagaatttgtgtgagtttctgtgaggctctttgctagttgttgaggattcgacaatcaaatccacctactagaaagctgctgcctggctacagagacgattttcttgtcattcatcgtgatttgataatctttgtatggacacttacacaaaagaatcgaagagctgaatttttgttctgtttccataatgaattgaacaagaaaaaaaaacaggctgggaaaactgatctttggatctaaaatttcacagctcattttgttttcttgtttttatgactttcactgttttgaccccgaggattggaccctttccaagataaaaaagggcaaagctagttgtgttgattagatgtatcgaggttcacttttaggggtagctgtcctttttgcggtcaaacaatggctgtcttctcaatccagtgcctaatttaacctgaaggacttagtttcttgttttaagtgactagaggctagctagatcttcaaatttgcagtcacctgtggaattttcttacaaatttcacaacaaggtgaaactatgttgggtttactttttcattgggtagtgaggaattctgaggggttaatgtgaataagtgaaaagggtcttgtactagatgctggtatctctctgtctctctgcagattatctggaattgcatagttagcaatgtcggtacatgtcctagaagccagtatggtgggggcagataaataatgcaaaaattttgttttctttgtgtctttttaagatgtgttatcttggcttctactatgatcattggttttaagataggctttttagagttgaatctgttaagtgaggcaagttttgtagaaattcttggtgccaaatgagtcgagaacagaagggcaaacaggaaaaaggtggctcgaatgtagctgagaaagttgtggttgctgttaaggcatccaaagaagttcccaagactgctcttgtctgggctttgactcatgttgttcaacctggagattgcattacgttacttgttgttgttccttcacctagctcaggtagaagatggggtttcccaagatttgctggggactgcgccagtcggaagtctcaattaggatcaagttcagagcagaaatctgatatcactgattcctgctcccaaatgatccttcaacttcatgatgtttatgatccaaacaagattaatgtcaagataaaaattgtttctggatcgccatgtggagcggtagctgctgaggccaagcgagccctagctagttgggttgtattggacaagcagcttaaacatgaggaaaaacggtgcatagaggagttgcaatgcaacattgtggttatgaagaattcacaggctaaagttctccgcttaaatttggttgggtcacctgagaaggaagctgaagcttcttctcaattaaattctgggagagatgaagcttctgaaaagtatccccaaaacaaagatacatcatctggttctattagagggccagttgtcactccaactagtagtccagagctcgggacaccatttactgctactgaagcaggaacttcttcagtgtcaagctctgatctgggcacttctccttttttcaactcagcagggaatggagacctgaagaaggatgaatcattggtcattaaagaaattcaggatcttgatgaatctggttcagaccccgagagtgaaaatttatccttatcttcaacaagtttaaggttccaaccatggataacagagtatcttacttctcagcatcaatcctcacgacacctggaagaaacttcagttagagctcatgacagggttcaagcttcaacaacaaaagccttgctggagaaattttcgaaacttgatagagaagcaggcattggaatatcaagctttaggagtgattctgaatttagtggaaatgtgagggaagcagtttcattatcgagaaatgccccacctggccctcctccattgtgttcaatatgtcagcataaggcccctgtatttgggaaaccgccgaggtggtttacctatgctgaattggagcttgcaactggtggattttcacaagctaatttcttggctgagggtgggtttggatccgttcatagaggacttctcccagatggtcaggcaattgcagtgaagcaacacaaattggctagttctcaaggagatcttgagttttgctcagaggtggaagtcctgagctgtgctcagcacaggaatgttgttatgctgattgggttctgtattgaggatagaaggcgactgctggtttatgagtacatatgcaatggatccctagattctcatctatatgggcgtcatcgggaacctttagaatggtctgcacggcaaaagattgcagtaggagctgctagaggtctgagataccttcatgaagaatgcagagttggctgcattgtgcaccgtgacatgcggccgaacaacattctcatcacccatgattttgaacctttggttggtgattttggccttgcaagatggcagcctgatggtgatactggtgtggaaacaagagtgattggaacattcgggtatttggcaccagagtatgctcaaagtggacaaatcacagaaaaggcagatgtctattccttcggagtggtgttaattgaactggttactggacggaaagctgtggaccttaataggccaaagggccaacaatgtctaaccgaatgggcacgtccacttttggaagaatacgccatagatgaactggtggaccccagattggaagatcgctattccgaacatgaggtatattgcatgcttcatgctgcatcattatgcgtaaggcgagatcctcattctaggccgcgcatgtcacaggtgctccgcatactggaaggtgatgtgctcatgaacaccaattacacgtcgccagggtatgatgttggtaaccgtagtggccggttctgggcagagcaacaacggagctacagtggaccgctcacgagtgattcattagatgagttcagtggaaagctctccctcgacggagcaaggccaagaacaaggaggacttcatgcgaagatcatttgtaaaaggctcatttaccaggtttatttgcgcgcatggtgcgctatattttgttttgtattgttttccttcattgccaggttagattctgcttctgtatagtaagtaggagtattggaagcaaggtttcaattagggtttttgtaattctttttggaatggccagtttcaaaagctatggtgaatatgcctctgctaattaaatcaatcaatcagctttgagagatttggttctttccctctcttttagtactaatggagcaatttatttatttgataattgggtcaaataagtaaattaa

SEQ ID NO: 1110 - DNA, 3357 bp, Gossypium hirsutum
gtttctgtgaggctctttgctagttgttgaggattcgacaatcaaatccacctactagaaagctgctgcctggctacagagacgattttcttgtcattcatcgtgatttgataatctttgtatggacacttgcacaaaagaatcgaagagctgaatttttgttctgtttccataatgaattgaacaagaaaaaaaaacaggctaggaaaactgatctttggatctaaaatttcacagctcattttgttttcttgtttttatgactttcactgttttgaccccgaggattggaccctttccaagataaaaaagggcaaagctagttgtgttgattagatgtatcgaggttcacttttaggggtagctgtcctttttgcggtcaaacaatggctgtcttctcaatccagtgcctaatttaacctgaaggacttagtttcttgttttaagtgactagaggctagctagatcttgaaatttgcagtcacctgtggaattttcttacaaatttcacaacaaggtgaaactatgttgggtttactttttcattgggtagtgaggaattctgaggggttaatgtgaataagtgaaaagggtcttgtactagatgctggtatctctctgtctctctgcagattatctggaattgcatagttagcaatgtcggtacatgtcctagaagccagtatggtgggggcagataaataatgcaaaaaatttgttttctttgtgtctttttaagatgtgttatcttggcttctacaatgatcattggtttttaagataggcttttttagagttgaatctgttaagtgaggcaagttttgtagaaattctcggtgccaaatgagtcgagaacagaagggaaaacaggaaaaaggtggctcaaatgtagctgagaaagttgtggttgctgttaaggcatccaaagaagttcccaagactgctcttgtctgggctttgactcatgttgttcaacctggagattgcattacattacttgttgttgttccttcacctagctcaggtagaagatggggtttcccaagatttgctggggactgcgccagtcggaagtctcaattaggatcaagttcagagcagaaatctgatatcactgattcctgctcccaaatgatccttcaacttcatgatgtttatgatccaaacaagattaatgtcaagataaaaattgtttctggatcgccatgtggagcggtagctgctgaggccaagcgagccctagctagttgggttgtattggacaagcagcttaaacatgaggaaaaaaggtgcatagaggagttgcaatgcaacattgtggttatgaagaattcacaggctaaagttctccgcttaaatttggttgggtcacctgagaaggaagctgaagcttcttctcaattaaattctgggagagatgaagcttctgaaaagtatccccaaaacaaagatacatcatctggttctattagagggccagttgtcactccaactagtagtccagagctcgggacaccatttactgctactgaagcaggaacttcttcagtgtcaagctctgatctgggcacttctccttttttcaactcagcagggaatggagacctgaagaaggatgaatcattggtcattaaagaaattcaggatcttgatgaatctggttcagaccccgagagtgaaagtttatccttatcttcaacaagtttaaggttccaaccatggataacagagtatcttacttctcagcatcaatcctcacgacacctggaagaaacttcagttagagctcatgacagggttcaagcttcaacaacaaaagccttgctggagaaattttcgaaacttgatagagaagcaggcattggaatatcaagctttaggagtgattctgaatttagtggaaatgtgagggaagcagtttcattatcgagaaatgccccacctggccctcctccattgtgttcaatatgtcagcataaggcccctgtatttgggaaaccgccgaggtggtttacctatgctgaattggagcttgcaactggtggattttcacaagctaatttcttggctgagggtgggttcggatccgttcatagaggacttctcccagatggtcaggcaattgcagtgaagcaacacaaattggctagttctcaaggagatcttgagttttgctcagaggtggaagtcctgagctgtgctcagcacaggaatgttgttatgctgattgggttctgtattgaggatagaaggcgactgctggtttatgagtacatatgcaatggatccctagattctcatctatatgggcgtcatcgggaacctttagaatggtctgcacggcaaaagattgcagtaggagctgctagaggtctgagataccttcatgaagaatgcagagttggctgcattgtgcaccgtgacatgcggccgaacaacattctcatcacccatgattttgaacctttggttggtgattttggccttgcaagatggcagcctgatggtgatactggtgtggaaacaagagtgattggaacattcgggtatttggcaccagagtatgctcaaagtggacaaatcacagaaaaggcagatgtctattccttcggagtggtgttaattgaactggttactggacggaaagctgtggaccttaataggccaaagggccaacaatgtctaaccgaatgggcacgtccacttttggaagaatacgccatagatgaactggtggaccccagattggaagatcgctattccgaacatgaggtatattgcatgcttcatgctgcatcattatgcgtaaggcgggatcctcattctaggccgcgcatgtcacaggtgctccggatactggaaggtgatgtgctcatgaataccaattacacgtcgccagggtatgatgttggtaaccgtagtggccggctttgggcagagcaacaacggagctacagtggaccgctcacgagtgattcattagatgagttcagtggaaagctctccctcgacggagcaaggccaagaacaaggaggacttcatgcgaagataatttgtaaaaggctcatttaccaggtttacttacgcccatggtgcactatattctgttttgtattgttttccttcattgccaggttagattctgcttctgtatagtaagtaggagcattggaagcaaggtttcaattagggtttttgtaattctttttggaatggccagtttcaaaagctatggtgaatgtgcctctgctaattaaatcaatcaatcagctttgagagatttggttctttccctctgttttagtactaatggagcaatttatttatttgataattgggtcaaataagtaaattaa

SEQ ID NO: 1111 - DNA, 3245 bp, Populus trichocarpa
gagcagtagaaacaccaacaacaaaaatgattcgaaggagggcccattcccatccatgcaaattcaatgttatttattattatattcattagaataattcttttccttaatcttcccttccctttacttaaaacactctctcagagacagaaagaaacacagagacgacgacgcacgcatttaaatatccggaagaggatttccccccttcttcttttttttctttgaacgcagattggtcccttcgaggaccatgtgagtagagcttgtttgatttaaagaaaaagtgatgagtagagagcagaggagagggaaccaagagaaaggcggctcagacgttgctgtgaaggttgttgttgcagttaaagcctccaaggagattcccaagactgctttggtctgggctttgactcacgttgtgcaacctggagattgcattactctgctggtggttgtaccttcacagagtcctggccgaagattatggggattcccaagatttgctggtgactgtgccaatggtcaccggaagtctcatctgggagcaacctcagatcagaagtttgaccttacagattcctgctcccagatgatccttcagcttcatgatgtttatgatccaaacaaaatcaacgtgaagataaaaattgtatctggctcaccttgtggggcagtctctgcagaagccaagaaggcacaagccaactgggttgtattagacaaacagctgaggcatgaggaaaaacgctgcatggaagagctgcaatgcaacatagtggttatgaaaaagtcccaggcaaaagtcctccgcttgaatcttgttggatcatcaaaggaacctgaagttgtgggctcatcaccttccaacctagatgaagcatctgagaagcattccaaaaataaaaatgattctccaggctccattcgaggaccagtggttactccaacaagtagtccagaggctggaacaccatttactgtgactgaggcagggacttcatcagtctcaagtgatccaggaacttcaccattttttatctcagaaacaaatggagaactcaagaaagaggaaccactggtcattgtggaaaatagggatcttgatgaatctagttcggacacagacagtgaacatttatcttcagtttcaagtttaaggtttgaaccatgggtaggagagttgcttagttctcacattcattcctcaagacacatagaagatggctctcagagaagtaatagtttggctcaaacttcaacaactatagctttgctagagaagttctcaaaacttgatcaacaaacaggaattggaaagtcaaactacaggaccgatctagacttgagtggaaacatgagagaggcaatctcattatccagaaatgcgcctcttggcccccctcctttgtgttcaatatgccaacataaggcacctgtatttgggaagcccccaaggtggtttagctatgctgagttggagcttgctactggaggattttcacaagccaatttcttggcagagggtgggtttggatctgttcacagaggtgtattgccagatggccaggcagttgctgtcaagcaacacaaattggctagttcacagggggatatcgaattttgctcagaggtggaagtccttagctgtgctcagcatcgaaatgttgttatgctcattggcttttgtattgaggacagaaggaggttgctagtttatgaatatatatgcaatgggtcactagattctcatctctatggacgtcatagggagccattagaatggtctgcacggcaaaagattgcagcaggagctgctcgagggttacgttatcttcatgaagaatgcagagtaggttgcattgtccatcgagatatgcggcctaacaatattctcataacccatgattttgaaccactggttggagattttggcctagcaaggtggcagcctgatggtgaaactggtgttgaaacaagagtgattggaacatttgggtatttggctccagagtatgctcaaagcggtcaaatcacagaaaaagctgatgtttattcctttggagttgttttggttgagcttgttaccggccgaaaagcagtggacctcaaccggccaaagggccagcagtgtctcacggaatgggcacgtcctctattggaagaatttgccatagatgaactgattgatccacagcttggcaatcactattcagagcaggaggtttactgcatgctccatgcagcatcgttatgcatacgacgggatcctcattccaggcctcgtatgtctcaggttctccgcatactagaaggtgacatgcttgtggacgcaaattacatggcaacacctgggtatgatgtgggaaaccggagtggaaggatttacatagagcagcagcagcagcagccaccacaacattgtggtggtcccctaccaataaatgaggcacgggaaggattcagtgggaagctatccttttgacaccctaaagccaattttcgaggaaagggacaaggccaggaggatttcatgccgagattcgtaaagagctagcccgtaatgaacaacgtatacgcaagggtgccaaatatgtggctggtccatttgcattttgtaatttttttttgccttcagtgttttgttcaaagccatcttcattttgctttgtatagtggaaagggagtaggggtagcaatgtttgggaaattttatgatgtagatggagtaacttgttgaattttattagttatttttctaaatctattttaaagaaatgatagatacacaaaggaaagagaaaattaaattcaggacctagaaaaaaagaatatcttcacctaacttttctttctttatgtgtatttatttctttgagatggatcgagaaaagtaactaatagcgttctgttagttattctgaatattattataaaatttcccacaatattttgtatttaataaatgattggaattgatattaaatagcaatgatgcatgagcactagtgaatacgcaatgcttgaagcaatgaagcagctcttaagaatctctcgtctctctctctctgtttgtaggtctgcctatcttggactagttttgaaacttcgagaattgagggatggagggagaggatggagaagcagatgtaactaatctcatatttgtcttgacctcgaaggcatgaaacatatgatgagaggaaaatcatttcttgccttggcagcaatattttgaatttcaaatt

SEQ ID NO: 1112 - DNA, 1069 bp, Hordeum vulgare
gcgcgccaaaggaagaaacggagaaccaaaacaatggccgctctccgccacctcgccggcgccacccacaaccaccgcatcgcggccaactcctcctccctcttcgacctccagcggccgccttcctgcctcgccgcggcgcgacccctcagcctggcgcccctccgctcccgcttcacccggctttacgcgctgtccagcaacgacatcaaggtggggttcaacctggaggtggacggcgcgccgtggaagattcttgagtttctccatgtcaaacctggaaaaggtgccgcttttgtgaggacaaaaatgcgcaattatatcaccggcaacacagttgagaaaacctttcgagctggaagtacgatccaggaagcttctatttcaaaggaaaccaaacaattcacctacaaggatggctcccagtttgtgttcatggatttgacgtcctttgaagaaagccgcttaaacgagtcggatgttggcgacaggcagaagtggttgaaagaaggaatggactgcactttgttatactggaatggacggatcattgattttgatcttcccatcaccgttaggctgaccgtaaccgaaactgatcctgggcaaggtgacagtgcacaaggaggaacaaagcctgcaactctggaaacaggagctgttgtcaatgtgccgtctttcgttgatgtaggcgacgatgtcctaattgactcgagaaccgggcagtatatgagccgggcatagagtggataccagatgagatgccaacagtgaagagctagttttcttgttccccgcatttttggtataattaccgttgaaaagtccacaacattgtcttttcttcttcttctcatttatcatactgggaccttctacaccggggcgtgaaattctatcgaaattctctgaactgggttcctttctccttgagctgagctgacaatatgcagtcttaacatggaatgtacagtgcaggaatacctcaccagcgagttaattgcagggcattaccacacttgggcaccatgtaaccgattggtatcaatagtcattttttttgcgtgtc

SEQ ID NO: 1113 - DNA, 1065 bp, Hordeum vulgare
aggggcgcgccaaaggaagaaacggagaaccaaaacaatggccgctctccgccacctcgccggcgccacccacaaccaccgcatcgcggccaactcctcctccctcttcgacctccagcggccgccttcctgcctcgccgcggcgcgacccctcagcctggcgcccctccgctcccgcttcacccggctttacgcgctgtccagcaacgacatcaaggtggggttcaacctggaggtggacggcgcgccgtggaagattcttgagtttctccatgtcaaacctggaaaaggtgccgcttttgtgaggacaaaaatgcgcaattatatcaccggcaacacagttgagaaaacctttcgagctggaagtacgatccaggaagcttctatttcaaaggaaaccaaacaattcacctacaaggatggctcccagtttgtgttcatggatttgacgtcctttgaagaaagccgcttaaacgagtcggatgttggcgacaggcagaagtggttgaaagaaggaatggactgcactttgttatactggaatggacggatcattgattttgatcttcccatcaccgttaggctgaccgtaaccgaaactgatcctgggcaaggtgacagtgcacaaggaggaacaaagcctgcaactctggaaacaggagctgttgtcaatgtgccgtctttcgttgatgtaggcgacgatgtcctaattgactcgagaaccgggcagtatatgagccgggcatagagtggataccagatgagatgccaacagtgaagagctagttttcttgttccccgcatttttggtataattaccgttgaaaagtccacaacattgtcttttcttcttcttctcatttatcatactgggaccttctacaccggggcgtgaaattctatcgaaattctctgaactgggttcctttctccttgagctgagctgacaatgtgcagtcttaacatggaatgtacagtgcaggaatacctcaccagcgagttaattgcagggcattaccacacttgggcaccatgtaaccgattggtatcaatagtcattttttt

SEQ ID NO: 1114 - DNA, 910 bp, Avena sativa
aaaacaatggccgccctccgccagctggccggcgccacccacaaccatcgcattgcggccaactcctcctccctcttcgatctccagcgcccgccttcttgcctctccttcgccgcggcgcggcccctccgcctcgcgcccctgcgctcccgctcccccacccggctttattcgctgtccagcaacgacataaaggtaggaatcagcctcgaggtggacggcgcgccgtggaagattattgagtttctccatgttaagcctggaaaaggtgccgcttttgtgaggacaaagatgaaaaattatatctccggcaacacggttgagaaaacctttcgagctggaagtacgatccaggaagcttctatttctaaggaaaccaaacaatttacatacaaggatggatcccagtttgtgttcatggatctgacgacctttgaagaaagtcgcttaaacgagtcagatgttggtgataagcaaaagtggttgaaagagggaatggactgcattttgttgtactggaacggaaagatcatcgattttgatcttcccatcactgttaggctgaccgtaactgagactgatccggggcaaggtgacagtgcacaaggaggaacaaagcctgcaaccgtggaaacaggagctgttatcaacgtgccatctttcgttgatgtaggtgacgatgtcctaattgattcgagaaccggccagtatatgagccgggcatagagtggataccgttcagaaacaccaacagaggactagttttctcgttcgcccaattttggtttatttgtttacctgactgatgaaagttcacaacattgctcattcagcacagcggacatgaaattctgttgaaactttttacaactgggatgagatctttcagctaaaaatccatatttcagcc

SEQ ID NO: 1115 - DNA, 851 bp, Brachypodium distachyon
gacgaacaaaaccaatggccgctctccgccacctcgccgccggcgccaccagctcctccttcgatctccggcggccgccttccttctgcctcgccgggacgcggcccctccgccttcgctcccgcctcgcccgtgtctacgcgctgtccagcaacgacatcaaggtggggctcaacctcgaggtggacggcgcgccgtggaagatccttgagtttctccatgtcaagcctggaaaaggtgccgctttcgtgaggacaaaaatgcgcaattatgtctccggcaacacggttgagaaaacatttcgagctggaagtacgatccaggaggcgtctatttcaaaggaaaccaaacaatttacatacaaggatggcccccagtttgtattcatggatctgacgacctttgaagaaagtcgcttaaatgaatcagatgttggcgacaagcaaaagtggttgaaagagggaatggactgcaatttgttatactggaatgggcggatcatcgattttgaccttcccatcactgttcggctgactgtaactgagactgatccagggcaaggtgacagtgcacaaggaggaacaaagcctgcaaccctggaaacaggagctgttgtcaatgtgccatctttcgtggatgtaggcgatgatgttctaattgattcgagaaccggccagtacatgagtagagcatagagcgcgatgctagacgaaacagcaacagagaactagtttccttgttcgctcatttttggtttagtcattgcatttatgtaagttcacaacattgttcattcattcatcgcattggtacccttgacaccaggcataaagttctactgaaattctctt

SEQ ID NO: 1116 - DNA, 963 bp, Oryza sativa
ccgaaggggaatcatctcttccttatcgtcttcatcgcatcagttgagctgccagctgagctatggcttctctccgccacggccacctctctccctccggcgccactgcaccaccctcctccttcgcccaactccgccgcccttcctcctgcctcgccggaccacgacctctccgctctcgtctcacccgggtgtacgcgctttccagcaacgatatcagggtgggctccaacctcgaggtcgacggagctccctggaaggttcttgaatttctccatgtcaagcctggaaaaggtgctgcttttgtaaggacaaaaatgcgtaattatatcactggcaacacagttgacaaaacctttcgagctggaagtacgatcccagaggcatccatttcaaaggaaactaagcaatttacctacaaggatggagcccagtttgtgttcatggatctgactacctttgaagaaagtcgcttaaatgagtcagatgttggcgacaggcagaaatggttgaaagaaggaatggactgcaatttgttatactggaatggacggatcattgattttgatctccccatcaccgttaggctgactgtaactgatactgacccagggcaaggtgacagtgcacaaggaggaacaaaaccagcaaccgtggaaacaggagctgttgtcacagtgccctcgtttgtgaacgtaggcgatgatatcctgattgattcaagaactggccagtatatgaacagagcatagaagagatgagagactagacatcaacagagcattagtttttgtctccccatttttggcccattccctcacctcacccaggtttgactgtattgtttacagcatttgaaccctcgacaggatcaaaatgctttctcaaatttttgtactgcatatgtgcgtacatatttcaccagagcagatgattaatgagccaaacacattgtaagatcca

SEQ ID NO: 1117 - DNA, 953 bp, Oryza sativa
gtcttcatcgcatcacttgagctgccaggtgccagcgtcactcagctgagctatggcttctctccgcctccgccacctctctccctccggcgccactgcaccaccctcctccttcgcccaactccgccgcccttcctcctgcctcgccggaccacgacctctccgctctcgtctcacccgggtgtatgcgctgtccagcaacgacatcagggtgggctccaacctcgaggtcgacggagctccctggaaggttattgaatttctccatgtcaagcctggaaaaggtgctgcttttgtaaggacaaaaatgcgtaattatatcactggcaacacagttgacaaaacctttcgagctggaagtacgatcccagaggcatccatttcaaaggaaactaagcaatttacctacaaggatggagcccagtttgtgttcatggatctgactacctttgaagaaagtcgcttaaatgagtcagatgttggcgacaggcagaaatggttgaaagaaggaatggactgcaatttgttatactggaatggacggatcattgattttgatctccccatcaccgttaggctgactgtaactgatactgacccagggcaaggtgacagtgcacaaggaggaacaaaaccagcaaccgtggaaacaggagctgttgtcacagtgccctcgtttgtgaacgtaggcgatgatatcctgattgattcaagaactggccagtatatgaacagagcatagaagagatgagagactagacatcaacagagcattagtttttgtctccgcatttttggcccattccctcacctcacccaggcttgactgtattgtttacagcatttgaaccctcgacaggatcaaaatgctttctcaaatttttgtactgcatatgtgcgtacatatttcaccagagcagatgattaatgagacaaacacattgtaagatcca

SEQ ID NO: 1118 - DNA, 1932 bp, Leymus cinereus x Leymus triticoides
  misc_feature (101)..(101): n is a, c, g, or t
  misc_feature (623)..(623): n is a, c, g, or t
  misc_feature (694)..(694): n is a, c, g, or t
  misc_feature (1238)..(1238): n is a, c, g, or t
  misc_feature (1349)..(1349): n is a, c, g, or t
  misc_feature (1367)..(1367): n is a, c, g, or t
ccacggcttgcgtcttggcctcttgccatttactatttagacgccgtgtaggtggccggccggcagggacagacatcgatcgatcgagcgccattgccctnccactgccagccaacccgtcgtgtaggtaggtgactggctgcggtagtgagtgaaggcgttctgtgctctgctctgctttgtgaggcatgggcgggttgcggcttcttgttggggggctgtggttcttggcgctgctgcggctgggcgcggcggcggaggcgggggtcgtcgccgtggacgggcggcgcgccattgcggccacgggcgaagacttcgtctgcgccacgctcgactggtggccgccggacaagtgcgactacggtacctgcagctggggccgcgcctcgctcctcaacctggatctctccaacaaaatcctgctcaatgccgtcagagccttctcgccgctggtgctccggctgggcggctcgctgcaggacaaggtggtgtacggcacggccgaccggcgggggccgtgcgcgccgttcgccaagagcgagtcggagatgttcggcttcacgcagggctgcctgcccatgcgccgctgggacgagctcaacgccttcttccagaaatccggngcgaagatcgtgttcgggctcaacgctctcaacggccgggtccctctgcaggacggggccatgggaggganctgggacagcagcaacgcggcgtcgctcatccgctacaccgccggcaagggctacaaaatccacgggtgggagctcggaaatgagctcagcggctccggcgtcgggaccaagatcggcgtgggccagtacgtcaaggacgcgatcgccctgaaaaagacggtggacggcatgtaccggggcagcccggcgaagccgctggtgctcgcgccgggcggcttcttcgacgcgggctggtacggcgagctcatcgccagaaccaagcccaacatgctcaacgtggtgagccaccatatctacaacctaggggcaggggtggacacacatctcgtcgagaggatcctcgatccggcggcactcgacgggatggcgagcccgttcagggatctccaggggttgctgaaagctgcagggacatcggccgtcgcctgggttggagaggctggaggggcttacaacagtgggcatcaccttgtcaccgatgcatttgtgttcagcttctggttcctggatcagctcgggatgtcggccaagtatgacaccaanagctactgcaggcagagcttcatcggtggcaactatggcctgctgaacacaaccacattccagccaaatcctgactactacagtgctctgctgtggcatcgcctgatgggnaccaaagtgctggaagcnaagttcaccggcaccaacatggtccgcgcctacgcgcattgcgcaaagcattctccggggataaccctgctgctcatcaacctgcacggaaacgcgacaaaccacgtctcggtggcaagttcaggcgcacacgccggaaccgcgaggaggcacggcgggaggttcggccagtcggccggagcgaccagggaggagtaccacctcacccctgagggtggcaacatccagagccaggtgatgatgcttaacggcagggcgctggtgactggtgcggatgggagcatccccaggatggagcctgtcaaggtggacgcggcgcggcatatcgccgtggcgcctcggtccattgtgtttgttcacatgccaaatttccatgcacctgcgtgtagttagggcttttgattttgttataggtggagacaaggatgggttgctaagcatgtccaccctaagtataagatggctgaagaatgtgtggctttgtgtgattagattgtataaagaggttggaggggaaattgaaatagtgaaacaagagcaatgggaataactctttcctggttca

SEQ ID NO: 1119 - DNA, 1481 bp, Solanum tuberosum
caatctccctcccctttttgtatcaatggcggaggcgacggagatgccgtactttaagttgaataccggtttcagcattccggcggtcggtttgggaacatggcagtccgatcccggcgtcgtcggcaaagccgtggagactgctatcaagatgggctaccggcatattgattgtgctcaaatttataaaaatgagaaggagattggtgaagttttgagcaggctgtttaaagatggtgttgtcaagaggcaagatctattcattacatccaaactctggaacactaatcatgcacctgaagatgtaccagtcgcactagacaaaactcttaaagacttgcagctggaatacgttgacctgtacctcatccattggcctgtcagtatgaagcctggatcagttgactttaaacctgaaaatcttatgccaaccaacatacccagcatatggaaagcaatggaaaaagtttatgattccgggaaggctagagttattggtgttagcaatttctctactaagaaactgggagatcttttgcaagtagcacgtattcgtcctgctgtcaaccaggtggagtgccatccttcgtggcaacaaaccaaattgcgggagttctgtaaatccaatgaagtgcacctctctgcatattcgccgcttgggtctccaggttcaacatggcttaaaagtgatgtgctaaagcagccagctgtaatctcagttgctgagaaattgggcaagactcctgcacaggtttgtcttcgttggggcattcagatgggtcagagtgtacttcctaagagcacacatgaagcacgaattaaagagaatcttgatgtactgaactggtctatacctgatgacttgcttgccaagttctctgaaattccacaggcaaggctgctgagaggcatttcatttgttcacgagacgcatggccagtacagaacacttgaagagctgtgggatgatgagatctaaggtcacagtatgagttaactgtcaaagataggcaaatcttaatccatttgtctcagagattcaagcttcttgtgcacttccttttcctttgaacttttggagatcgatgaattttcaaaccattagatgtaggtttccttgcaccccctatccctctattgactctatgctggaaaaccattcatctacgagacagtattcaaacatttgatttgctgggatgatactacccctaaaccatcaacttttgcagtcatcttttattgtggagtagttaaatactatgctcctggtgaggctatgtctccttcctttcgtttggtggatgaattaagtacttttagttttgtccatcagacggggaaaggaaaaaaaaaacagaatatttgaggttttaaacatcactgttaatacttggcaattgaacgtgtttctcatactacttgaatcaagcgcacgcatgacatgaaactaacagacacagcatagcatgcttaaattt

SEQ ID NO: 1120 - DNA, 1371 bp, Solanum phureja
accatgtgtcagcttcagaagggaacagttgtaactgacacattatcttcatttcttttacataatatatatataaggagaggggaagtgcaaagttcaattcgcattgctactctgtactcatcaataactttttctctctttggcagtatacggttcactatcttttttttcaatttccctcctctttttgtatcaatggcggaggcgacggagatgccgtactttaagttgaataccggtttcagcattccggcggtcggtttgggaacatggcagtccgatcccggtgtcgtcggcaaagctgtggagactgctatcaagatgggttaccggcatattgattgtgctcaaatttataaaaatgagaaggagattggtgaagttttgagcaggctgtttaaagatggtgttgtcaagaggcaagatctattcattacatccaaactctggaacactaatcatgcacctgaagatgtaccagtcacactagacaaaactcttaaagacttgcagctggaatacgttgacctgtacctcatccattggcctgtcagtatgaagcctggatcagttgactttaaacctgaaaatcttatgccaaccaacatacccagcatatggaaagcaatggaaaaagtttatgattccgggaaggctagagttattggtgttagcaatttctctactaagaaactgggagatcttttgcaagtagcacgtattcgtcctgctgtcaaccaggtggagtgccatccttcgtggcaacaaaccaaattgcgggagttctgtgaatccaatgaagtgcacctctctgcatattcgccgcttgggtctccaggtacaacatggcttaaaagtgatgtgctaaagcagccagctgtaatctcagttgctgagaaattgggcaagactcctgcacaggtttgtcttcgttggggcattcagatgggtcagagtgtacttcctaagagcacacatgaagcacggattaaagagaatcttgatgtactgaactggtctatacctgatgacttacttgccaagttctctgaaattccacaggcaaggctgctgagaggcacttcatttgctaatgagacgcatgggcagtacagaacacttgaagagctgtgggatgatgagatctaaggtcacagtatgaattaactgttgaagccatttgtctcagagatttaagcttcttgtgcacttccttttccttagaacttttggagataggtgaattgtcaaccattagatgtaggtttccttgcaccccttgtccctctattgactctatactggaaaaccattcaagaatcttgcagattctatgagacggtattcaaacatttgatttgctgggat

SEQ ID NO: 1121 - DNA, 1321 bp, Solanum melongena
caattcgcatttctctttgtttacttttggctgtatacaaatcactctcgttttttttcaatttccctcctctttctgtatcaatggcgaagatgtcgtacttcgacttgaacaccggtcactgcattccggcggtcggtttaggaacgtggcagtccgatcctggcgtcgtcggcaaagccgttgaggctgctatcaagatgggctaccggcatattgattgtgctcaaatttataaaaatgaaaaggagattggtgaagttttgaataggctgtttaaagatggtgttgtcaagaggcaagatctattcattacatccaaactctggaacactaatcatgcacctgaagatgtaccagtcgcactagacaaaactctaaaagacttgcagctggaatacgttgatctgtacctcatccactggcctgtcagtatgaagcctggatcggactttaaacctgaaaatctcatgccaatcaacatacccagagtatggaaagcaatggaaaaagtttatgattctggaaaggctagagttattggtgttagcaatttctctactaagaaactggctgatcttttggaagtagcgcgtattcctcctactgtcaaccaggtggaatgccatccttcgtggcaacaaaccaaattgcgcgagttctgtaaatccaagaatgtgcacctctctgcattttcaccacttggttctccaggtacaacatggcttaaaagtgatgtgctaaagcagccagttgtagtctcagttgctgagaaattgggcaagactcctgcacaggtttgtcttcgttggggcattcagatgggtcagagtgtacttccaaagagcacaaatgaagcacggattaaagagaatcttgatgtactgaactggtctatacctgatgacttgcttgccaggttctctgaaattccacaggcaaggctgctgagaggcacttcgtttgttcacgagacacatggccagtacagaacacttgaagagctgtgggatggtgagctctaaggttacagtacgagctaactgttgaagttgagcaaatcttaatccatttgtctcatagatttgagctccttctgcacttcctttttctttgaactttgggagatcgctgaattgtcaaacaattaatctcatagatgtaggtttctttgcatccccctggaaaacgattcaaagaatctttcagattctacgatagtattcaaacatatgatttgctgggataatctcaccccaaaactatcagtttctgttgtgttctttattgttgaggtagttaaatccaatgcttttgtggg

SEQ ID NO: 1122 - DNA, 1328 bp, Nicotiana tabacum
  misc_feature (1115)..(1115): n is a, c, g, or t
gcattgctatgtgactgtgtttttgctgtgtacaattcactttcgtcttttcaattttcctcctctgtttgtatcaatggcggcggcaattcgatactttgagttgaacactggtgccaagatgccgtcagtaggtttgggaacgtggcagtccgatcctggcgtcgtcggccacgctgttgagattgctatcaaggtgggctaccggcatattgattgtgctcgaatttataaaaatgaaaaggagattggtgaagttttgaagaagctgtttaaagatggcgttgtcaagagggaagagctcttcgttacgtccaaactctggaacactgatcatgcaccggaagacgtaccattggcactaaacagaactctagaagacttgcagctggactacgttgatctgtacctcatgcactggcctgtcactttgaagcctggttcggctgactttaaacctgaaaaccttatgccaacaaacatacctagcacatggcaagcaatggaaaaactttatgattcggggaaggctagagctattggtgttagcaatttctctactaagaaactgggagatcttttgcaagtagctcgtgttcctcctgctgtcaaccaggtggagtgccatccttcatggcaacaagccaaattgcgggatttctgtaaatccaagggagtgcacctctctgcctattcaccacttggttctcctggtacaacctggcttaaaagtgatgtactaaagcagccagctgtaatctcagttgctgagaaattgggcaagactcctgctcaggtttgtcttcgatggggcattcaaatgggtcagagtgtacttcctaagagcacacatgaagcacggatcaaagagaatcttgatgtactgaactggtctatacctgatgatttgtttgccaaattctcagaaattccacaggcaaggctgctgagaggcacttcatttgttcacgaaacttatggccagtacagaacacttgaagagctatgggatggtgagctctaaggtctcagtcaaaattaactgttgaagataggcaaatctcagtccatttatctcatagatataggcttcttgtgcacttccttttccttcnaactttgggagatcggccaatgtcaacccatttatctcgtagatgtaggcttcttgcatgtgtccctctattgccttggcgctggaaaccattcaagaatcttgcagattctactaaacattactcaaacgtttgatttgctgggatataccccaaaattgtcaacttttgtgatcatttttattatatagtcaaatcctatgctttatcgcg

SEQ ID NO: 1123 - DNA, 1327 bp, Capsicum annuum
cttttttgctgtgtataaattcactgtctctttcgcttatttcgaatatcctccttgcttcgctttgtaccaatggcgtcgaatgggtactttaagttgaacaccggtttcataattccggccatcggtttgggaacctggcagtccgatcctggcgtcgttggccaagccgtcgagactgctatcagggttggctaccggcatattgattgtgctcatgtttataaaaatgagaaggagataggtgaagttttgaagaggttgattaacgaaggtgttgtcaagaggtcagagctattcattacatccaaactctggaacactgatcatgcacctgaagatgtaccagtcgcaatagacagaactctaggaaacttgcagctggagtatgttgatctgtaccttatgcattggcctgtcagtatgaagcctggatcggttgactttaaacctgaaaatcttatgccaaccaacatacacaacatatggaaagcaatggaaaaagtctatgattctgggaaggctagagccattggtgttagcaatttctctacaaagaaactgggagatcttttgcaagaagcacgtattcctcctgctgtcaaccaggtggagtgccatccttcgtggcaacaagccaaattacgagagttctgtaaatccaagggagtgcacctatctgcctattcgccgcttggttctccaggtacaacatggcttaaaagtgacgtgctaaagcagccagctgtaatctcagttgctgagaaattgggcaagactcctgcacaggtttgtcttcgttggggcattcagatgggtcagagtgtacttcctaagagcacaaatgaagcacggattaaggagaattttgatgtactggactggtctatacctgatgacttgcttgccaagttctctgaaatccctcaggcaaggctgctgagaggcacttcatttgttcacgagaagtatggccagtacagaacacttgaagagctctgggatggtgagatctaaggtcacagtcagaattaaccgcggaagatgggcaaatcttaatccatttaactgacagatttaggcgtctcgcacacttttttttccttggaactttgggagatcagtgaattgtcaatccatgtatctcattgatgtaggtttcttgcaccccctatccctctattgctttatgctggaaaaccgttcaagtgtcgtgcagattcaacgacactattcaaacatttgatttgctgggatagtaccccaagaccatcaacttttgtggaccttttatcatgtagtagttactgctatgctttgttggact

SEQ ID NO: 1124 - DNA, 819 bp, Hordeum vulgare
gaagcatccgttggcccctgccacctcccttatcgcggtggattggcctcctctatctctaacctgttggccgcccatctgcactctctcctccaaactctcagctccctccctcgcacacgccgttctcgaatggcggccacctccggcctcacggccaccgtcacctcccctccggccgcccttagaacctcgcctcctcccgtgctcttcctccgccccatctctcgctgctccaggctccattccctcaaggccaaggcagcagcaaaggaccagggcgaaaagaagcccgaagctaccaaaaagaaggcatacagtcttgtttgcactgcctgtgaagggaatggcgcaatcgcatgcacccaatgcaagggaggtggggagaatttggaagaccatttcggtggccgattcaaagctggaggcttatgctggctttgcagaggaaagcgtgaaattctatgtgggagctgcaatggcgctggcttcttgggtggatttatgagcactgccgacgacacttccgaatgaaatgcttatgttgttatttttttgcttatgttgtatttgacaaattttgagagatctgtaacatttttacttgtatctgctccaaggaattagtcccttagaagtgggacatttatcgcatttaataaatgtataattattttatttgtgacaaaaatatgtcactaaggctcctcgcgggaaattggccgtttgagcgacgaaaggggcggcgaaggggaagcggcgcggggaagcgcgcggtcgtgtatcgtgaggggggccccgaggcccagtgtggctaga

SEQ ID NO: 1125 - DNA, 716 bp, Pseudoroegneria spicata
atcgcggtggattggcctcctctatcctgttggccgcccatctctactctctcctccaaactctcagctccctccctcgcacacgccgttctcgaatggcggccacctccggcctcacggccaccgtcacctcccctccggccgcccttagaacctcacctcctcccgttctcttcctccgccccatctctcgctgctccaggccccattccctcaaggccaaggcagcagcaaaggaccaggacgaaaagaagcccgaagctaccaaaaagaaggcatacagtcttgtttgcactgcctgtgaagggaacggcgcaatcgcatgcacccaatgcaagggaggtggggagaatttggaagaccatttcggtggccgattcaaagctggaggattatgttggctttgcagaggaaagcgtgaaattctatgtgggagctgcaatggcgctggcttcttgggtggatttatgagcactgtcgacgacacttctgaatgaaatgcttatgttgttattttttgcttatgttgtatttgacaaattttgggagatctgtaacatttttacttgtatcccctccaaggaatttgtcccttagaagtgggacatttaccgcatttaataattgtataatttttttatttgtgacaaagtatgtcattaaggctcctcgcagaaaatattcatatatggcgtcaaacccaccttggaaaccca

SEQ ID NO: 1126 - DNA, 608 bp, Triticum aestivum
tcttgttggccgcccatctctactctccaaactctcagctccctccctcccgctgttctcgaatggcggccacctccggcctcacggccaccgtcacctcccctccggccgcccttagaaccttggctcctcccggtctcttcctccgccccatctctcgctgctccagaccccattccctgaaggccaaggcagcagcaaaggaccaggacgaaaagaagcccgaagctaccaaaaagaaggcatacagtcttgtttgcactgcctgtgaagggaatggtgcaatcgcatgcacccaatgcaagggaggtggggagaatttggaagaccatttcggtggtcgattcaaagctggaggattatgctggctttgcagaggaaagcgtgaaattctatgtgggagctgcaatggcgctggcttcttgggtggatttatgagcactgccgatgacacttcggaatgaaatgcttatgttgttattttttgcttattttgtatttgacaatttttgggagatctgtaacatttttacttgtatcccctccaaggaatttgtcccttagaagtggacatttatggcatttaataattgcaattaaaatttttt

SEQ ID NO: 1127 - DNA, 648 bp, Triticum aestivum
ggtggattggcctcctctcctctatcttgttttgttggccgcccatctctactctccaaactctcagctccctccctcccgctgttctcgaatggcggccacctccggcctcacggccaccgtcacctcccctccggccgcccttagaaccttggctcctcccggtctcttcctccgccccatctctcgctgctccagaccccattccctgaaggccaaggcagcagcaaaggaccaggacgaaaagaagcccgaagctaccaaaaagaaggcatacagtcttgtttgcactgcctgtgaagggaatggcgcaatcgcatgcacccaatgcaagggaggtggggagaatttggaagaccatttcggtggtcgattcaaagctggaggattatgctggctttgcagaggaaagcgtgaaattctatgtgggagctgcaatggcgctggcttcttgggtggatttatgagcactgccgatgacacttcggaatgaaatgcttatgttgttattttttgcttattttgtatttgacaatttttgggagatctgtaacatttttacttgtatccccttcaaggaatttgtcccttagaagtggacatttatggcatttaataattgtataattttttatttgtgacaaagta

SEQ ID NO: 1128 - DNA, 737 bp, Avena sativa
ttgctcctgcatttcccttatcacggtggattggcctctcgttggccgcccatctctccaaactctcggctcactcccacacccagctgttctcgaatggcagcgacctccggcctcacggccaccgtctcctcccctccggccgccctaagaacctctcctcctcccgttatcttcctccgccccatctctcgctgctccggggtccattccgtcaaggccaaggcaacaaaaaaggaccagggggaaaagaagccttcaaaggcacaaagtcttgtttgcagtgcctgtgaaggaaatggcgcaatcgcgtgcacccagtgcaagggaggcggggagaatttggaagaccatttcggtggccgattcaaagctggagcattatgctggctttgcagaggaaagcgtgaaattctttgcgggagctgcaatggcgctggtttcttgggtggatttatgagcactgccgacgacacttctgaatgagtggttcatgttcctatttctgtttatgttgtatttgaccaattttgggagatctgtagcattttacttgtatcccctcgaagcaatctcttggaagtgggacatttatcacatttaataagtgtatcaatttttattcgagacaaagcgtgtcactgaggcttctcgcagaaattatatgttattgatatatggcgtcaaactcactccttttgttttcaagaacatgcaggattctgcatatcttttca

SEQ ID NO: 1129 - DNA, 534 bp, Hordeum vulgare
cctgctcctgctcctgctctctgctccattgctttcctccctctgcctcgagaagccggctagccggagagggaacgtacgtggtcgccggcgtcggagaagaggaaggaagagggtgagggaggatgtcggactgggggccggtggtgatcgcggtggtgctgttcgtgctgctgtccccggggctgctgctgcagctccccgggaagcaccacttcgtggagttcggcaacatgcacaccagcgccatggccatcctcgtccacgccatcatctacttcgccctcatcgctctctttgtcatcgtcatcggcgtgcacatcaccacggactagtccgatcgatcccccggccagctccaattaagctgctctccttcctcttctgcttctttctttacttttgtttttggctgactcttgcctctgttcttgctggtgcagcaaccactgtagtatgtgatgatgtttctttgttgccctgcgtaattaatcgctcgtatgtagccgcctgattaataaagagatgtttact

SEQ ID NO: 1130 - DNA, 684 bp, Hordeum vulgare
ctcctgcccctgctcctgctctctgctccattgctttcctccctctgcctcgagaagccggctagccggagagggaacgtggtcgccggagtcggagaagaggaaggaagagggtgagggaggatgtcggactgggggccggtggtgatcgcggtggtgctgttcgtgctgctgtccccggggctgctgctgcagctccccgggaagcaccacttcgtggagttcggcaacatgcacaccagcgccatggccatcctcgtccacgccatcatctacttcgccctcatcgctctcttcgtcatcgtcatcggcgtgcacatcaccacggactagtccgatcgatcccccggccagctccaattaagctgctctccttcttcttcttctgcttctcgtttctttctttacttttgtttttggctgactcttgcccctgttcttgctggtgcagcaaccactgtagtatgtgatgatgtttctttgttgccctgcgtaattaatcgctcgtatgtagccgcctgattaataaagagatgtttacttggttttccatggcgtgattgtggctgcgcaagtcattttctttctttcttcatcgttctgacacttacctctctgttctgttcttgcaactacttgcagtagtgtatatgatcatgtttgtttgttgtcctgcctgattaa

SEQ ID NO: 1131 - DNA, 614 bp, Brachypodium distachyon
cggccgggagcagtagctagaagaagaactagtagagttggacttggcaagaggaaacgagaaagcgaaacgtgaccaaccccaaacccaaccgaatggcaatgaaagccaacacctttcgtttcaattccccccatcactgattcctcctcctcctcacaccatcctcctgtatccttagctctcaacaacaacaaaggagaagaagctcgtcgatcgtcgccgtcgccggagaagaagagtaggaaggatatgtctgactgggggccagttgtgatcgcggtggttctgttcgtgctgctgtcgccggggctgctgctgcagctgccggggaagcaccatttcgtggagttcggcaacatgcacaccagcgccatggccatcctcgtccacgccatcatctacttcgcgctcatcgccctcttcgtcatcgtcatcggagtacacatcacaactgactgatcgagctcgagctacctccccatattaggacttaagcagagcaccttcttccctgctctttctttctttctgcctgcctgctctctgtccttattgctactactactatgtatagctgctgcttgactaataaagctgtttaattaattatg

SEQ ID NO: 1132 - DNA, 521 bp, Avena sativa
caccatccctcctcccctcctctgctccactaccttcctcttcctcctccacctcgccggagtcgtcgtcgtctccggagaagcagcggcaggaggaggatgtcggactggggcccggtggtgatcgcggtggtgctgttcgtgctgctctcgccggggctgctgctgcagctgccggggaagcaccacttcgtggagttcggcaacatgcacaccagcgccatggccatcctcgtccacgccatcatctacttcgccctcatcgcgctcttcgtcatcgtcatcggagtgcacatcaccaccgactagaccgcctagtcctaggctagcagctagctaacaagggcctgctccgtctcgtccggccatgccatgcctgctgtctctgatttcttcttcctcttcatgttttttctctttcttctgactgatgccgctgtgttctttgttcccctccgtcgccatccaaactgccattaaatgtctcagttcgatatatatatgctctacttttcttgcac

SEQ ID NO: 1133 - DNA, 635 bp, Triticum aestivum
gggtaaagcgagacgtcaccaaccgaatggcgatgaaagggagccctcacgcctttccctccacaatcacaccatccttctctgctctactctgcgcccccgctcctgttctgctctgctccattgccttcctttctctgccgcgaggagctagctagagagaaagaaagaagcttgccggagtcggagaaggggagggagagggaggatgtcggactgggggccggtggtgatcgcggtggtgctgttcgtgctgctgtcgccggggctgctgctgcagctccccgggaagcaccacttcgtggagttcggcaacatgcacaccagcgccatggccatcctcgtccacgccatcatctacttcgccctcatcgcgctcttcgtcatcgtcatcggcgtgcacatcaccactgactagagaccggctgagctccatcaccccggccggccagctccaattaagctgctcttccccttcttccgttttctttttttcatccgatccatctgactcctgcctatcttctgttctgttctgctcttgctgcttgcaactacttgtagtagtacatgtgatcatgtttgtttgttgccgcgtatgtagcttcttgattaataaagagatgtgtttactc

SEQ ID NO: 1134 - DNA, 615 bp, Triticum aestivum
  misc_feature (70)..(70): n is a, c, g, or t
gaatggcgatgaaagggagccctcacgcctttccctccacaatcacaccatccttctctgctctactctnctcccccgctcctgttctgctctgctccattgccttcctttctctgccgcgaggagctagctagagagaaagaaagaagcttgccggagtcggagaaggggagggagagggaggatgtcggactgggggccggtggtgatcgcggtggtgctgttcgtgctgctgtcgccggggctgctgctgcagctccccgggaagcaccacttcgtggagttcggcaacatgcacaccagcgccatggccatcctcgtccacgccatcatctacttcgccctcatcgcgctcttcgtcatcgtcatcggcgtgcacatcaccactgactagagaccggctgagctccatcaccccggccggccagctccaattaagctgctcttccccttcttccgttttctttttttcatccgatccatctgactcctgcctatcttctgttctgttctgctcttgctgcttgcaactacttgtagtagtacatgtgatcatgtttgtttgttgccgcgtatgtagcttcttgattaataaagagatgtgtttactcaaaa

SEQ ID NO: 1135 - DNA, 627 bp, Triticum aestivum
caaacgaatgggaatggcgatgaaagggagccctcacgcctttccctccacaatcacaccatcctcctcctctgctcccgctgctcctggtttgctctgctccattgccttcctttctcttccccgaggagctagctagaaagagagaaagaaagaagctcgccggcgtcggagaagagggggaggatgtcggactgggggccggtggtgatcgcggtggtgctgttcgtgctgctgtcgccggggctgctgctgcagctccccgggaagcaccacttcgtggagttcggcaacatgcacaccagcgccatggccatcctcgtccacgccatcatctacttcgccctcatcgcgctcttcgtcatcgtcatcggcgtgcacatcaccactgactagagaccggcggagctcgatcaccccggccggccagctccaattaagctgctcttccccttcttcctttttccaattttcatccgatccatctgactcctgcctctgtgtttcgttttgttctgttcttgctgcttgcaactacttgtagtagtacatgggatcatgtttgtttgttgccatgcgtaattaatctcgcgcgtatgtagcttcttgattaataaagagatgtgt

SEQ ID NO: 1136 - DNA, 662 bp, Triticum aestivum
cccccgggctgaggaattcggacgaggggaacgtaccaacgaatgggaatggcgatgaaagggagccctcacgcctttccctccacaatcacaccatcctcctcctctgctcccgctgctcctggtttgctctgctccattgccttcctttctcttccccgaggagctagctagaaagagagaaagaaagaagctcgccggcgtcggagaagagggggaggatgtcggactgggggccggtggtgatcgcggtggtgctgttcgtgctgctgtcgccggggctgctgctgcagctccccgggaagcaccacttcgtggagttcggcaacatgcacaccagcgccatggccatcctcgtccacgccatcatctacttcgccctcatcgcgctcttcgtcatcgtcatcggcgtgcacatcaccactgactagagaccggcggagctcgatcaccccggccggccagctccaattaagctgctcttccccttcttcctttttccaattttcatccgatccatctgactcctgcctctgtgtttcgttttgttctgttcttgctgcttgcaactacttgtagtagtacatgggatcatgtttgtttgttgccatgcgtaattaatctcgcgcgtatgtagcttcttgattaataaagagatgtgt

SEQ ID NO: 1137 - DNA, 529 bp, Triticum aestivum
ctgctctgctccattgccttgctttctctgcctgcctcgaggagctagctagaaagcgagaaagaaacctgccggcgtcggagaagaggaaggggagggagagggaggatgtcggactgggggccggtggtgatcgcggtggtgctgttcgtgctgctgtcgccggggctgctgctgcagctccccgggaagcatcacttcgtggagttcggcaacatgcacaccagcgccatggccatcctcgtccacgccatcatctacttcgccctcatcgccctcttcgtcatcgtcatcggcgtgcacatcaccactgactagacaccggctgagctccatcaccccggccggccagctccaattaagctgctcttcctttttcttttttttatccatctgactcctgcctctcttttttgttttgtttggctctgttcttgcaactacttgtagtagtatatgtgatcatgtttgtttgttgccctgcgtaattaatcgcgcatgtagcttcttgattaataaagagatgtgt

SEQ ID NO: 1138 - DNA, 683 bp, Hordeum vulgare
gctcctgctcctgctctctgctccattgctttcctccctctgcctcgagaagccggctagccggagagggaacgtacgtggtcgccggagtcggagaagaggaaggaagagggtgagggaggatgtcggactgggggccggtggtgatcgcggtggtgctgttcgtgctgctgtccccggggctgctgctgcagctccccgggaagcaccacttcgtggagttcggcaacatgcacaccagcgccatggccatcctcgtccacgccatcatctacttcgccctcatcgctctcttcgtcatcgtcatcggcgtgcacatcaccacggactagtccgatcgatcccccggccagctccaattaagctgctctccttctttttcttctgcttctcgtttctttctttacttttgtttttggctgactcttgcctctgttcttgctggtgcagcaaccactgtagtatgtgatgatgtttctttgttgccctgcgtaattaatcgctcgtatgtagccgcctgattaataaagagatgtttacttggttttccatggcgtgattgtggctgcgcaagtcattttctttcttttttcatcgttctgacacttacctctctgttctgttcttgcaactacttgcagtagtgtatatgatcatgtttgtttgttgtcctgcctgattaa

SEQ ID NO: 1139 - DNA, 594 bp, Avena sativa
caccatccctcctcccctcctctgctccactaccttcctcttcctcctccacctcgccggagtcgtcgtcgtctccggagaagcagcggcaggaggaggatgtcggactggggcccggtggtgatcgcggtggtgctgttcgtgctgctctcgccggggctgctgctgcagctgccggggaagcaccgcttcgtggagttcggcaacatgcacaccagcgccatggccatcctcgtccacgccatcatctacttcgcactcatcgcgctcttcgtcatcgtcatcggagtacacatcaccaccgactagaccggctaggctagcagctagctaacaagggccggcctgatccatctcgtccggccatgccatgcctgctgtctctgatttcttcttcctcttcatgttttttctctttcttctgactgatgccgctgtgttctttgttcccctccgtcgccatccaaactgccattaaatgtctcagttcgatatatatatgctctacttttcttgcacgtactagtatttctactgtaatttctgtgagttcgttaactgcacttccactctcagatcagaaccaaacttcta

SEQ ID NO: 1140 - DNA, 622 bp, Avena sativa
ctcctctgctccactaccttcctcttccccctccgcctcctccatcgtggtctcggtctcggtctcgtcatcgccggagtcgtcgtcggaggagaagcagcggaacagcggctagcaggaggagggatgtcggactggggcccggtggtgatcgcggtggtgctgttcgtgctgctctcgccggggctgctgctgcagctgccggggaagcaccgcttcgtggagttcggcaacatgcacaccagcgccatggccatcctcgtccacgccatcatctacttcgcactcatcgcgctcttcgtcatcgtcatcggagtacacatcaccaccgactagaccggctaggctagcagctagctaacaagggccggcctgatccatctcgtccggccatgccatgcctgctgtctctgatttcttcttcctcttcatgttttttctctttcttctgactgatgccgccgtgttctttgttcccctccgtcgccatccaaactgccattaaatgtctcggttcgatattatatatgctctacttttcttgcacgtactagtatttctactgtaatttctgtgagttcgttaactgcacttccactctcagatcagaaccaaacttcta

SEQ ID NO: 1141 - DNA, 462 bp, Festuca arundinacea
tgctcgttgtcctcgacggaggagaacaagaagaggaagaggaagaaggaagaagagaaggatgtcggactggggcccggtggtgatcgcagtggtgctgttcgtgctgctgtcgccggggctgctgctgcagctgccggggaagcaccacttcgtggagttcggcaacatgcacaccagcgccatgtccatcctcgtccacgccatcatctacttcgcgctcgtcgccctcttcgtcatcgtcatcggagtacacatcacaactgactagaccggctaggctagctaagagagcctttgtcgcacccggccatgcctcctgtctctaatttcgtcttcgtcatcctctttatgttcttttctttcttctttcttctttcttctgactgatgcccctgtgttctttcttcctctccatgcatgtgtaacattatctaaactgccattaaaaatctcagttcc

SEQ ID NO: 1142 - DNA, 530 bp, Secale cereale
  misc_feature (24)..(24): n is a, c, g, or t
  misc_feature (216)..(218): n is a, c, g, or t
  misc_feature (220)..(220): n is a, c, g, or t
  misc_feature (223)..(224): n is a, c, g, or t
  misc_feature (288)..(288): n is a, c, g, or t
  misc_feature (300)..(300): n is a, c, g, or t
aggctttctctgcctcgaggagcnagctagctagagagagaggaggagaagctcgccggcgtcgggagaggaggagaggatgtcggactgggggccggtggtgatcgcggtggtgctgttcgtgctgctgtcgccggggctgctgctgcagctgcccgggaagcaccacttcgtggagttcggcaacatgcacaccagcgccatggccatcctcgnnnangcnntgtctacttcgccctcatcgcgctcttcgtcatcgtcatcggcgtgcacatcaccactgactanacactggctcanctccatcaccccggccggccagctccaattaagctcctcctcctcttcttcctttttcttttcccccatccatctgactcctgcctctcccttttgttttgttttgttccgttcttgctgcttgcaactacttgtacgtagtagtgtatgcgatcagtttgtttgttgtccttggtaattaatcgcgcgtatgtagcttcttgattaataaagagatgtgtttactcaca

SEQ ID NO: 1143 - DNA, 984 bp, Oryza sativa
atgatcaacaagtgcagttgcagttgcagtgtagagcaggcaccggtcgaattcgagcctaataacctgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcg

SEQ ID NO: 1144 - DNA, 190 bp, Setaria italica
gcggtggtgctgttcgtgctgctgtcgccggggctgctgctgcagctgcccgggaagcaccacttcgtggagttcggcaacatgcacaccagcgccatggccatcctcgtccacgccatcatctacttcgccctcatcgcgctcttcgtcatcgtcatcggcgtgcacatcaccactgactagacaccgg

SEQ ID NO: 1145 - DNA, 559 bp, Cynodon dactylon
aagaagaagaagcaacagaaacagcaatagcagcagcagcaacaacaacaacaagaggatgtctgactggggccctgtggtgatcgcagtggtgctgttcgtgctcctctcgccgggactgctcgtccagctcccgggacgccaccacattgtggagtttggcaacctccacaccagcgccctgtccatcctcgtccactccatcatctacttcgccctcattacactcttcgtcatcgtcatcggagttcacatcaccaccgactcgtagctgctcagatcggagtcttatatactactgtagcttgttgttctacagcatgcaatctttgttggtgatttcagtgcaatcttcttcggttctcctttctcaataatttctgtgcattcgttcctactccttattaattccttctttgctctgccattagcaagctggacacacagcatgttggttggtttttacatgtaacaagtagagcacatatcatgtcatgtgcagttcagagctatattattgttccccacatgtaaaagtggacttacttttttgcaaata

SEQ ID NO: 1146 - DNA, 960 bp, Setaria italica
cgaaatcaagccacatgatcagctcaacctcaccttccccagcaccccacaactcaagaagcataggcatagctctaagcctcctaactaatagtctgctgacagccagcctgaaggcaagcgcagctactacaagagccctcattccatcacctgctagctagctgcttcgttctgcaacaacgctagctgctaatactagctagtagtgatcgatatatccttcgtccatcgggttggatcgtccaacaagttgaagcaagaaagacaagtgaaagcagagaggcaccgtcagcaaaaaagaagaagaagaagaagcaagcaagcaaaggaagaagaaggaggcgtcaggatgtctgactggggcccggtggtgatcgcggtggtgctgttcgtgctcctctcgccggggctgctgttccagctccccggccgctgccacttcgtcgacttcggcaacctgcagaccagcgccgtgtccatcctcgtccactccatcatctacttcgcgctcatcgccatcttcgtcatcgtcatcggagtgcacatcaccaccgccgactagctgctgctaacctgccatagctagctacttgctgattgacacctccattcctgcagatacttactgcaggtcactgctatatgtagctacgcaatcttatgattctgtttctgttatcttctttcatttctttctttgcatttgcatgcatgactctcgctgtccttaagtatatactccacccgctggtctatatgttgattgatttacatgtaaaataccagaatgtcgtgtgtgctccacaaagctttcaaggccccaataagtttgtgaggtgggcatgtaaaggtcttgcatctttttatttttgctgcaccccttgcaaataaaaggagcgactgtttctttcttcagctacctaaaaaaaaaaacacaagacctttacatgcccacct

SEQ ID NO: 1147 - DNA, 1052 bp, Triticum aestivum
ctccctccccgctataaataaaatcgagagccttcctccagggcgagccgctctgtgtccagccagcagcggccgtcggcaagtacgtacttggtggttcggtttccctcgagtcgcggcaatcagtcgaggacggccggtcggttgaggaaggaggggaagcggcatggactgcggcggtgaggagcaggcgaggcagaacggccatgccggcgacggcggcgacccggccgagtggaagatggtggccgagctccgggccgtggtggaggcgcaggaccccgcagccaaggaggaggacgacttcatgctgcggcggttcctgcgcgcccgtgaccacaacgtcggcaaggcgtcggcgatgttcctcaagtacctcgcatggaagcgcgccgccaagccgtggggatccatcaccgaggccgaggtgcgcggcgagctcgtgcaggacaagctctacgtgcagggcttcgacaagacgggccgccccatgatctacctcttcggcaaccggcacttcgccgccaagcgcgacctcgaggagttcaagcgctacgtcgtctacatcctcgacagcacctgcaccaagttgccggcggggcaggagaagtttgcgtcggtggtggatctgaaggggtgggggtacgcgaactgcgacatccgggcaaagctggcggcgttggagatcatgcagaactactacccggagcggctgggccgggtgttcctgatccacgtgccttacgtgttcatggcggcgtggaagatggtgtaccccttcatcgacgacaacaccaagaagaagttcgttttcgtagctgacaaggacctcgacgccacgctccgggacgccatcgacgtgtctcagctgcccgagcagtacggcggcaagctcagacttgaggggtacaagagctcgtcgacatgcaactgatccatgtattatggatgtccaattgtgcgcaagtatgtaacattgccacgcttgataagtataagtaatacttctccattcatctaatgcaaggtcgttttttagtcgaaaggggggg

SEQ ID NO: 1148 - DNA, 1079 bp, Triticum aestivum
gctaagccgcaccctcctccccgtctcttcatactctgtcattagagctctcgcagtctcctgtctcctccctccccgctataaataaaatcgagagccttcctccagggcgagccgctctgtgtccagccagcagcggccgtcggcaagtacgtacttggtggttcggtttccctcgagtcgcggcaatcagtcgaggacggccggtcggttgaggaaggaggggaagcggcatggactgcggcggtgaggagcaggcgaggcagaacggccatgccggcgacggcggcgacccggccgagtggaagatggtggccgagctccgggccgtggtggaggcgcaggaccccgcagccaaggaggaggacgacttcatgctgcggcggttcctgcgcgcccgtgaccacaacgtcggcaaggcgtcggcgatgttcctcaagtacctgagttggaagcgcggcgccaagcctcgcggctccatcaccgaggccgaggtgcgcggcgagctcgtgcaggacaagctctacattcagggcttcgacaagacgggccgccccatgatctacctcttcggcaaccgccacttcgccgccaagcgagaccttgaggagttcaagcgatacgtcatctacatccttgacaacacctgcaccaagttgccggcagggcaggagaagtttgcgtcggtggtggatctcaaggggtgggggtacgcgaattgcgacatccgggcgaagctggcggcgttggagatcatgcagaactactacccggagcggctgggccgggtgttcttgatccacgtgccttacgtgttcatggcggcgtggaagatggtgtaccccttcatcgacgacaacaccaagaagaagttcgttttcgtagctgacaaggacctcgacgccacgctccgggacgccatcgacgtgtctcagctgcccgagcagtacggcggcaagctcagacttgaggggtacaagagctcgtcgacatgcaactgatccatgtattatggatgtccaattgtgcgcaagtatgtaacattgccacgcttgataagtataagtaatacttctcca

SEQ ID NO: 1149 - DNA, 1094 bp, Hordeum vulgare
gcacgagggcagacagcccttgcacagcacagctaggccgcacccatctctttcttcatactctgtccagccagccagactcctctaccgctataaaatcgagagcctcccgagcgagcgagccactctctctatctacttggttttgctcctctcgaatcgcggcaaggcaatcaaccgaggaaggaggccgggggagcggcatggactgcggcggtgaggagcaggcgaggcagaacggccatggcggcgacccggcggagtggaagaaggtggccgagctccgggccgtggtggaggcgcaggaccccgcagccaaggaggaagacgacttcatgctacggcggttcttgcgtgcccgggagcaaaacatcaacaaggcatcgtcgatgttcctcaagtacctgagttggaagggcgccgccaagccgcatggctccatcaccgaggccgaggtgcgcggcgagctcgtgcaggacaagctctacgtgcagggcttcgacaaggtggggcgccccatgatctacctcttcggcaaccggcacttcgccgccaagcgcgacctcgaggagttcaagcgctatgtcgtctacatcctcgacaacacctgcaccaagttgccggcggggcaggagaagttcgcgtcggtggtggacctcaaggggtgggggtatgccaactgcgacattcgagcgaagctggcggctttggagatcatgcagaactactacccggagcggctgggacgggtgttcctgatccacgtgccatacgtgttcatggccgcgtggaagatggtgtaccccttcatcgacgacaacaccaagaaaaagtttgtctttgtagctgacaaggacctcgatgccacgcttcgggacgccatcgacgtgtcccagctgcctgaacaatacggtggcaagctcagacttgagggatacaagagctcgtcatcaccgccatcgtgattttttttgaagggtgtacgattgtgtcggggtatgttacattgccctggttgataatcaagtaatactcatcctttcatccaagcaaggccgcttacttttgttttaagtcaaaactattttaagttg

SEQ ID NO: 1150 - DNA, 1016 bp, Hordeum vulgare
actcctctgccgctataaaatcgagagcctcccgagcgagcgagccactctctctatctacttggttttgctcctctcgaatcgcggcaaggcaatcaaccgaggaaggaggccgggggagcggcatggactgcggcggtgaggagcaggcgaggcagaacggccatggcggcgacccggcggagtggaagaaggtggccgagctccgggccgtggtggaggcgcaggaccccgcagccaaggaggaagacgacttcatgctacggcggttcttgcgtgcccgggagcaaaacatcaacaaggcatcgtcgatgttcctcaagtacctgagttggaagggcgccgccaagccgcatggctccatcaccgaggccgaggtgcgcggcgagctcgtgcaggacaagctctacgtgcagggcttcgacaaggtggggcgccccatgatctacctcttcggcaaccggcacttcgccgccaagcgcgacctcgaggagttcaagcgctatgtcgtctacatcctcgacaacacctgcaccaagttgccggcggggcaggagaagttcgcgtcggtggtggacctcaaggggtgggggtatgccaactgcgacattcgagcgaagctggcggctttggagatcatgcagaactactacccggagcggctgggacgggtgttcctgatccacgtgccatacgtgttcatggccgcgtggaagatggtgtaccccttcatcgacgacaacaccaagaaaaagtttgtctttgtagctgacaaggacctcgatgccacgcttcgggacgccatcgacgtgtcccagctgcctgaacaatacggtggcaagctcagacttgagggatacaagagctcgtcatcaccgccatcgtgattttttttgaagggtgtacgattgtgtcggggtatgttacattgccctggttgataatcaagtaatactcatcctttcatccaagcaaggccgcttacttttgttttaagtcaaaactattttaagttg

SEQ ID NO: 1151 - DNA, 1008 bp, Pseudoroegneria spicata
  misc_feature (4)..(4): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (15)..(16): n is a, c, g, or t
  misc_feature (19)..(19): n is a, c, g, or t
  misc_feature (21)..(21): n is a, c, g, or t
  misc_feature (28)..(28): n is a, c, g, or t
  misc_feature (93)..(93): n is a, c, g, or t
  misc_feature (420)..(420): n is a, c, g, or t
  misc_feature (425)..(425): n is a, c, g, or t
  misc_feature (429)..(429): n is a, c, g, or t
  misc_feature (468)..(468): n is a, c, g, or t
  misc_feature (504)..(504): n is a, c, g, or t
  misc_feature (508)..(508): n is a, c, g, or t
  misc_feature (546)..(546): n is a, c, g, or t
  misc_feature (561)..(561): n is a, c, g, or t
  misc_feature (576)..(576): n is a, c, g, or t
  misc_feature (612)..(612): n is a, c, g, or t
  misc_feature (615)..(615): n is a, c, g, or t
  misc_feature (619)..(619): n is a, c, g, or t
  misc_feature (627)..(627): n is a, c, g, or t
  misc_feature (636)..(636): n is a, c, g, or t
  misc_feature (642)..(642): n is a, c, g, or t
  misc_feature (663)..(663): n is a, c, g, or t
  misc_feature (666)..(667): n is a, c, g, or t
  misc_feature (684)..(684): n is a, c, g, or t
  misc_feature (690)..(690): n is a, c, g, or t
  misc_feature (741)..(741): n is a, c, g, or t
  misc_feature (780)..(780): n is a, c, g, or t
  misc_feature (797)..(797): n is a, c, g, or t
  misc_feature (807)..(807): n is a, c, g, or t
  misc_feature (811)..(811): n is a, c, g, or t
  misc_feature (816)..(816): n is a, c, g, or t
  misc_feature (833)..(833): n is a, c, g, or t
  misc_feature (869)..(869): n is a, c, g, or t
  misc_feature (871)..(871): n is a, c, g, or t
  misc_feature (876)..(876): n is a, c, g, or t
  misc_feature (881)..(881): n is a, c, g, or t
  misc_feature (883)..(883): n is a, c, g, or t
  misc_feature (889)..(889): n is a, c, g, or t
  misc_feature (1007)..(1007): n is a, c, g, or t
cggncgngcngcncnnatncnttggcanctacttggtttggctcctctcgaatcgcgtcaaggcaatcaacccaggccggccggtcggttgangaaggaggccgggggagcggcatggatagcggtgctgacgagcaggggaggcagaacggccatggcggggacggcggggacccggcggagtggaagaaggtggcggagctccgggccgtggtggaggcgcaggaccccgcagccaaggaggaggacgatttcatgctgcggcggttcctgcgcgctcgggaccacaacatcaataaggcgtcgacgatgttcctcaagtacctgagctggaagcgcaccgccaagccgcggggatccatcaccgaggccgaggtgcgcggcgagctcgtgcaggacaagctctacgtgcagggcttngacangacngggcgccccatgatctacctcttcggcaaccggcacttngccgccaagcgcgacctcgaggagttcaagcgctangtcntctacatcctcgacaacacctgcaccaagttgccggcngggcaggagaagttngcgtcggtggtgganctgaaggggtgggggtacgccaactgcgacatccgngcnaagntggcggcnctggacatnatgcanaactactacccagagcggctnggnngggtgttcctgatccangtgccntacgtgttcatggcagcatggaagatggtgtaccccttcatcgacgacaanaccaagaagaagtttgtctttgtcgccgacaaggacctngatgccacgctacgggncgccattgangtgncccanctgcccgagcaatacgnaggcaagctcagactcgagggatacaagagctcgtngncaccnccgtngncgacgngcgactgatttggtttattaggggtgtccaattgtgtgaaagtatgctacattgccccgcttgataagcaagtaatactcatcctttcatctatgcaaggccgcttaactcttgcctna

SEQ ID NO: 1152 - DNA, 924 bp, Triticum aestivum
  misc_feature (40)..(40): n is a, c, g, or t
ctctcgaatcgcggcaaggcaatcaaccggggccggcggntcggttgaggaaggaggccgggggcgcggcatggactgcggcggtgaggagcaggcgaggcagaacggccatgccggcgacggcggcgacccggcggagtggaagaaggtggccgagctccgggccgtggtggaggcgcaggaccccgcagccaaggaggaggacgacttcatgctgcgccggttcctgcgcgcccgagaccacaacatcagcaaggcgtcggcgatgttcctcaagtacctgagttggaagcgcggcgccaagcctcgcggctccatcaccgaggccgaggtgcgcggcgagctcgtgcaggacaagctctacattcagggcttcgacaagacgggccgccccatgatctacctcttcggcaaccgccacttcgccgccaagcgagaccttgaggagttcaagcgatacgtcatctacatccttgacaacacctgcaccaagttgccggcagggcaggagaagtttgcgtcggtggtggatctcaaggggtgggggtacgcgaattgcgacatccgggcgaagctggcggcgttggagatcatgcagaactactacccggagcggctgggccgggtgttcttgatccacgtgccttacgtgttcatggcggcgtggaagatggtctaccccttcatcgacgacaacaccaagaagaagtttgtctttgttgcagacaaggaccttgacggcacgcttcgggacgccatcgacttgtcccagctgcccgagcagtacggcggcaagctcagactcgagggatacaagagctcgtcgacaacgctatagtcaacgtgtgactgatttggtttattaagggtgtccagttgtgtgaaagtatgctacattgccccgcttgataagcaagtaatact

SEQ ID NO: 1153 - DNA, 1036 bp, Leymus cinereus x Leymus triticoides
  misc_feature (31)..(32): n is a, c, g, or t
  misc_feature (447)..(447): n is a, c, g, or t
  misc_feature (451)..(451): n is a, c, g, or t
  misc_feature (471)..(471): n is a, c, g, or t
  misc_feature (572)..(572): n is a, c, g, or t
  misc_feature (575)..(575): n is a, c, g, or t
  misc_feature (603)..(603): n is a, c, g, or t
  misc_feature (620)..(620): n is a, c, g, or t
  misc_feature (623)..(623): n is a, c, g, or t
  misc_feature (638)..(638): n is a, c, g, or t
  misc_feature (654)..(654): n is a, c, g, or t
  misc_feature (668)..(668): n is a, c, g, or t
  misc_feature (674)..(674): n is a, c, g, or t
  misc_feature (689)..(689): n is a, c, g, or t
  misc_feature (710)..(710): n is a, c, g, or t
  misc_feature (713)..(713): n is a, c, g, or t
  misc_feature (717)..(717): n is a, c, g, or t
  misc_feature (730)..(730): n is a, c, g, or t
  misc_feature (733)..(733): n is a, c, g, or t
  misc_feature (778)..(778): n is a, c, g, or t
cggcaaggcaatcaaccaggccggccggtcnnttgaggaaggaggccgggcggcggcatggacagcggtgctgaggagcaggcgaggcagaacggccatggcggcgacggcggtgacccggcggagtggaagaaggtggccgagctccgggccgtcgtcgaggcacaggaccccgcagccaaggaggaggatgacttgatgctgcggcggttcctgcgcgcccgggaccacaacatcaacaaggcgtcggcgatgttcctcaagtacctgagctggaagcgcggcgccaagccgcggggctccatctccgagggagaggtgcgcggcgagctcgtgcaggacaagctctacgtgcagggcttcgacaaggcgggccgccccatgatctacctcttcggcaaccggcacttcgccgccaagcgcgacctcgaggagttcaagcgctangtcntctacatcctcgacaacacntgcaccaagtgcgtaaagctgaatgtgcaagttatcctactagttaatagtggattattgatgtatatgtgtcgttctatgtgttcttcaggttgccggcnggncaggagaagttcgcgtcggtggtggacntgaaggggtgggggtangcnaactgcgacatccgngcgaagctggcggcantggacatcatgcanaactantacccggagcggctngggcgggtgttcctgatccangtncctncgtgttcatggcngcntggaagatggtgtaccccttcatcgacgacaacaccaagaagaantttgtcttcgtcgctgacaaggaccttgacgccacgctccgggatgccatcgatgtgtcccaactgcccgagcagtacggtggcaagctcagacttgagggatacaagagctcgtcgccaccgccgccgtcgacgcgcaactgatttggttttttaagggtgtcaaattgtgcggaagtatgttacattgccccgcttgataagcaagtaatactcatcctttcatctaggcaaggccgcttaggattcaaaaaaaaa

SEQ ID NO: 1154 - DNA, 1739 bp, Saccharum officinarum
acgccctacctctcccctcaacccagcgccccccccttccccgccgccgatagggtttctactccccgcgccgcccgcccccaaatcgtccccgaagcttccagtgcctcgcgccgcagccatgagcgacggcaaggactccctcgacctctccgccctcggcgccgccatccccaactcggccgagctcagcgcggaggacaaggctcaccttgtggcgtcgatcaagaacacgctcgagggattggcgtcgcggcataccgacgtgctcgagaacctggagcccaaggtcaggaagcgcgtcgagaagctcagggagatccagggccaacacgatgaacttgaggcaaagtttttcgaggagagagcagctctagaagctaagtatcagaagttgtatgaaccactttactcaaagcgttacgaaatcgtcaatggtgtcgttgaggttgagggtgtcacagaagaaagtgcagctgaaacccctgcagagcaaaagagtggagatgagacctctgctgagcaaaaagaagaaaaaggtgtaccagctttctggcttaatgcaatgaagaatcatgaaattctagctgaggaaatccaggagagggatgaggaagctctcaagtacctcaaggacatcaagtggtacaggatcagcgagccaaagggctttaagcttgaatttcactttgatacaaatccgttcttcaagaattcagtgcttacaaaaacatatcacatgattgatgaggatgaaccaattctggagaaagccattggtactgaaattgaatggtaccctgggaagtgcttgacacaaaaggtgctaaaaaagaagccacggaaggggtcaaagaacactaaacctatcacaaaaactgaagattgtgagagcttcttcaacttcttcagtccacctcaagtccctgatgatgatgaggaaattgatgaggatacagctgaacagttgcagaaccaaatggagcaagattatgatattggatctaccatcagagacaagattatcccacatgctgtctcgtggttcactggagaggctgctcaagacgaggacttcgaagttatggatggtgaggacgacgaagacgatgacgatgaagacgaagacgacgaggatgaagatgatgatgatgattacgataccaagaagaccaagggaactgctggaggggaagggcagcaaggggaacgacctgcagagtgcaagcagcagtaaggtgctgcacatcaaatattggcaggcattggttgtggagcaattagtttggttctgcttgatgcaatgttattgagttggttttgtggagcccttgaggtgagggggcgcttgttggttttatggaattggtgggggggatttttctgggacatggtgttatatgtggtagttttgtcacttgctgtattgggtttcagatattatatatgtgctcttcttatgcttggagtgaagatggttgccactctggtatggcttattgtgcatacctgctttcatcaagcgtgccgtgccgctgagaaattttgttctaggggaaaggctagccttttgcctgaaaatgtattgcgaattgcatcttgcacatggtcttgcatttaccattttgtacgttgttacacaatgacctcgttccagactccatttcagcggtttccgagttttgaaggaagttcagctcggtaactattagaaataaagaaagcgattggtgaagttc

SEQ ID NO: 1155 - DNA, 1556 bp, Zea mays
aaccagcgcagccctcaattcctcactctttttttatcccctcctctgccattccctccctctcccctcaacccagcgcccccctcccgccgccactagggtttctcctccccgcccacccccaaaccatccccgaagcttccagtgcgtcgcgccgcaaccatgagcgacggtaaggactccctcgacctctccgccctcggcgccgccatccccaactcggccgagctcagcgcggaagacaaggctaaccttgtggcgtcgatcaagaacacgctcgagggattggcatcgcggcataccgacgtgctcgagaacctcgagcccaaggtcaggaagcgcgttgagaagctcagggagatccagggcgaacacgatgaacttgaggcgaagtttttcgaagagagagctgctctagaagctaagtatcagaagttgtatgaaccactttactcaaagcgttatgaaattgtcaatggtgtggtcgagattgagggtatcacaaaagaaagtgcagctgaaaccccagaggagcaaaaaagtggagatgagacctctgctgagcaaaaagaagaaaaaggtgtaccagctttctggcttaatgcaatgaagaatcatgaaattttagctgaggagatccaggagagggatgaggaagctctcaagtacctcaaggacatcaagtggtacaggatcagcgagccgaagggttttaagcttgaatttcactttggtacgaatatgttcttcaagaattcggtgcttacaaaaacatatcacatgatcgatgaggatgaaccaattctggagaaagccattggtactgaaattgaatggtaccctgggaagtgcttgacacaaaaagtgctaaaaaagaagccacggaaggggtcaaagaacacgaaacctatcacaaaaaccgaagattgtgagagcttcttcaacttcttcagtccacctcaagtccctgatgacgacgaggaaattgatgaggacacagctgaacagttgcagaaccaaatggagcaagattatgatattggatctaccatcagagacaagattatcccacatgctgtctcgtggttcactggagaggctgctcaagatgaggactttgaagttatggatggcgaggacgacgacgatgaagacgacgatgatgaagacgacgaggatgaagatgacgatgattatgatacaaagaagaccaagggaactgctggaggggaagggcagcagggtgaacgacctgcagagtgcaagcaacagtgaggtgtgatgtcattaagttggttttgtggggccgttgggtgggggttcttgttggttttattttatggaactggcggggggatttttctgggacatgttacatgtgggtctgtattgggtttcagatgttatatttttttttttttttttggagtgaagatagtccatggttgccactctgggtgtcttattgttcaggtcactggcattgtgtactgtactttcaagcgtgccgatgccgtgccgctgagaaatttttgttttttctaggggaaaaggct

SEQ ID NO: 1156 - DNA, 1537 bp, Zea mays
cccagcgcccccctcccgccgccactagggtttctcctccccgcccacccccaaaccatccccgaagcttccagtgcgtcgcgccgcaaccatgagcgacggtaaggactccctcgacctctccgccctcggcgccgccatccccaactcggccgagctcagcgcggaagacaaggctaaccttgtggcgtcgatcaagaacacgctcgagggattggcatcgcggcataccgacgtgctcgagaacctcgagcccaaggtcaggaagcgcgttgagaagctcagggagatccagggcgaacacgatgaacttgaggcgaagtttttcgaagagagagctgctctagaagctaagtatcagaagttgtatgaaccactttactcaaagcgttatgaaattgtcaatggtgtggtcgagattgagggtatcacaaaagaaagtgcagctgaaaccccagaggagcaaaaaagtggagatgagacctctgctgagcaaaaagaagaaaaaggtgtaccagctttctggcttaatgcaatgaagaatcatgaaattttagctgaggagatccaggagagggatgaggaagctctcaagtacctcaaggacatcaagtggtacaggatcagcgagccgaagggttttaagcttgaatttcactttggtacgaatatgttcttcaagaattcggtgcttacaaaaacatatcacatgatcgatgaggatgaaccaattctggagaaagccattggtactgaaattgaatggtaccctgggaagtgcttgacacaaaaagtgctaaaaaagaagccacggaaggggtcaaagaacacgaaacctatcacaaaaactgaagattgtgagagcttcttcaacttcttcagtccacctcaagtccctgatgacgacgaggaaattgatgaggacacagctgaacagttgcagaaccaaatggagcaagattatgatattggatctaccatcagagacaagattatcccacatgctgtctcgtggttcactggagaggctgctcaagatgaggactttgaagttatggatggcgaggacgacgacgatgaagacgacgatgatgaagacgacgaggatgaagatgacgatgattatgatacaaagaagaccaagggaactgctggaggggaagggcagcagggtgaacgacctgcagagtgcaagcaacagtgaggtgtgatgtcattaagttggttttgtggggccgttgggtgggggttcttgttggttttattttatggaactggcggggggatttttctgggacatgttacatgtgggtctgtattgggtttcagatgttatatatgctcttatatgcttggagtgaagatggtccatggttgccactctggatgtcttattgttcaggtcactggcattgtgtactgtactttcaagcgtgccgatgccgtgccgctgagaaattttgttctactaggggaaaggctagccttctgcctgaatgttatgcgttaattgactatcttgacaacaaaaaaaaaa

SEQ ID NO: 1157 - DNA, 1580 bp, Zea mays
ggagtccaaactccaaaccaaaccggcgcttctcccacgtcttctcgagttcccacgcgcccgcctgctataaatcgcatccctcaatccccactctttatcccctcctcagccatcgcctccctctcccctcaacccagcgcccccctcccgccgccgctagggtttctcctccctccccgcccacccctaaatcatttccgaagcttccagtgcgccgcagccatgagcgacggcaaggactccctcgacctctccgccctcggcgctgccatccccaactcggccgagctcagcgcggaggacaaggctaaccttgtggcgtcgatcaagaacacgctcgagggattggcgtcgcggcataccgacgtgctcgagagcctcgagcccaaggtcaggaagcgcgtcgagaagctcagggagatccagggcgaacacgacgaacttgaggcaaaatttttcgaggagagagctgctctagaagctaagtatcagaagttgtatgaaccactttactcaaagcgttacgaaattgtcaatggtgtggtcgaggttgagggtatcacagtagaaagtgcagctgaaacccctgcggagcaaaagactggagatgagacctctgctgatcaaaaagaagaaaaaggtgtaccagctttctggcttaatgcaatgaagaatcatgaaattctagctgaggagatccaggagagggacgaggaagctctcaagtacctcaagaacatcacgtggtataggatcagcgagccgaagggctttaagcttgaatttcaatttggtacaaatccgttcttcaagaattcagtgcttacaaaaacatatcacatgattgatgaggatgaaccaattttggagaaagccattggtactgaaattgaatggtaccctgggaagtgcttgacacaaaaggtgctaaaaaagaagccacggaagggttcaaagaacactaaacctatcacaaaaactgaagattgtgagagcttcttcaacttcttcagtccacctcaagtccctgatgatgatgaggaaattgatgaggatatagctgaacagttgcagaacgaaatggaacaagattatgatattggatctaccatcagagacaagattatcccacatgctgtctcgtggttcactggagaggctgctcaagatgaggagtttgaagttatggatggtgaggatgacgatgatgaagacaatgatgatgaagacgaagatgacgaggatgatgatgatgatgatgattacgattcaaagaagaccaagggaactgccggaggggaagggcagcagggcgaacgacctgcagagtgcaagcagcagtgaggtgctgcacaatgaatgttggcaggcattgtttgtggagcaattagtttggttctgcttgatgctcaaggtcattgagttggtttgtggaaccttcgagggggcgcttgttggttttatggaattggttggggaatttttctgggacatggcgttatatcattatatgtgggtagtttcttcactttctgtattgggtttcagatattatatgtgttcttatgcttggagtg

SEQ ID NO: 1158 - DNA, 1639 bp, Zea mays
atcccctcctcagccatcgcctccctctcccctcaacccagcgcccccctcccgccgccgctagggtttctcctccctccccgcccacccccaaatcatttccgaagcttccagtgcgccgcagtcatgagcgacggcaaggactccctcgacctctccgccctcggcgctgccatccccaactcggccgagctcagcgcggaggacaaggctaaccttgtggcgtcgatcaagaacacgctcgagggattggcgtcgcggcataccgacgtgctcgagagcctcgagcccaaggtcaggaagcgcgtcgagaagctcagggagatccagggcgaacacgacgaacttgaggcaaaatttttcgaggagagagctgctctagaagctaagtatcagaagttgtatgaaccactttactcaaagcgttacgaaattgtcaatggtgtggtcgaggttgagggtatcacagtagaaagtgcagctgaaacccctgcggagcaaaagagtggagatgagacctctgctgatcaaaaagaagaaaaaggtgtaccagctttctggcttaatgcaatgaagaatcatgaaattctagctgaggagatccaggagagggacgaggaagctctcaagtacctcaagaacatcacgtggtataggatcagcgagccgaagggctttaagcttgaatttcaatttggtacaaatccgttcttcaagaattcagtgcttacaaaaacatatcacatgattgatgaggatgaaccaattttggagaaagccattggtactgaaattgaatggtaccctgggaagtgcttgacacaaaaggtgctaaaaaagaagccacggaagggttcaaagaacactaaacctatcacaaaaactgaagattgtgagagcttcttcaacttcttcagtccacctcaagtccctgatgatgatgaggaaattgatgaggatatagctgaacagttgcagaacgaaatggaacaagattatgatattggatctaccatcagagacaagattatcccacatgctgtctcgtggttcactggagaggctgctcaagatgaggagtttgaagttatggatggtgaggatgacgatgatgaagacaatgatgatgaagacgaagatgacgaggatgatgatgatgatgatgattacgattcaaagaagaccaagggaactgctggaggggaagggcagcagggcgaacgacctgcagagtgcaagcagcagtgaggtgctgcacaatgaatgttggcaggcattggttgtggagcaattagtttggttctgcttgatgcgcaaggtcattgagttggtttgtggaaccttcgagggggcgcttgttggttttatggaattggttggggaatttttctgggacatggcgttatatcattatatgtgggtagtttcttcacgttctgtattgggtttcagatactatatatgtgttcttatgcttggagtgaagatggttgccactctggtatgtcttattgtgcataccactggcatagtgtgctgtctgtactttcatcaagcgtgccgtgccgctgagaaattttgctctaggggaaaggctagccttttgcctgaaaatgttttgcgaattgcatcttgcata

SEQ ID NO: 1159 - DNA, 1661 bp, Setaria italica
ctcctcccctcgccgcctccctcccccaaatctacccaccgaagcttctagggcctcgcgacgcccctccgcagcagccatgagcgacggcaaggactccctcgacctctccggcctcggagccgccctccccaacgcgaccgagctcagcgcggaggacaaggctaaccttgttgcgtcgatcaagaacacgcttgagggattggcgtcgcggcatatcgacgtgcttgagagcctcgagcccaaggtcaggaagcgcgtcgagaagctcagggagatccagggccaacatgatgaacttgaggcaaagtttttcgaggagagagctgcacttgaagctaagtatcagaagttgtatgagccactttactcaaagcgttatgaaattgtcaatggtgtgatcgaggttgagggtgtcaaagaagaaagtgcagctgaaacccctgcagagcaaaagagtggagatgaaaagcctgccgagcaaaaagaagaaaaaggtgtgcctgctttctggctcaatgcaatgaagaatcatgaaatcctggctgaggagatccaggagagggatgaggaagctctcaagtacctcaaggacatcaagtggtacaggatcagcgaacctaagggttttaagcttgaatttcactttgatacaaatccattcttcaagaattcagtgcttacgaaaacatatcacatgattgatgaggatgaaccaattctagagaaagccattggtactgaaattgaatggcaccctgggaagtgcttgacacaaaaggttcttaaaaagaagccaaggaaggggtcaaagaacactaaacctatcacaaaaactgaagattgtgagagcttcttcaacttcttcagtccacctcaagtacctgatgatgatgaggaaattgatgaggatacagctgaacagttgcagaaccaaatggagcaagattatgatattggatctaccatcagagacaagattataccacatgctgtctcatggttcactggggaggctgctcaagatgatgactttgaaggccttatagatggtgatgaggatgatgatgaagacgacgaggacgatgaagatgaagaggatgaggaaagtgaagatgattatgatgccaagaagacccagggagctgctggaggggaagggcagcagggtgaacgacccgcggagtgcaagcagcagtgaggtgaacgacctgtggagtgcaagcagcagtgaggtgctgtgcatcgaatgcttgcagacagcggttctggaatgatggaagtttggttctgcttgatgcaatgtcattgagttggttttgtggagcccttgggggggcgcgtgttggttttgtggaattggtggggggatttttccgggacatggtatcatatgttggtagttttgtcacttgctgtattgggtttcagatattatgtgctctgcttatgctttgagtgatcattgtcgccagtctggtatcttattgcacatacctctggcatagcgtgctgtacttcataaagcgtgttgcggagaaattttgctctagggatttaggctagcattttgcccgactgtttttgtgaatttcatcttacgcagcgtcttacaatttagagcttatatgttactctacaacttaatgtgaaatgctgtg

SEQ ID NO: 1160 - DNA, 1653 bp, Pennisetum glaucum
cgccacccctccctctcccccctcaacccgagcgccccctcccgccgccgctagggtttctcctcccctcgccgcctccctcccccaaatctacccaccgaagcttcaagggcctcgcgcggcctctccgcagcagccatgagcgacggcaaggactccctcgacctctccggcctcggcgccgccctccccaacgcgaacgagctcagcgcggaggataaggccagtctcgtggcgtcgatcaagaacacgctcgagggattggcttcgcggcatatggacgtgcttgataacctcgagcccaaggtcaggaagcgcgttgagaagctcagagagatccagggccaacatgatgaacttgaggcaaagttttttgaggagagagctgcacttgaagctaagtatcagaagttgtatgagccactttactcaaagcgttatgaaattgtcaatggtgtgattgaggttgagggtgtttcaaaagaaagtgcagctgaaacccctgcagaaaagagtggagatgaaaaccctgctgagcaaaaagaagaaaaaggtgtccctgctttctggcttaatgcaatgaagaatcatgaaatcctggctgaggagatccaggagagggatgaggaagctctcaagtacctgaaggacatcaagtggtacaggatcagcgaacccaagggttttaagctcgaattctactttgatacaaatccattcttcaagaattctgtgcttacgaaaacatatcacatgattgatgaggatgaaccaattctagagaaagccattggtactgaaattgaatggctccctggtaagtgcttgacacaaaaggttcttaaaaagaagccgcggaaggggtcaaagaacactaaacctatcacaaaaactgaagattgcgagagcttcttcaacttcttcagtccacctcaagtacctgatgatgaggaggaaattgatgaggatacagctgaacagttgcagaaccaaatggagcaagattatgatattggatctaccatcagagacaagattataccacatgctgtctcatggttcactggagaggcagctcaagatgatgattttgaaggccttatagatggtgatgaggacgatgatgaagatgatgaggatgatgaagatgatgaggatgaggaaagtgaagatgattctgataccaagaagaccaagggagctgctggaggggaaggccagcagggtgaacgacctgcggagtgcaagcagcagtgaggtgctacactacacatattgcagacaatggttctggaagtttggttctgcttgatgcaatgtcattgagttggttttgtggagcccatggggggcgtgcgttggttgtggaatttgtgggggaatttttccgggacatggtgtcatatgttggtagttttgtcacttgctgtattgggtttcagatattatgtgctctgcttatgctttgagtgatcattgttgccagtctggtatcttattgcacatacctctggcatagcgtgctgtactttcatgaagcgtgttgcggagaaattttgctctagggaaaaggctagcattttgcctgactgttgaattgcattttacgcatcatcttacaatttggaggttgtgtacttatgttactgtaca

SEQ ID NO: 1161 - DNA, 1610 bp, Panicum virgatum
cccctccctctcccctcaacccccagcgccccctcccgccgccgctagggtttctcctcccctcgccgcctccccccaaatctccccaccggagcttctagagcctcgcgcggcccctccgcagcagccatgagcgacggcaaggactccctcgacctctccggcctcggcgccgccgttcccaactcgaacgagctcagcgcggaggataaggctaacctcgtggcctcgttgaagaacacgctcgagggattggcgtcgcagcatatggacgtgctcgaaggcctcgagcccaaggtcaggaagcgtgtcgagaagctcagggagatccagggacaacatgatgaacttgaggcaaagtttttcgaggagagagctgcacttgaagctaagtatcagaagatgtatgaaccactttactcaaagcgttacgaaattgtcaatggtgtgatcgaggttgagggtatcacagaaagtgcagatgaaacccctgcagagcaaaagagtggagatgaaacccctgctgagcaaaaagaagaaaaaggtgtgccagctttctggcttaatgcaatgaagaaccatgaaatcctggctgaggagatccaggagagggatgaggaagctctcaagtaccttaaggacatcaagtggtacaggatcagcgaacctaagggttttaagcttgagtttcactttgatacaaatccattcttcaagaattcagtgcttacaaaaacatatcacatgattgatgaggatgagccgattctagagaaagccattggtactgaaatcgaatggtaccccgggaagtgcttgacacaaaaggttctaaaaaagaagccgaggaaggggtcaaagaacactaaacctatcacaaaaactgaagactgcgatagcttcttcaacttcttcagtccacctcaagtccctgatgatgatgaggaaattgatgaggatacagctgaacaattgcagaaccaaatggagcaagattatgatatcggatctaccatcagagacaagatcattccacatgctgtctcatggttcactggagaggctgctcaagatgatgactttgaaggccttatagatggtgatggggatgatgatgaagaagatgatgaagatgaagatgaagaggatgaggaaagtggagatgattatgatacgaagaagaccaagggagctgccggaggggatggccagcagggtgaacgacccgccgagtgcaagcagcagtgaggtgctgcacattgaatttctgcacacagtggattcttgcatgatggaagtttggttctgcttgatgcaatgtcattgagttggttttgtggggcccttggaggggcttgtgttggttttgtggagtcggtgggggggatttttctgggacatggtatcgctatcatatgttggtagttttgtcacttgatgtattgggtttcagatattatgtgctctacttatgctttgagtgatcattgttgccagcctggtatttcttattgcacataccgctggcttagcatgctgtacattcatgaagcgtgttgtggagaaattttgctctagaggaaagccggaaaggctactttcacctgact

SEQ ID NO: 1162 - DNA, 2753 bp, Oryza sativa
aagaagcgcagttcccacgcgcccggctataaatcgcatccccgcattcctagcctcttccctttttctatcccctccgcctccactcccctctcccctcctctcaacccccacagctcgcgccgccgccgcagctagggtttctctccgccctagcctacctcgcggagacctaccacccgaagcttcgggaaccctcgcatagccgccatgagcgacggcaaggactccctcgacctctccggcctcggcgccgccgtccccaacgccaaagagctcagcgcggaggacaaggccaacctcgtggagtcgattaagaacacgctgcagggattggcggcgcggcacacggacgtgctcgagagcctcgagcccaaggtcaggaagcgcgtggaggtgcttagggagatccagagccaacacgatgatctagaggcgaagttctttgaggagagagctgcacttgaagctaaatatcagaagatgtatgaaccactttactccaagcgttatgaaatcgtgaatggtgtggttgaggtagatggtgtcaccaaagaagctgcagatgaaacccctgcagagcagaaagaggagaagggtgtaccagagttctggcttaatgccatgaagaaccatgaaattctgtctgaggagatccaggagagggatgaggaagctcttaagtacctcaaggacatcaaatggtacagaattagtgagccaaagggtttcaagcttgaattttacttcgatactaatccattcttcaagaactcggtgcttaccaaaacataccacatgattgatgaagatgaaccaattctggagaaagccattggtactgaaattgaatggttccctgggaagtgtttgacacaaaaggttctcaagaagaaaccaaagaagggctcaaagaacactaaacctatcacaaaaactgaaaactgtgagagcttctttaacttcttcagcccacctcaagttcctgatgatgatgaggaaattgatgaggatacagctgaacagttgcagaaccaaatggagcaagattatgacattggatctaccatcagagacaagatcattccacatgctgtttcatggtttactggagaggctgctcaagatgaggacttcgaaggcattatggatgatgaagatgatgacgatgaagatgacgacgatgatgaagatgaggatgacgagggtgatgatgaagacgacgaggatgaaaagaagggcggacgagttcctgcaggggaagggcagcagggagagcgacctgcagaatgcaagcaacagtaagatgcttcctacctgagcgtttccaaagtccggtcctggagtgaagaagaatgtttggttcggcttgatgcaatgtctcgtccatttggtttggagagccagttggggaagtgttgggattgagttggtttagtggaactggcgggggatatttttttcgggacatggtattatatgtttggtagctttttccattgttgtattgggtcgacatatcttgtgcgaagcttatggttgagtgatgaatatcgccggtttggtattatcatattgccaataccactggcatagtgctgagaaattttgatctaggagaggcaatgtttttgtgcgaccaagttgcatctttgatggcaaggaaattgttcttttttttttttagttttgcaattcaaccgaggcttgagtaaagtaatctcgcaagtgccttgtctgcgtgctcataagcgatttcttgacaagacaattttgttcgactgccacgcagaaattgaccgaaattcgccgtgaaactaccgtttgaactctgaagagtgaacttttgagtcacacgtgtaggctggcatacaaccaatgacaataacacaagaagcaaagctctgccttcaaaccaaatgaacaaacaagagctaccatcttcagaccatgaagaacgccagttacatcgagctgggttagtgacctggaggaatccagtactacaactctattacaaaatgctcgagcttgctgctccctgtacctttggcggtctaatctccatactgaatccaaaaatctgtggagaacctgaaccaaaccctctatacgtgtcgtaagtcataacctacccctgtccataaacttcttaacttcatcatacaaaacaagtatggcggcagcgccagtgctcctaaacatgttagaaagtgctccgcggtagaacgacttgatcccctccaccttgtagatcttcctccagcaatcaagggtgctgctgtacatctgcacatccatccctgattgcatcatcatcctccttcgcacggtatccagcgggtacgagatgagccccgccatggaagtgactgcctgtgctgtcacccagcgctgccacaggggcgagtctagtggtaccatcacatccttggcggtgtcaaagcctccaaagtataagccccggtgaacgaccatcccttgtagtgatgctggcaatcctctgtagataccccggatgccgtttttattgtagatggtttgaacgaagtggcaaatgcctctgaactggcgagtatcggtccggccaatatcagctgcaagacgggtatgagcaatatcaagtggataaatgaggaccagagtagtacatccagccgcagcaccagcaatgaagttggttaaagcaatagaagagaacttgttatcagctgaggttcctgcatctttcagtatgctcctgtacagatcct

SEQ ID NO: 1163 - DNA, 1686 bp, Brachypodium distachyon
atcccctccttcggcctccacttctctccccctctctctcccccccctctctctcttccacttccccctctcgctgcgccgccgccgctagggtttctgccccttatcaagccgtagaaccctacacctgttcctacacgccgccatgagcgaggaaggcaaggacgcgctcgacctctccgccatcagcgccgccgtacccaacgccgcagagctcagcgccgaagacaaggccaacctcgtggagtcgattaagaacacgctgcagggattggcggcgcagcactcggacgtgctcgagaacctcgagcccaaggtcaggaagcgcgtcgaagcgctcagggagatccagagccaacatgatgaacttgaggcaaagttttttgaggagagagctgcccttgaagctaaatatctgaagatgtatgaaccactgtattcaaagcgttatgaagttgtcaatggtgtggttgaagtagaaggtgtaacaaaagatgaggcggctgtaactgctgctgatcagaaagaggaaaagggtgtgccagatttctggcttaatgcaatgaagaaccatgaaatcctggctgaggagatccaggagagagatgaggaagctctcaagtacctcaaggacatcaaatggtacagaattaatgagcccaagggtttcaagcttgaatttcactttgacactaatccattcttcaagaactcagtgcttacaaaaacataccacatgattgatgaagatgaaccaatcctagagaaagccattggtactgaaattgaatggtatcctgggaagtgcttgacacaaaaggttctaaaaaagaagccaaagaaggggtccaagaacactaaacccatcacaaaaactgagatgtgtgatagcttctttaatttcttcactccacctcaagttccagatgatgatgaggaaattgatgaggacacagctgaacagttgcaaaaccaaatggagcaagattacgatattggatctaccattagagacaagattatcccgcatgctgtttcatggttcactggtgaggctgctcaagatgaggactttgatggcatcatggatggtgaagatgatgatgatgaagatgatgacgaggatgaagatgaagatgaggacgatgaggaagacgaagatgacgagggtgataagaagaagggcgggcgagttcctgcaggggaagggcagcagggggagcggcctgctgagtgcaagcaacagtgagatccttagaacgtgaatgttccaaattcagtgattctggattgaagaatgctgggttctgcttgatgctatgtcgttgagttggttctgtggggccagtgggggattgagtaagttttgtggaaccggtggtggattttttttggacatggtattatatatgctggtagtctttctattgttgtattgggttgaaatacttgtgcggtgtttatgctggagtgatcaatgttgcagtttggtatgtcattgcaaatgccacaggctagtctacttgttttgccaggaaattttgatctaggggaatgttatcttatttgggtttacattgttttgaagtctccacatcaactgagtgatgtctcccgtgctgaaagctgttgctacttgattgtcaactggctagctcttgtgtctcctgctgaaagctgttgcta

SEQ ID NO: 1164 - DNA, 1617 bp, Avena sativa
ctccactccccccacgcagcagcgccccaaccccccacgcgccgccgcccctctagggtttctctcctcgccgcctcccaagcagcagaacccttgccccgcgccgccgcagccatgagcgacggcaaggactccctcgacctctccgccctcggggccgccgtccccaacgccgcagagctcagcgccgaggataaggcgaacctcgtggagtcgattaagaacacgctgcagggattggccgcccggcacacggacgtgctcgagagcctcgagcccaaggtcaggaagcgtgtggaagcgctcagggagatccagagccagcatgatgaccttgaggcaaagtttttcgaggagagagctgcacttgaagctaaataccagaagatgtacgaaccactgtactcaaagcgttatgatgttgtcaacggtgttgttgaggtcgaaggcgtaactaaagatgatgcaggagaagctgctgcagataagaaagaggaaaagggtgtgccagatttctggttcaatgcaatgaagaaccatgaaatccttgctgaggagatccaagagagggatgaggaggctcttaagtacctgaaggacatcaaatggtacaggattagtgagccaaagggtttcaagcttgaatttcacttcaatactaatccattcttcaagaatgaagtgcttacaaaaacgtatcacatgatcgatgaagacgagccaatcctagagaaagcaattggtactgaaattgaatggtatcctgggaagtgcttgacacaaaaggtgcttaaaaagaagccaaagaaggggtcaaagaatgcaaagcctatcacgaaaattgaaaattgcgagagcttctttaatttcttcagtccaccacaagttcccgacgatgacgaggaaattgacgaggatacagctgagcagttgcaaaaccaaatggagcaagattatgatatcggatctaccatcagggacaagattatcccacacgctgtttcgtggttcactggagaggctgttcaggatgaggaatttgatggcatgatggatgatgatgaagacgaggatgaagatggcgacgaggatgaagatgaggacgaggatgatgaggaagacgaagacgacgatgacgatgatgctgctcctaagaagaagggcggtcgtgttcctgcaggggaagggcagggggagcggcctgcagagtgcaagcaacagtgaggtgcatcatacatgaccatttccgaagacctgttgttctctgttgaagaatgtttggttctacttgatgcgctatgtcgttgagttggttctgtggagccagtggggggattgagttggttttgtggaaccggtgggggatttctttcttggtgacatggtcttgtatgctggtagcctttccattgttgtattgggttgaaatactttatgtgctgcttggagtgatcaatgttgccagtttggtatgtcttattgcaaataccaccggcatactacttgttttgcccggaaattttgatctaggtgtcttgttttatctatgttgttctgaactgcatcttagcttgtagcccatgttatggaattgcagctcaacaatggttctatggg

SEQ ID NO: 1165 - DNA, 1633 bp, Avena sativa
cttccgcctccacccctccactccccccacgcagcagcgccccaaccccccacgcgccgccgcccctctagggtttctctcctcgccgcctcccaagcagcagaacccttgccccgcgccgccgcagccatgagcgacggcaaggactccctcgacctctccgccctcggggccgccgtccccaacgccgcagagctcagcgccgaggataaggcgaacctcgtggagtcgattaagaacacgctgcagggattggccgcccggcacacggacgtgctcgagagcctcgagcccaaggtcaggaagcgtgtggaagcgctcagggagatccagagccagcatgatgaccttgaggcaaagtttttcgaggagagagctgcacttgaagctaaataccagaagatgtacgaaccactgtactcaaagcgttatgatgttgtcaacggtgttgttgaggtcgaaggcgtaactaaagatgatgcaggagaagctgctgcagataagaaagaggaaaagggtgtgccagatttctggttcaatgcaatgaagaaccatgaaatccttgctgaggagatccaagagagggatgaggaggctcttaagtacctgaaggacatcaaatggtacaggattagtgagccaaagggtttcaagcttgaatttcacttcaatactaatccattcttcaagaatgaagtgcttacaaaaacgtatcacatgatcgatgaagacgagccaatcctagagaaagcaattggtactgaaattgaatggtatcctgggaagtgcttgacacaaaaggtgcttaaaaagaagccaaagaaggggtcaaagaatgcaaagcctatcacgaaaattgaaaattgcgagagcttctttaatttcttcagtccaccacaagttcccgacgatgacgaggaaattgacgaggatacagctgagcagttgcaaaaccaaatggagcaagattatgatatcggatctaccatcagggacaagattatcccacacgctgtttcgtggttcactggagaggctgttcaggatgaggaatttgatggcatgatggatgatgatgaagacgaggatgaagatggcgacgaggatgaagatgaggacgaggatgatgaggaagacgaagacgacgatgacgatgatgctgctcctaagaagaagggcggtcgtgttcctgcaggggaagggcagggggagcggcctgcagagtgcaagcaacagtgaggtgcatcatacatgaccatttccgaagacctgttgttctctgttgaagaatgtttggttctacttgatgcgctatgtcgttgagttggttctgtggagccagtgggggggattgagttggttttgtggaaccggtgggggatttctttcttggtgacatggtcttgtatgctggtagcctttccattgttgtattgggttgaaatactttatgtgctgcttggagtgatcaatgttgccagtttggtatgtcttattgcaaataccaccggcatactacttgttttgcccggaaattttgatctaggtgtcttgttttatctatgttgttctgaactgcatcttagcttgtagcccatgttatggaattgcagctcaacaatggttctatggg

SEQ ID NO: 1166 - DNA, 1510 bp, Triticum aestivum
gaggaaggagcccgagtctccagcagccatgagcgacggcaaggacaccctcgacctctccgccctcggcgccgccgtccccaacgccgcagagctcagcgccgaggacaaggccaacctcgtggagtcgattaagaacacgctgcagggattggcggcgcggcacacggacgtgctcgagagcctggagcccaaggtcaggaagcgcgtcgaggcgctcagggagatccagagccaacatgatgaatttgaggcaaagttttttgaggagagagctgcacttgaagctaaatatcagaagatgtatgaaccactgtactcaaagcgtcatgatgttgtcaatggtgtggttgaggcagaaggcgtaaccaaagattcaggtgaagctgctccagatgagaaagaggaaaagggtgtgccagatttctggttgaatgcaatgaagaaccatgaaatccttgctgaggagattcaagagagggatgaggaagctctcaagtacctcaaggatatcaagtggtacagaattactgagccaaagggtttcaagcttgaattccacttcaatactaatccattcttcaagaatgaagtgctttcgaaaacgtaccacatgattgatgaagatgaaccaatcctagagaaggccattggaactgaaattgaatggtatcctggaaagagcttgacacaaaaggtgctaaagaagaagccaaagaaggggtcgaagaacactaaacctatcacgaaaatcgaaaattgcgagagcttctttaatttcttcagtccacctcaagttcctgatgacgatgaggaaattgatgaggatacagctgaacagttgcagaaccaaatggagcaagattatgatatcggatctaccatcagagacaagattattccacatgctgtttcatggttcactggagaggccgctcaagatgaggactttgacggcatcatggatgatgatgaagatgatgacgaagatgatgaggaggatgaagatgaggatgaggatgacgaggaagatgaagatgatgacgatggtgataagaagaagggtgggcgagttcctgcaggggaaggtcaggcaggggagcggcccgcggagtgcaagcaacagtgaggtccttcccagatgaagactatttttcttggctgaagaatgtttggttctgcttgatgccatgtcgttgagtttggttccgaggagccagtgggggattgattgcgttggttttgtggaagaaccggtggggggtttctttgtcggggacatggtattatatactggtagcatttcaattgttgtattgggttgaaatacttttgtccgctgctgcgagtgatcatcgatgttgcaagtttggtagtcctacttgttttgccaggaaattttgatatactaggtatttgtgtgcgctacattcattgtttcaaaatgcatatctgcattgcctggctatttctcgggtcgcagctgaaacacctcggccgcgaccacgct

SEQ ID NO: 1167 - DNA, 1502 bp, Triticum aestivum
  misc_feature (234)..(234): n is a, c, g, or t
cgcacgcgcacgaggaaggagcccgagtctccagcagccatgagcgacggcaaggacaccctcgacctctccgccctcggcgccgccgtccccaacgccgcagagctcagcgccgaggacaaggccaacctcgtggagtcgattaagaacacgctgcagggattggcggcgcggcacacggacgtgctcgagagcctggagcccaaggtcaggaagcgcgtcgaggcgctcagngagatccagagccaacatgatgaatttgaggcaaagttttttgaggagagagctgcacttgaagctaaatatcagaagatgtatgaaccactgtactcaaagcgtcatgatgttgtcaatggtgtggttgaggcagaaggcgtaaccaaagattcaggtgaagctgctccagatgagaaagaggaaaagggtgtgccagatttctggttgaatgcaatgaagaaccatgaaatccttgctgaggagattcaagagagggatgaggaagctctcaagtacctcaaggatatcaagtggtacagaattactgagccaaagggtttcaagcttgaattccacttcaatactaatccattcttcaagaatgaagtgctttcgaaaacgtaccacatgattgatgaagatgaaccaatcctagagaaggccattggaactgaaattgaatggtatcctggaaagagcttgacacaaaaggtgctaaagaagaagccaaagaaggggtcgaagaacactaaacctatcacgaaaatcgaaaattgcgagagcttctttaatttcttcagtccacctcaagttcctgatgacgatgaggaaattgatgaggatacagctgaacagttgcagaaccaaatggagcaagattatgatatcggatctaccatcagagacaagattattccacatgctgtttcatggttcactggagaggccgctcaagatgaggactttgacggcatcatggatgatgatgaagatgatgacgaagatgatgaggaggatgaagatgaggatgaggatgacgaggaagatgaagatgatgacgatggtgataagaagaagggtgggcgagttcctgcaggggaaggtcaggcaggggagcggcccgcggagtgcaagcaacagtgaggtccttcccagatgaagactatttttcttggctgaagaatgtttggttctgcttgatgccatgtcgttgagtttggttccgaggagccagtgggggattggttttgtggaaccggtggggggtttctttgtcggggacatggtattatatactggtagcatttcaattgttgtattgggttgaaatacttttgtccgctgctgcgagtgatcatcgatgttgcaagtttggtagtcctacttgttttgccaggaaattttgatatactaggtatttgtgtgcgctacattcattgtttcaaaatgcatatctgcattgcctggctatttctcgggtcgcagctgaaactaaacttgtgtcg

SEQ ID NO: 1168 - DNA, 1364 bp, Leymus cinereus x Leymus triticoides
  misc_feature (236)..(236): n is a, c, g, or t
  misc_feature (242)..(242): n is a, c, g, or t
  misc_feature (244)..(244): n is a, c, g, or t
  misc_feature (269)..(269): n is a, c, g, or t
  misc_feature (302)..(302): n is a, c, g, or t
  misc_feature (320)..(320): n is a, c, g, or t
  misc_feature (335)..(335): n is a, c, g, or t
  misc_feature (344)..(344): n is a, c, g, or t
  misc_feature (368)..(368): n is a, c, g, or t
  misc_feature (407)..(407): n is a, c, g, or t
  misc_feature (444)..(444): n is a, c, g, or t
  misc_feature (524)..(524): n is a, c, g, or t
  misc_feature (566)..(566): n is a, c, g, or t
  misc_feature (995)..(995): n is a, c, g, or t
  misc_feature (1022)..(1022): n is a, c, g, or t
  misc_feature (1070)..(1070): n is a, c, g, or t
  misc_feature (1085)..(1085): n is a, c, g, or t
  misc_feature (1097)..(1097): n is a, c, g, or t
  misc_feature (1100)..(1100): n is a, c, g, or t
  misc_feature (1196)..(1196): n is a, c, g, or t
  misc_feature (1201)..(1201): n is a, c, g, or t
  misc_feature (1210)..(1210): n is a, c, g, or t
  misc_feature (1240)..(1240): n is a, c, g, or t
  misc_feature (1243)..(1243): n is a, c, g, or t
  misc_feature (1250)..(1250): n is a, c, g, or t
  misc_feature (1260)..(1260): n is a, c, g, or t
  misc_feature (1329)..(1329): n is a, c, g, or t
aacccgaatctctagcagccatgagcgacggcaaggacaccctcgacctctccgccctcggcgccgccgtccccaacgcagcagagctcagcgccgaggacaaggccaacctcgtggagtcgattaagaacacgctacagggattggcggccaggcacacggacgtgctcgagagcctggagcccaaggtcaggaagcgcgttgaggcgctcagagagatccagagccaacatgangaattngnggcaaagttttttgaggagagagcngcacttgaagctaaatatcagaagatgtacganccactgtactcaaagcgncatgatgttgtcaanggtgtggtngaggtagaaggtgtaaccaaagangattcaggtgaagctgctgcagatcagaaagaggaaaanggtgtgccagatttctggttgaatgcaatgaagaacnatgaaatccttgctgaggagatccaagagagggatgaggaagctcttaagtacctcaaggacatcaagtggtacagaatnagtgagccaaagggtttcaagcttgagttccacttcaatacnaatccattcttcaagaatgaagtgcttacgaaaacgtatcacatgatcgatgaagatgaaccaatcctagagaaggccattggtactgagattgaatggtatcctggaaagagcttgacacaaaaggtgctaaagaagaagccaaagaaggggtcaaagaacactaaacctatcacgaaaatagaaaattgcgagagcttctttaatttcttcagtccacctcaagttcctgatgatgatgaggaaattgacgaggatacagctgagcagttgcaaaaccaaatggagcaagattatgatatcggatctaccatcagagacaagattattccacatgctgtttcatggttcactggagaggccgctcaagatgaggactttgatggcatcatggacgatgatgaagatgatgatgaagatgaggatgangatgaggatgaggacgacgaggaagangaagacgatgatgatggtgataagaagaagggcggccgagttcctgcnggggaagggcagcanggggagcggccngcngagtgcaagcaacagtgaggtgcttcacacatgaaggctatttttcttggctgaagaatgtttggttctgcttgatgctatgtcgttgagtttggntctgnggagccagngggggattgattgagttggttttgtggaancgntgggggntttctttgtnggggacatggtattatatactggtagcatttcaattgttgtattgggttgaaatactttgtccgctgcngcgagtgatcatcaatgttgccagttggtagtcca

SEQ ID NO: 1169 - DNA, 1521 bp, Triticum aestivum
ccacgcgtccgccacccctcccactccccgcacgcagcagcccgcgcccccaacccccaacccacctcacgcgccgccgccgctagggtttctcaccccgccctcccccgccgccgcccgcgcaggaggaaggagcccgaatctccggcagccatgagcgacggcaaggacaccctcgacctctccgccctcggcgccgccgtccccaacgccgcagagctcagcgccgaggacaaggccaacctcgtggagtcgattaagaacacgctgcagggattggcggcccggcacacggacgtgctcgagagcctggagcccaaggtcaggaagcgcgtcgaggcgctcagggagatccagagccaacatgatgaatttgaggcaaagttttttgaggagagagctgcacttgaagctaaatatcagaagatgtatgaaccactgtactcaaagcgtcatgatgttgtcaatggtgtggttgaggcagaaggtgaagctgctgaagaccagaaagaggaggtgggtgtgccagatttctggttgaatgcaatgaagaaccatgaaatccttgctgaggagatccaagagagggatgaggaagctctcaagtacctcaaggacatcaagtggtacagaattactgagccaaagggtttcaagcttgagtttccacttcaataccaatccattcttcaagaatgaagtgcttacgaaaacgtaccacatgatcgatgaagatgaaccaatccttgagaaggccattggtactgaaattgaatggtgccctggaaagagcttgacacaaaaggtgctaaagaagaagccaaagaaggggtcaaagaacactaaacctatcacgaagattgaaaattgcgagagcttctttaatttcttcagtccacctcaagttcctgatgatgatgaggaaattgatgaggatacagctgaacagttgcagaaccaaatggagcaagattatgatattggatctaccatcagagacaagattattccacatgctgtttcatggttcactggagaggccgctcaagatgaggactttgatggcatcatggatgatgatgaagatgacgacgaagatgacgaggaggatgaagatgatgaggaggacgacgaggaagatgaagacgatgatgatggtgataagaagaagggcgggcgagttcctgcaggggaagggcagggggagcgacccgcggagtgcaagcaacagtgaggtgcttcacacatgaagactattttccttggctgaagaatgtttggttctgcttgatgctatgtcgttgagtttggttctgtggagccagtgggggattgattgcgttggttttgtggaagaaccggtggggggtttctttgtcagggacatggtattatatactggtagcatttcaattgttgtattgggttgaaatactttgtccgctgctgcgagtgatcatcgatgttgccagtttggtagtcctacttgttttgcctggaaattttgatatactaggtatt

SEQ ID NO: 1170 - DNA, 1317 bp, Pennisetum glaucum
cggggcatatggacgtgcttgataacctcgagcccaaggtcaggaagcgcgttgagaagctcagagagatccagggccaacatgatgaacttgaggcaaagtttttttgaggagagagctgcacttgaagctaagtaccagaagttgtatgagccactttactcaaagcgttatgaaattgtcaatggtgtgattgaggttgagggtgtttcaaaagaaagtgcagctgaaacccctgcagaaaagagtggagatgaaaaccctgctgagcaaaaagaagaaaaaggtgtccctgctttctggcttaatgcaatgaagaatcatgaaatcctggctgaggagatccaggagagggatgaggaagctctcaagtacctgaaggacatcaagtggtacaggatcagcgaacccaagggttttaagctcgaattctactttgatacaaatccattcttcaagaattctgtgcttacgaaaacatatcacatgattgatgaggatgaaccaattctagagaaagccattggtactgaaattgaatggctccctggtaagtgcttgacacaaaaggttcttaaaaagaagccgcggaaggggtcaaagaacactaaacctatcacaaaaactgaagattgcgagagcttcttcaacttcttcagtccacctcaagtacctgatgatgaggaggaaattgatgaggatacagctgaacagttgcagaaccaaatggagcaagattatgatattggatctaccatcagagacaagattataccacatgctgtctcatggttcactggagaggcagctcaagatgatgattttgaaggccttatagatggtgatgaggacgatgatgaagatgatgaggatgatgaagatgatgaggatgaggaaagtgaagatgattctgataccaagaagaccaagggagctgctggaggggaaggccagcagggtgaacgacctgcggagtgcaagcagcagtgaggtgctacactacacatattgcagacaatggttctggaagtttggttctgcttgatgcaatgtcattgagttggttttgtggagcccatggggggcgtgcgttggttgtggaatttgtgggggaatttttccgggacatggtgtcatatgttggtagttttgtcacttgctgtattgggtttcagatattatgtgctctgcttatgctttgagtgatcattgttgccagtctggtatcttattgcacatacctctggcatagcgtgctgtactttcatgaagcgtgttgcggagaaattttgctctagggaaaaggctagcattttg

SEQ ID NO: 1171 - DNA, 458 bp, Zea mays
agctagaggtagcaccagcaaaccaaataagcagaccaccttctccacccggctggcctggccggccttcgtcttcctccgatccccaggccccagccactccccgtacaagccaaaaagaccagtaggtaggcaggcagttcatcgtcgatcgagcaagatgtcggactggggccccgtggtgatcgggctggtgctgttcgtgctgctctcgccggggctgctcgtccagctccccggccgccaccacttggtggagttcggcaacctgaagaccagcgccgtctccatcctcgtccactccatcatctacttcgcgctcatcaccctcttcgtcatcgtcatcggagtgcacatcaccaccggcgactagctcgatcaatcacacgttctctgtccattaatttcctgaatcggctgcctgggcttcttactttttccatctcgggcatctctgt

SEQ ID NO: 1172 - DNA, 615 bp, Zea mays
gcgagcaccagcaaaccaaataagcagaccaccttctccacccggccggccttcgtcttcctccgatccccaggccccagccactccccgtacaagccaaaaagaccagtaggtaggcaggcagttcatcgtcgatcgagcaagatgtcggactggggccccgtggtgatcgggctggtgctgttcgtgctgctctcgccggggctgctcgtccagctccccggccgccaccacttggtggagttcggcaacctgaagaccagcgccgtctccatcgtcgtccactccatcatctacttcgcgctcatcaccctcttcgtcatcgtcatcggagtgcacatcaccaccggcgactagctcgatcgatcacacgtctctgtcgattaatttcctgatcggtctgcttggcttctttctttttcatctcgtgcatctgtgttactatatatactacaccataccatacacgtctttcccacctccgacccctctctgtccttcccatcagcatatatactagaatgtcgtgcgtcagcgcgtgtatgatgctgtcgaccatggcaatcgaacttaattaatttctcagcatccatctggaatagaaagaaggaaaag

SEQ ID NO: 1173 - DNA, 767 bp, Zea mays
ctagagcgagcaccagcaaaccaaacaagcagaccaccttctccacccggccggccttcgtcttcctccgatccccaggccccagccactccccgtacaagccaaagagaccagtaggtaggcaggcagttcatcgtcgatcgagcaagatgtcggactggggccccgtggtgatcgggctggtgctgttcgtgctgctctcgccggggctgctcgtccagctccccggccgccaccacttggtggagttcggcaacctgaagaccagcgccgtctccatcgtcgtccactccatcatctacttcgcgctcatcaccctcttcgtcatcgtcatcggagtgcacatcaccaccggcgactagctcgatcgatcacacgtctctgtcgattaatttcctgatcgatcggtctgcttggcttctttctttttcatctcgtgcatctgtgttactatatatactacaccataccatacacgtctttcccacctccgacccctctctgtccttcccatcagcatatatactagaatgtcgtgcgtcagcgcgtgtatgatgctgtcgaccatggcaatcgaacttaattaatttctcagcatccatctggaatagaaagaaggaaaagaatgttgtctgtaatgtttcagttcatgcagggaagtcgtgccctggagtttaggcgtcatggggtgaactcggtcctgggatgagcattgagcattgagcagtagttagccacacactcagatattgtttgtttgtttatat

SEQ ID NO: 1174 - DNA, 696 bp, Pennisetum glaucum
gaccccacaactcaacaagccttctaactaacagtacgtctgctgacagccagcctgcaggcaatgcaagcagctgctacaagagagtgagcccctcgtcattccatcacctctgcttcgttctgcaacaacactctgctagcagctgctaatactatagctactagtagtgatcgatcgatatatatatatccttggtcgatcgagttggatcgtccaacaaaatcgaagcaggatgtctgactggggcccggtggtgatcgcagtggtgctgttcgtgctcctctcgccggggctgctgttccagctccccggccgctgcaacttcatcgacttcggcaacctgcacaccagcgccgtctccatcctcgtccactccatcatcttcttcgcgctcatcgccatcttcgtcatcgtcatcggagtgcacatcaccaccggagactagcttaattagctgctgccatagctcctgctgatcggcgacacacctccattactcctgcagatactcactgcaggtcactgctatatatatgtgtgtgtgtgtgtagctacgcaatcttatgattctgttcatttctgttactatcttcttcgttactttctttgaatttacaggcatgattcttgctgtcctcaagtgatataaatataataaacagcttcatctttgcttatttatttgcaaaaaaa

SEQ ID NO: 1175 - DNA, 706 bp, Pennisetum glaucum
gatcagctcaacctcaccttcccctccaccccacaactcaagaagccttctaactaacagtacgtctgctgacagccagcctgcaggcaatgcaagcagctgctacaagagagtgagcccctcgtcattccatcacctctgcttcgttctgcaacaacactctgctagcagctgctaatactatagctactagtagtgatcgatcgatatatatatatccttggtcgatcgagttggatcgtccaacaaaatcgaagcaggatgtctgactggggcccggtggtgatcgcagtggtgctgttcgtgctcctctcgccggggctgctgttccagctccccggccgctgcaacttcatcgacttcggcaacctgcacaccagcgccgtctccatcctcgtccactccatcatcttcttcgcgctcatcgccatcttcgtcatcgtcatcggagtgcacatcaccaccggagactagcttaattagctgctgccatagctcctgctgatcggcgacacacctccattactcctgcagatactcactgcaggtcactgctatatatgtgtgtgtgtgtgtgtagctacgcaatcttatgattctgttcatttctgttactatcttcttcgttactttctttgaatttacaggcatgattcttgctgtcctcaagtgatataaatataataaacagcttcgtctttgctta

SEQ ID NO: 1176 - DNA, 715 bp, Panicum virgatum
gagagagcgagcaccagacgaaagcaaagataagccacgcccccacatgatcatcagctcacctctctctcacctggtggcctttctccccctccaggcctccaccccacaagtcaagaacaagaagcatatagctctaactactctgacagccagccagctgcctgcaggtgatcgaacagcaaaaggggaggagccctcaacgaccatcacctggcctgctagaggcaaaggcagcaggatgtcggactggggccccgtggtgatcgcggtggtgctgttcgtgctcctctcgccggggctgctcttccagctccccggccgctgcagcttcgtcgacttcggcaacctgcacaccagcgccgcctccatcgtcgtccactccatcatcttcttcgcgctcatcaccatcttcgtcatcgtcgtcggggtgcacatcaccacaggcgaccagtctgcctactagctactggcatgctgatccaatggctcctccgatcctttcctggtcctccaatgtagccacgcagtcttacgattctgcttctgtttctcaattgttcctcctttctttctttgcatccatggctctctctgtccttcagaaatatacataataaactgcttcttttcttatttgccacaagctggtctatatgttgattgatttacatgtatgagtacatggaaaatacaagaatgtcatgtatgctcc

SEQ ID NO: 1177 - DNA, 1019 bp, Saccharum officinarum
cgccttgcatcggccgccggccctccatccatcgcaccagcagcgcattcagttcgccatggcgtgcctgctccgcgccgccgccgtcctcgcgctcctgatggccgtctccgtggccgcgctctcggcgccggtgtcggcgggcggcgtggccgtcggcgacctggctgcccatctggccggcgccgtcgtgatccggcgcggcgggcggacgtgccgcggcacggtgggcgagtgcatggagtacttcggcgcggacgccgagggcgaggccgacgtcgcgggcatggccaccggcggcagcaagcgccgggtgctgcagggcggctccggctacatcggctacgacgcgctgcgcagggacaacgtgccctgctcgcagcgcggcgcgtcctactacaactgccagcccggcgccgaggccaacccctactcccgcggctgcagcgccatcacccagtgcaggggctgatgggatgacgccttcattccatttccccagttaatgctaatcgcagcagcgttaattaaggataatcgatcggttgctgtgctagcttcatggtgattttctttttgggtctttaatttgagacgttcatggaggtcgtcgtctttgctgtgctagctagcctttgtccagctgaggcatccatgactggtccatcgattattgtggtgcagtggatatgtgtctgtgctgttgctagcatccctttcaggatgaaagtaaaagtaattatatgtgatgatcgtgtaatttccttgcgtctctgcttttacagccaatgaataatttgcagtgcctgcctttctaaaaattaagattttattctccacatatcctctgaattactttaaaacttcgatctcaatccttatattcactgtccgtatgtgctttctgttaggattttatcttttatatttccggggggggcctctctagagaaccacatttatcttcggcttcttgtgaaattatattccttttttttgtccacctaaatctattcact

SEQ ID NO: 1178 - DNA, 1108 bp, Zea mays
ctcgcgcgccccacctactgtgccgtccgtcccgccattggcacgcacgagcccacgatataacccgccacccctcgctctcccataccagtaccaccaacaaacttctttctcgccttgcatcggccgccggccctccatccaccgcaccagctagcaacgacgacacgctagccaggtagcgtagccgaccagcctccgcgcgcgggcactcagttcgccatggcgcgcctgctccgcgccgccgccggcctcgcgctcctcctggccgtccttgccccggcggcgtcggcgggcggcgacctggcccagctgggcgccgccgtcgtgacgcggcgcggcggcgggcggacgacgtgccgcggaggcacggtgggcgagtgcatggagtacctggacgtggacgcggagggcgaggccgacgtggcgggcatggccaccggcggcggcaagcgccgggtgctgcagggcggctccggctacatcggctacgacgcgctgcgcagggacaacgtgccgtgctcgcagcgcggcgcgtcctactacaactgccagcccggcgccgaggccaacccctactcgcgcggctgcagcgccatcacccagtgcaggggctgatgcctgcctgatgatttccgttccgtttcgtccccagctattagtcgggtcttcaatttaaagaagaagacatgcatggagcgatgtcgtcgtctttgctgtgcgcgctatagcctttctcgtccgcctgaggcacgcatgactcgtccgtcgattattgtgctgcagtggacatgtgtatgtgctcctgtttctagcatatccccttgctttcaggaagaaagtgaaagtaattatatatatgatgatcgtgtaataattttcgtctacgagggagaatgaccttgtcatgcagaaaagatcaattcaagtggctcagcgttcggattagtggtttagatatatactctttaagactagtcattattagttcatgccaccaactgtggttgggctgtcatttttcatcatatgtggagagtgagtcaatgtacctagctaggagcgttgttgttggcataaataaaagcagattcgtttgcttttcaga

SEQ ID NO: 1179 - DNA, 1021 bp, Zea mays
accagtaccaccaacaaacttctttctcgccttgcatcggccgccggccctccatccaccgcaccagctagcaacgacgacacgctagccaggtagcgtagccgaccagcctccgcgcgcgcgggcactcagttcgccatggcgcgcctgctccgcgccgccgccggcctcgcgctcctcctggccgtccttgccccggcggcgtcggcgggcggcgacctggcccagctgggcgccgccgtcgtgacgcggcgcggcggcgggcggacgacgtgccgcggaggcacggtgggcgagtgcatggagtacctggacgtggacgcggagggcgaggccgacgtggcgggcatggccaccggcggcggcaagcgccgggtgctgcagggcggctccggctacatcggctacgacgcgctgcgcagggacaacgtgccgtgctcgcagcgcggcgcgtcctactacaactgccagcccggcgccgaggccaacccctactcgcgcggctgcagcgccatcacccagtgcaggggctgatgcctgcctgatgatttccgttccgtttcgtccccagctattagtcgggtcttcaatttaaagaagaagacatgcatggagcgatgtcgtcgtctttgctgtgcgcgctatagcctttctcgtccgcctgaggcacgcatgactcgtccgtcgattattgtgctgcagtggacatgtgtatgtgctcctgtttctagcatatccccttgctttcaggaagaaagtgaaagtaattatatatatgatgatcgtgtaataattttcgtctacgagggagaacgaccttgtcatgcagaaaagatcaattcaagtggctcagcgttcggattagtggtttagatatatactctttaagactagtcattattagttcatgccaccaactgtggttgggctgtcatttttcatcatatgtggagagtgagtcaatgtacctagctaggagcgttgttgttggcataaataaaagcagattcgtttgcttttc

SEQ ID NO: 1180 - DNA, 969 bp, Sorghum bicolor
accaccaccaaacgcgactgtttcttgcatcggccgcgcgccggccctccacacccatcgcaccagcatccagcaacgacacgccgccgcctccgccctccgcctgcgcgcgcgcatttcagctcgattatcgccatggcgccgcgcctgcagctccgcgccgccgccgtcctcgcgctgctgatggccgtcgtctccgtggccgcgctctcggcggcgccggcgtcggcggccggagtggccgtcggcgacctggccgtggcccatctggccggcgccgtggtgatccggcgcggcgggcggacgtgccgcggcacggtgggcgagtgcatggagtacttgggcgcggacgccgagggcgaggccgacgtcgcgggcatggccaccggcggcagcaagcgccgggtgctgcagggcggctccggctacatcggctacgacgcgctgcgcagggacaacgtgccctgctcgcagcgcggcgcgtcctactacaactgccagcccggcgccgaggccaacccctactcccgcggctgcagcgccatcacccagtgcaggggctgatggctgatgctgatgttttcagtccattctcctccccagttaatgttaatcgcagctgctagcgttaaggatgatcgatcggttgctgtgtgatagcttcatggtgattttcatttttgaatcttttaatttgagaagacatgcatatatggaggtcgtcgtctttgctgtgctagcacagctttgtccggctgatcaagcggcatctccatgactggtccatcgattattgtggtgcagtggatatgtgtctgtgctgttgttgctagcatccctttcaggatgaaagtaaaagtaattatttgtgatgatcgtgtaattttctggtgtctctgattttacagccaatgaataatttgcagtgcctgcctttcattcatacatactatagcattgtttagttcc

SEQ ID NO: 1181 - DNA, 733 bp, Setaria italica
cgcctagctctccgcgcattgctcgccatggcgcgccttctccgcgccgcggcgttcctcctcctcgcggtgctggccgtggccctcgcggcgctcccggcgccggcgtcggcgggcgccggggacctggccagcgagctcctcgtggtgcggcgcggcagtagcggcgggcgcgcgtgccggggcacggtgggcgagtgcatggagtacgcggacgtggacgccgagggcgagggcgacgtggccgggatggccaccggcggcagcaagcgccgcgtgctgcagggcgggtccgggtacatcggctacgacgcgctgcgcagggacaacgtgccctgctcccagcgcggcgcctcctactacaactgccagcccggcgccgaggccaacccctactcccgcggctgcaacgccatcacccagtgcaggggctgagctagctcagcgctgcacgcgcgcgtcgtctccagttaatataaatcatgtatttgtcgcggctaattaatccgttgcggctgatggtgatgtttgtttaagagttgggggcatggctgattggttgtgcagtggatatgtgtctctcttctgttctgtgttctagcttcgcttcgccttcagggtgaaaggaaaagtgattatgatcgtgtaattctggtgtctctgaatctacagccaatgaattttcaccgtacgtctttcatgtgtttgttccaacagatttgagcaaattttc

SEQ ID NO: 1182 - DNA, 659 bp, Pennisetum glaucum
ccttgcttgcatagtctttgcaacctccttttttgggtgtgggacaagcccgagggacaccaccaaacgcgcctccacctgctcctgctccatcacatcagcagcagaagcagcaaaagcgaccagctctccgcgcattgccgctcgatctccatggcgcgcatgctccgcgccgcggcgttcctgctcctcgcggcgctggccgtggcccttgcggcgctcccggcgccggcgtcggcgggcggcgtgtcgggcgacctgctggccggccacctcgtggtgcggcgcggcagcggcggcgggcgcgcgtgccggggcacggtgggcgagtgcatggcggaggacgtggacggcgagggcgagggcgacgtggccgggatggccaccggcggcagcaagcgccgggtgctgcagggcgggtccgggtacatcggctacgacgcgctgcgcagggacaacgtgccctgctcccagcgcggcgcctcctactacaactgccagcccggcgccgaggccaacccctacacccgcggctgcagcgccatcacccagtgcaggggctgatcgatcgtctccaccagtcagtacaaatcatgtgttcgtcgcggctaattgatcggttgctgctactagcttgggtgctgtttgtttcagagttt

SEQ ID NO: 1183 - DNA, 1115 bp, Phaseolus coccineus
cgtttatgtgcatccaccaatttgagttcggtttctgcgtttagtcaccaacgatcctacaatggcgacggtcacgttttccttttccgctaaaaccctaaccctaccctatcatcccaaaaccccaatctccaacttctacccgataaccaatcttcgcttcccttcttctattgtgacccgaactcgaaatggtaaccggattcgggcgtcgctggatggggatttctcatcgaaaaggagcagcagcagcaacaacagcgaccagagagagacaataatgttacccggttgtgattacaaccactggctgattgtgatggagtttcctaaggacccagcacccactcgtgaacaaatgattgacacttacctcgacactcttgccactgtattgggaagcatggaggaagcaaagaagaacatgtatgcatttagcaccactacctacactggatttcagtgcactgttgatgaagcaacctcggagaaattcaagggtttgcccggggttctttgggtactgccagactcgtatatagatgttaaaaacaaagactacggaggtgacaagtacgtaaatggggagattattccttgcaagtaccctacctaccaacccaaacggagcgcacctaagaacgagagtagaaggtatgagagacggagagatggccctccccctgaccgcagaaggccaagacaagaggcggctgcctcggattcatcctctacatgagtcttgcaggtgattttcagtttactgagagaaactaatgccaaaagaaagctgctccttatcacggctctatcatgctcatggtcactttaacaaatagaagattgagcttgtattgggttctcatcaggatgcatccaatgtttcttgcaaactcaaacgggtattttcacgattcattttgaggaatgtgttcttttggactatatgagtatgacatgtgagacaagtgctatagttatgtatctatgtaatttggagagcttcttatcatgctaccagtttgtgttttagtaatatttttttcctacaaatttcacatcccctgcagtattaactcataaagttactgatatgaactgataaagtttagata

SEQ ID NO: 1184 - DNA, 1268 bp, Glycine max
taatatctcgtcgagggagccttatcatttatttgtcatccaattttcgctctttcggtctctccaaattgagttcagagtcaccaccgaatccgttcctacaatggcgacggtgacgttttccttttccgctaaaaccttaactctaccctatcaccccaaaacctcaatctcgagcttcgctccggtaacgaatcttcgcctctctcattctatcgtcacccgaacccgaaattgtaaccggattcgggcggcgctggatggggatttctcggcgaaaaggagcaacaacaacgagcagagggagacgataatgttgcccggctgtgactacaaccattggctgattgtgatggagtttccaaaggaccctgcacccactcgtgaacaaatgattgacacttacctcgacactcttgccactgtcttgggaagcatggaggaagctaagaagaacatgtatgcctttagcacaaccacttacactggatttcagtgcactgttgatgaagcaacctccgagaaattcaagggtttgcctggggttctttgggtactgccagactcctatattgatgttaagaacaaagactacggaggtgacaaatacataaacggggagattattccttgcaagtaccctacctaccaaccgaaacgtagcgcaccgaagaatgagagtagaaggtatgagagacggagagatggccctccccctgaccgcagaaggccgagacaagaggccgctgcctcggattcatcctctacatgagtcttgcaggtgattttcagttttgctgatagtaactaatgtcaagtgaaagctgctccttatcacagctctatcatgctcatggtcattttaacaaatagaagattgagcttgtgttggattctcatcagatgcatacaatgtttcttgcaagctcaaactggtattttcacaattcatcttgaggaatatgtgcttttggactctgagtatgacatgtgaggcaagtcttaggtttatttgtctgtgtaatttggagagctacttataatgcagccagtttgttttcgtgataatttttttctgcaagttcatggcagctacagtattaactcataaagtgactgatgaactgtacaagtttagataatatgcatatatagccttttgtcattatcttaagaagccaattaatgaatccttaagttagtcatgttacaataattcagttttgctggacttcatcctgctcactcccccatcagtgtggctggtg

SEQ ID NO: 1185 - DNA, 1093 bp, Glycine max
caattttcgctctttcggtctctccaaattgagttcagagtcaccaccgaatccgttcctacaatggcgacggtgacgttttccttttccgctaaaaccttaactctaccctatcaccccaaaacctcaatctcgagcttcgctccggtaacgaatcttcgcctctctcattctatcgtcacccgaacccgaaattgtaaccggattcgggcggcgctggatggggatttctcggcgaaaaggagcaacaacaacgagcagagggagacgataatgttgcccggctgtgactacaaccattggctgattgtgatggagtttccaaaggaccctgcacccactcgtgaacaaatgattgacacttacctcgacactcttgccactgtcttgggaagcatggaggaagctaagaagaacatgtatgcctttagcacaaccacttacactggatttcagtgcactgttgatgaagcaacctccgagaaattcaagggtttgcctggggttctttgggtactgccagactcctatattgatgttaagaacaaagactacggaggtgacaaatacataaacggggagattattccttgcaagtaccctacctaccaaccgaaacgtagcgcaccgaagaatgagagtagaaggtatgagagacggagagatggccctccccctgaccgcagaaggccgagacaagaggccgctgcctcggattcatcctctacatgaggtgattttcagttttgctgagagaaactaatgccaaaagaaagctgctccttatcacagctctatcatgctcatggtcactttaacaaatagaagattgagcttgtgttggattctcatcagatgcatgcaatgtttcttgcaaactcaaacgggtattttcacgattcatcttgaggaatatgttcttttggactctgagtatgacatgtgagacaagtcttagatttatttatctgtgtaatttggagagctacttatcatgcaaccagtttgttttagtgataatttttttctgcaagttcatggcagctacagtattaactcataaagtgactgatgaactgtacaagtttagata

SEQ ID NO: 1186 - DNA, 1173 bp, Cajanus cajan
tacggggggggatccacttcattttcttaccagaagtagctatttgattctccgtgacgacgtcgtatcagataaaatatctcttcgagccttatcgtttatttatgatccacggttacgctttctccagtttcatttgagtgtgtgcgcgctttcagtcaccaccgatcctacaatggcgacggttacgttttccttttccgctaaaaccctaaccccaccctatcacccgaaaaccccaatctcgagcttcaccccggtgacgaatttacgcctccctcattctatggtgacccgaacccgaaaccctatccggattcgggcgacgctggacggcgatttctcggcgaaaaggagcagcagcagcgagcagagggagacgataatgttacctggctgtgattacaaccattggcttattgtaatggagtttcctaaggaccctgcacccacccgtgaacaaatgattgacacttaccttgagactcttgccactgtattggggagcatggaggaagcaaagaagaacatgtatgccttcagcaccaccacctacactggatttcagtgcactgttgatgaagcaacttcagagaaattcaagggtttgcccggggttctttgggtactgccagattcgtatatagatgttaaaaacaaagactacggaggtgacaaatacataaatggggagattattccttgcaagtaccctacctaccaaccgaaacgtagcgggccaaagaatgagagtaaaaggtacgagagacggagagatggccctccccctgaccgcagaaggccaagacaagaggcagctgcttcagattcatcctctacatgagtcttgcaggtgattttcagttttgtcacaactttatatcatgctcatggtcatttaaacaaatagaagattgagcttgtgttggattctcgtcagatgcatacaatgtttctcgcaagctcaaatgggtattttcacgattcatcttgaggaatatgtgcttttggactatatgagtatgacatgtgagacaagtgctagatttattgtctgtaatttggagctattatgatgcaatcagtttgttttgtgtattaatttttctgcaagtttcatggcagctgcagttttagcacataaagtgactgatatgaactgtacaagtttag

SEQ ID NO: 1187 - DNA, 1152 bp, Vigna unguiculata
ggatctgccatccattaacttgagttcagtttctgcgtttagtcaccaacctacaatggcgacggtaacgttttccttttccgctaaaaccctaaccctaaccctaccctataaacccaaaaccccaatctccaacttctacaaggtaaccaatgttcgcctccgttcttctattgtcacccaaacccgaattggtaaccggattagggcgtcgctggatggggatttctcagcgaaaaggagcagcagcaacagcgaccagagagagacgataatgttacccggttgtgattacaaccattggctgattgtgatggagtttcctaaggaccctgcacccactcgtgaacaaatgattgacacttacctcgacactcttgctactgtattgggaagcatggaggaagcaaaaaagaacatgtatgcatttagcaccactacctacactggatttcagtgcactgttgatgaagcaacctcggagaaattcaagggtttacccggggttctctgggtactgccagactcgtatatagatgttaaaaacaaagactacggaggtgacaagtacgtaaatggggagattattccttgcaagtaccctacctaccaaccaaaacggagcgcacctaagaatgagagtagaaggtatgagagacggagagatggccctccccctgaccgaagaaggccaagacaagaggcagctgcctcggattcatcctctacatgaggttatttatagttttactgagagaaactagtgccaaaaggaagctgctccttatcacagttctatcatgctcatggtcactttaacaaatagaagattgagcttgtgttggattctcatcaagatgtatgcaacgtttcttgcaaactcaaacgggtattttcacgattcatcttgaggaatatgttcttttggactgtatgagtatgacatgtgagacaagtgctataattgtttatctgtgtaatttggagagctacttatcatgcaaccagtttatgttttagtgataatttttgtctgctagtttcatggcaactgcggtattaacacttaaagttactgatatgaactgatcaagtttagatagtatgcatatatagccttctgtccttatttgaagcaaaagaaaaaaaaaa

SEQ ID NO: 1188 - DNA, 753 bp, Glycyrrhiza uralensis
acttatttatgatggcattggcacacacttgttcgttctcagtgtctctcaagtttggtcacccacaccctccaattccaatgacgacgattaacttaactttctctgctaaaaccctaacccttcctcatcaccccaaaaccccaatcctcaacttcaaccgggtaccccctcattcaatccgggccagaacccgcacccgaaaccctatccggattcgggcggtgctggatgaggactactcgtcgaagaggagcagcagcagtgagcaaagggagacgattatgctccccggttgcgattacaaccactggctcatagtgatggagtttccaaaggaccctgcacccacccgtgagcaaatgatcgacacttacctccaaactcttgccactgtcttgggaagcatggaagaagcaaagaagaacatgtatgcctttagcaccaccacttacaccggatttcagtgcactgttgatgaagcaacttctgagaaattcaaaggtttgcctggtgttctctgggtactgccagactcatatatagatgttaaaaacaaagactacggaggtgacaagtacataaatggggagataattccttgcaagtaccctacttatcaaccaaaacgtagtggatcaaagaatgagagtagaaggtatgagagacggagagatggccctcctgccgagcgtcaaaggccaagaagacaagagacagctgcctcggattcatcctcttcatgaggcttgc

SEQ ID NO: 1189 - DNA, 1237 bp, Arachis hypogaea
tgatagagcgagtggtatcaacgcgagagttacggggccgattgaactacagaagtgtcttcaatccctgcaatggcgacggtcacgttctccctatccgctaaaaccctaaccctaccatcccaccctaaaactccaatcttcaaccaagtaaagaacgttgggttcttgaggagggtccccagtagtggcagcgtggttgggaggcggaagagcgtgattctcggggctttggatggagaatactcgtcgaagaggagtagcagcagcgaacagagagagaccattatgcttcccggttgcgactacaaccactggctcattgtcatggagttccccaaggatcctgctcccacccgcgagcagatgattgacacttaccttaataccctcgcctccgtccttggaagcatggaagaggcaaagaagaacatgtatgcctttagcaccaccacctacacaggattccagtgcactgttgacgaagcaacatctgagaaattcaaggggttgcctggtgttctttgggtgctgccagactcgtatatagatgttaaaaacaaagactatggaggtgacaaatacataaatggggagatcattccttgcaagtatcccacctatcaaccaaaacgtagtagcggaccaaagaatgagagcagaaggtatgagagaaggagagatggccctcctcctgagcgcagaaggccaagacaagaggcagctgcctcagattcagcctctacatgaggtaatttttcagtttttttgccgagtaatgccaaacgaaagcagctccttataatatgccacttcatttaaccaactagaagattaaggcattaagcttttgttggattttcatgagatatatacaattggtcttgccaggttactcagcccatctcgaggaatatgtgttcttggactatgaggtgacatgtaagatgggcgtggggtatatttgtgtaattgtttgtaatctggtattcgttatatcgacccgttttggtgctatgataagtcttttatagattcatgtcaagtgacaaataggaactgtactatttagtgtgcatatttagcttcttgacattgaatggccgatcaatgatcgttttaaattttcccgtctcggtgccttggtcacagttttgccgcagtttatcttgcgcaaagctttgttaatgcctaaagcaaaaggcagtaataactaataactctattttcctaacag

SEQ ID NO: 1190 - DNA, 1005 bp, Arachis hypogaea
gccgattgaactacagaagtgtcttcaatccctgcaatggcgacggtcacgttctccctatccgctaaaaccctaaccctaccatcccaccctaaaactccaatcttcaaccaagtaaagaacgttgggtacttgaggagggtccccagtagtggcagcgtggttgggaggcggaagagcgtgattctcggggctttggatggagaatactcgtcgaagaggagtagcagcagcgaacaaagagagaccattatgcttcccggttgcgactacaaccactggctcattgtcatggagttccccaaggatcctgctcccacccgcgagcagatgattgacacttaccttaataccctcgcctccgtccttggaagcatggaagaggcaaagaagaacatgtatgcctttagcaccaccacctacacaggattccagtgcactgttgacgaagcaacatctgagaaattcaaggggttgcctggtgttctttgggtgctgccagactcgtatatagatgttaaaaacaaagactatggaggtgacaaatacataaatggggagatcattccttgcaagtatcccacctatcaaccaaaacgtagtagcggaccaaagaatgagagcagaaggtatgagagaaggagagatggccctcctcctgagcgcagaaggccaagacaagaggcagctgcctcagattcagcctctacatgaggtaatttttcagtttttttgccgagtaatgccaaacgaaagcagctccttatcatatgccacttgatttaaccaactagaagattaaggcattaagcttttgttggattttcatgagatatatacaattggtcttgccaggttacgcagcccatctcgaggaatatgtgttcttggactatgaggtgacatgtaagatgggtgttgggtatatttgtgtaattgtttgtaatctggtattcgttatatcgacccgtttttggtgctatgacaagtcttttatagattcat

SEQ ID NO: 1191 - DNA, 1188 bp, Lotus japonicus
ttcatcatcgctcacactgcactctgtgttcggtttcgttgcagtgtttctacaatggcgacgattaccttctctttctccgccaaaaccctaaccctaccctttcactccaaaaccccttcactcttcaacttcttcaatcccagcctcaacttcaaccgggttgccccgcgttctatccgggcagttacccgtgcccggaaccctacccggattcgcgcggcgctggatgaggattactcggcgaagaggagtagtagcagtgagcagagggagacgattatgctccctggttgcgattacaatcattggctcattgtcatggagtttcctaaggaccctgctccttcacgtgagcagatgattgagacttacctctttactctctccactgttcttggaagcatggaagaagcaaagaagaacatgtatgcctttagcaccaccacctacactggatttcagtgcactgttgatgaagcaacatccgagaaattcaagggtttgcctggggttctctgggtactgccagactcttatatagatgttaaaaacaaagactatggaggtgacaagtacataaatggggagatcatcccttccaagtaccctacttaccaaccaaaacgtagtggaggatcaaggaatgacagtagaaggtacgagagaaagagagatggccctcctactgatcgtagaaggccaaaacaagaggcagagacgacgtcaaaggattcatcctctacataaggcgattttcagttttgttctgagtaatgtcaaacgaagcaatttgttgctccttacacagcattatcacggtcgcgggcatgctcatttaacacaaaagggtatatcttgattcatatcctcactagatgcatacagtttttatggcaagctcaaaggggctcaaaggggtatttcacgattcatctcgaggagtatgtgattttagatcgagtatgatgtgtaacacaggtgttacatgtatttgtctgtgtaatttggggttcacttatcgctcaatcagtgtgttttttgtgataagtatttttgcggagtttctgggcaaaattgaacataaagtaactgatagggactgcacaatttatgtttggtgcatatttagctttttgccattaagtagccagttaatgaagcacaagtcctgttgctatgatctcc

SEQ ID NO: 1192 - DNA, 1132 bp, Hordeum vulgare
cagcttgttctctcgctcgccgcttctcgcgtgaaacattggcagttggcagcacaagcatcgtgaccttcagtctgcggcccgcgaccagcctgcgccaccagctccctgccaggtgccatggccgcgccccgccccaccgtcctcgtcaccggcgccggcggccgcacaggtcaaatcgtgttcaacaagctcagggagagatccgaccagttcgcggcgaggggcctggtgaggtccgaggagagcaagcagaagatcgggggagccgacgacgtcttcgttgccgacatcagggaggcgggccacctcgcgcccgccgtccagggcgccgacgcgctcgtcatcctcaccagcgcctcccccaagatgaagcccgggttcgaccccaccaagggcggccgccccgagttctactacgaccacggagcctaccctgagcaggtggactggattgggcagaagaatcagatcgatgccgccaaagcagccggtgtgaagcacatagtgttggttggatccatgggggggacaaaccccaaccatcctctcaacagccttggcaatggcaacatattggtctggaagcgcaagtctgaacagtatctggcagacagtggagttccttatacaatcataaggcctggtggtctgcaagacaaggatgggggagtgagggagctgattgtcgggaaggatgatgagcttctccagactgacactaaggcgattcctagggctgatgtggccgaagtttgtgttcaggccctgcagtatgaagaggtgaagttcaaggcattcgatttggcctcgaaacctgaaggcgagggcaccccgaccaaagatttcaaagcgctgttctcccaggtcacagcccggttttgagtcatcagtccaggagtatacttgcatttctagcttacaaggatcttactgtatgagtgtgtaagcttttgtgtattatggaggtgctggctggtataattgcacaatcgttttatcaataatgctgaaaataaactcctgccgatgcatggagattcgagaagcaaaatctgttctattttcctgagattttcgttgcagaaaagaagtcggcaaacatttgaaagcaaaaaaaaaaaaaaaatac

SEQ ID NO: 1193 - DNA, 1108 bp, Hordeum vulgare
tctcgcgtgaaacattggcagttggcagcacaagcatcgtgaccttcagtctgcggcccgcgaccagcctgcgccaccagctccctgccaggtgccatggccgcgccccgccccaccgtcctcgtcaccggcgccggcggccgcacaggtcaaatcgtgttcaacaagctccgggagagatccgaccagttcgcggcgaggggcctggtgaggtccgaggagagcaagcagaagatcgggggagccgacgacgtcttcgtcgccgacatcagggaggcgggccacctcgcgcccgccgtccagggcgccgacgcgctcgtcatcctcaccagcgcctcccccaagatgaagcccgggttcgaccccaccaagggcggccgccccgagttctactacgaccacggagcctaccctgagcaggtggactggattgggcagaagaatcagatcgatgccgccaaagcagccggtgtgaagcacatagtgttggttggatccatgggggggacaaaccccaaccatcctctcaacagccttggcaatggcaacatattggtctggaagcgcaagtctgaacagtatctggcagacagtggagttccttatacaatcataaggcctggtggtctgcaagacaaggatgggggagtgagggagctgattgtcgggaaggatgatgagcttctccagactgacactaaggcgattcctagggctgatgtggccgaagtttgtgttcaggccctgcagtatgaagaggtgaagttcaaggcattcgatttggcttcgaaacctgaaggcgagggcaccccgactaaagatttcaaagcgctgttctcccaggtcacagcccggttttgagtcatcagtccaggagtatacttgcatttctagcttacaaggatcttactgtatgagtgtgtaagcttttgtgtattatggaggtgctggctggtataattgcacaatcgttttatcaataatgctgaaaataaactcctgccgatgcatggagattcgagaagcaaaatctgttctattttcctgagattttcgttgcagaaaagaagtcggcaaacatttgaaagcaaaaaaaaaaaaaaaatac

SEQ ID NO: 1194 - DNA, 1030 bp, Triticum aestivum
atccttcgctgctactctcgtgagacattggcacttggctacgctccgcagttcgcgaccagctagcccgccaccagcctccggccatggccgcgccccgccccaccgtcctcgtcaccggcgccggcggccgcacaggacaaatcgtgttcaacaagctcagggagagatccgaccagttcgcggcgaggggcctggtgaggtcggaggagagcaagcacaagatagggggagccgacgacgtctacgtcgccgacatcagggaggcggaccacctcgcgcccgccgtccagggcgccgacgcgctcattatcctcaccagcgcctcccccaagatgaagcctgggttcgaccccaccaagggcggccggcccgagttctactacgaggacggagcctaccctgagcaggtggattggattggccaaaagaatcagattgatgctgccaaagcagccggtgtgaagcacatagtgttggtgggatccatgggggggacgaatcccaaccacccactcaacaaccttggcaatggcaacatactggtctggaagcgcaagtctgaacagtatctggcagacagtggagttccttatacaatcataaggcctggtggtctgcaagacaaagatcggggagtgagggagctgattgttgggaaggatgatgagcttctccagactgacactaaggcaatccctagggctgatgtggctgaagtttgtgttcaggccctccagtatgaagaggtgaagttcaaggcattcgatttggcttcgaagcctgaaggcgagggcaccccaacgaaagatttcaaagcgctgttctccaaggtcacagcccggttttgagtcatcagttaagacttgagagcataagtacatttctagcttataaggatcttaatgtcttgggtgtgtatccttgtgcattatgaagttgctgactgatgtaattgcacaatcggtttatcaataatgctgaaaatagccttctatcgatgcttggagattggagaagcaatttatgc

SEQ ID NO: 1195 - DNA, 1026 bp, Triticum aestivum
atccttcgctgctactctcgtgagacattggcacttggctacgctccgcagttcgcgaccagctagcccgccaccagcctccggccatggccgcgccccgccccaccgtcctcgtcaccggcgccggcggccgcacaggacaaatcgtgttcaacaagctcagggagagatccgaccagttcgcggcgaggggcctggtgaggtcggaggagagcaagcacaagatagggggagccgacgacgtctacgtcgccgacatcagggaggcggaccacctcgcgcccgccgtccagggcgccgacgcgctcattatcctcaccagcgcctcccccaagatgaagcctgggttcgaccccaccaagggcggccggcccgagttctactacgaggacggagcctaccctgagcaggtggattggattggccaaaagaatcagattgatgctgccaaagcagccggtgtgaagcacatagtgttggtgggatccatgggggggacgaatcccaaccacccactcaacaaccttggcaatggcaacatactggtctggaagcgcaagtctgaacagtatctggcagacagtggagttccttatacaatcataaggcctggtggtctgcaagacaaagatcggggagtgagggagctgattgttgggaaggatgatgagcttctccagactgacactaaggcaatccctagggctgatgtggctgaagtttgtgttcaggccctccagtatgaagaggtgaagttcaaggcattcgatttggcttcgaagcctgaaggcgagggcaccccaacgaaagatttcaaagcgctgttctccaaggtcacagcccggttttgagtcatcagttaagacttgagagcataagtacatttctagcttataaggatcttaatgtcttgggtgtgtatccttgtgcattatgaagttgctgactgatgtaattgcacaatcggtttatcaataatgctgaaaatagccttctatcgatgcttggagattggagaagcaattt

SEQ ID NO: 1196 - DNA, 1016 bp, Avena sativa
ctgtcatctcacccttctctgcttctcgctgtgtctcccgtcggcgacaaaaccaccaccagctcacgggccatggcggactcggctgcgccccgcccaaccgtcctcgtcaccggcgccggcggccgcacaggccaactcgtcttcaacaagctcaaggagagatccgaccagttcgccgcgaggggcctggtgaggacggaggagagcaagcagaagatcgggggagccgacgacgtctacgtcgccgacataagggaggcggaccacctcgcgcccgccgttcagggcgtcgacgccctcgtcatcctcaccagcgcttccccgaagatgaagccggggttcgaccctaccaaaggcggccggcccgagttctactacgaggacggagcgtaccctgaacaggtggattggattgggcaaaagaatcagatcgatgccgccaaagcagctggtgtgaagcacatagtgttggtaggatccatgggaggaacaaatcctaaccatccgctgaacagccttggcaatggcaatatattggtctggaaacgcaagtccgaacagtatctggcagacagtggagttccttatacaataataaggcctggtggtctgcaagacaaagatgggggagtgcgggagctaattgttgggaaggacgacgagcttctccagactgacactaaggcaattcctagggctgatgtggctgaagtttgtgttcaggccctacagtatgaagaggtaaagttcaaggcattcgatttggcttcaaaacctgaaggtgtggggacgccgacaaaagatttcaaggcgctgttctcccaggtcacagctcggttctgagtcatcgacccagtagcatactcgcatttctagtttttcaacccctatgaggatctggatgtctaagcggataggtttgtgcgtgatgaagcttctgtctgatgtaattgcacaatcgttgtatcaataaagctgaaaagaacttcctgcaacgagaagcaaagcttttg

SEQ ID NO: 1197 - DNA, 1016 bp, Avena sativa
ctgtcatctcacccttctctgcttctcgctgtgtctcccgtcggcgaccaaaccgccaccagctctcgggccatggcagactcggctgcgccccgcccaaccgtcctcgtcaccggcgccggcggacgcacaggccaactcgtcttcaacaagctcaaggagagatccgaccagttcgccgcgaggggcctggtgaggacggaggagagcaagcagaagatcgggggcgccgacgacgtctacgtcgccgacataagagaagcggaccacctcgcgcccgccgtccagggcgtcgacgcgctcgtcatcctcaccagcgcttccccgaagatgaagccggggttcgaccctaccaaaggcggccggcccgagttctactacgaggacggagcgtaccctgaacaggtggattggattgggcaaaagaatcagatcgatgccgccaaagcagctggtgtgaagcacatagtgttggtaggatccatgggaggaacaaatcctaaccatccgctgaacagccttggcaatggcaatatattggtctggaaacgcaagtccgaacagtatctggcagacagtggagttccttatacaataataaggcctggtggtctgcaagacaaagatgggggagtgcgggagctaattgttgggaaggacgacgagcttctccagactgacactaaggcaattcctagggctgatgtggctgaagtttgtgttcaggccctacagtatgaagaggtaaagttcaaggcattcgatttggcttcaaaacctgaaggtgtggggacgccgacaaaagatttcaaagcgctgttctcccaggtcacagctcggttctgagtcatcgacccagtagcatactcgcatttctagtttttcaacccctatgaggatctggatgtctaagcggataggtttgtgcgtgatgaagcttctgtctgatgtaattgcacaatcgttgtatcaataaagctgaaaagaacttcctgcaacgagaagcaaagcttttg

SEQ ID NO: 1198 - DNA, 950 bp, Festuca arundinacea
  misc_feature (368)..(368): n is a, c, g, or t
  misc_feature (370)..(370): n is a, c, g, or t
  misc_feature (512)..(512): n is a, c, g, or t
ggcacgaggcccgcgccatggcggactcggctgcgccccgccccaccgtcctcgtcaccggagccggcggccgcacaggccatctcgtcttcagcaagctcaaggagagatccgaccagttctccgcgaggggcctggtgaggacggaggagagcaagcagaagatcgggggagccgacgacgtctacgtcgccgacatcagggaagcggaccacctcgcgcccgccgtccagggcgtcgacgcgctcgtcatcctcaccagcgcctccccgaagatgaagccggggttcgaccctaccaaaggcggccggcccgagttctactacgaggacggagcgtaccctgaacaggtggattggattgggcanangaatcagattgatgccgccaaagcagctggtgtgaagcacattgtgttggtgggatccatgggaggaacgaatcctaaccatccactcaacagccttggcaatggcaatatattgatctggaagcgcaagtccgaacagtanctggcagacagtggagtcccttatacaataataaggcctggtggtctgcaagacaaagatgggggagtgagggagcttattgttgggaaagacgatgagcttctccagaccgacactaaggcaattcctagggctgatgtggctgaagtttgtgttcaggccctgcagtacgaagaggtgaagttcaaggcatttgatttggcttcaaagcctgaaggtgtgggcacaccgacaaaagatttcaaggcgctgttttcccaggtcacagctcggttttgagtcaccagacaagtagcgtactcacatttctagcttttcgactcatatgagaggatcttgatgtctaagcggataggtttgtgcgttatgaagtatagaccagtgtaattgtacaatcgttttatcaataaagctgaaaagaacttcctgcaacgagaa

SEQ ID NO: 1199 - DNA, 1189 bp, Brachypodium distachyon
accacggccttccttcttctagacagttcttggggcatcctgctactcccttctagcgtcattcccatccttcccttctcccccgtgaaaccttggcaccaccgagggaattcggcgattcgcgaccaatctgcactacaccaccagctctccgcgccatggcggacccggccgctcctcgctccaccgtcctcgtcactggcgccggcggccgtacaggccaaatcgtcttcaacaagctcaaggagagatccgaccagttcgtcgcgagggggctagtgaggacagaggagagtaagcagaagataggaggagcagatgacgtttatgttgctgatatcagggaggcagatagcgtcgtgcccgctgttcaaggtgtcgacgctctcgtgatcctcaccagtgccaccccgaagatgaaaccaggattcgaccccagcaaaggcggtaggcctgagttctactatgaagatggggcgtatccggaacaggtggattggattggacaaaagaaccagattgatgcagccaaagcagctggtgtgaagcacatagtgttagtgggatctatgggaggaacaaatcctaaccatccacttaacagccttggcaatggcaatatattggtctggaagcgcaagtctgaacagtatctggcagacagtggagttccttatacaatagtaaggcctggtggtttgcaagataaagatgggggcgtgagggagctgattgttgggaaggatgatgagcttctccagactgacaccaaggcaattcctagggctgatgtggctgaagtttgtgttcaggccctgcagtatgaagagacaaagttcaaggcgtttgatttggcctcaaagcctgaaggtgtgggcacgccaacgaaagatttcaaggcgctgttctcccaggtcacctctcggttttgagttatctatcatatcaaggagcatactcgcatttccacatttttttaggctcgtcttggatatggatgtctagctgggtagctttgtgcatgatgatgatgatgatgcagtgtggtgtacttacacaatcgttgtatcaaacttgctagaaaaatgtcaccaaacagttcaaaaacacattgccacagctttataggacggtgcaaatcgttgtatcaaacttgctagaaaaatgtcaccaaacagttcaaaaacac

SEQ ID NO: 1200 - DNA, 1012 bp, Cynodon dactylon
cttcagacggctcgcaacccaccggcctccgcccgcggctatctgacggcgcccgagaggtgaatccagcacgagccgtcgcgagcacctaccgtgagagggcatggcggatacggccgcgccgcgccccaccgtcctcgtcaccggcgccgggggccgtacaggccaaattgtgtacaacaagctgaaagagcgatccgagcaatttgtcgcaagaggtctagtgagatcagaggaaagcaagcagaaaattgggggagcggatgatgtttacattgccgatataagggacgcaggtcgtctagcacctgctgttcagggcgctgatgcgttgataatcctcaccagtgctgttccgaagatgaaaccgggtttcgaccccagcaaaggaggcaggcctgagttttactatgaagatggaatgtaccctgagcaggtggattggattggccaaaagaatcagattgatgctgccaaagctgccggagtgaagcatatagtgctggtgggatccatgggaggaacaaatcctaaccatccactgaacagccttggtaatggcaatatactggtatggaagcgcaaggcagaacaatatttggcagatagtggtgtcccctatacaataataaggcctggaggtctacaagacaaagatgggggattaagagagttgattgttggaaaagatgatgaacttctgcagactgaaacaaaggcaatcccaagagctgatgtggctgaagtttgtgttcaggctctacagtatgaagaggcaaaattcaaagcatttgatttggcttcgaagcctgaaggtgtgggcacaccaacgaaagattttaaggcactgttttcccagattaccactcggttttaagcaagcccaatttcatgatgttaaacccggatctataatgactagatagttgcctgtatcgctgtaaaaaaaaaaaaaaaagaagatggtcgcttgtgtatgatggagctattgttctgtgtagtgcaataacta

SEQ ID NO: 1201 - DNA, 1144 bp, Pennisetum glaucum
ccaccggcccctgcggttatcgacacagcaccgaactgcacgaatcgagtcgccgcgagcggaggtcatggcggaatcggccgcgccccgtccaaccgtcctcgtcaccggcgccggtggccgcacaggccatattgtgtacaccaagctgaaagagagatccgagcaatttatcgcaaggggcctagtgaggacagaggagagcaaacagaaaattgggggagcagatgacgtttacattgctgatataagggatgcagatcatatagcgcctgctgttcagggtgctgatgctctcgtaatcctcacaagtgccgtcccgaagatgaaaccgggtttcgaccctagcaaaggcgggagacctgagttctactatgaagatggaatgtaccctgagcaggtggattggattggccaaaagaatcagattgatgctgccaaagctgctggagttaagcatatagtgttggtgggatccatggggggcacaaatcctaaccatccattgaacagccttggtaatggcaacatactggtatggaagcgcaaggcagaacagtatttggcggacagtggagtcccttatacaattataaggcctggaggtttgcaagacaaagatggaggagtgagggagttagttgttggcaaagatgatgaacttctccagactgacacaaagtccattcctagagctgatgtggctgaagtttgtgttcaggctctgcagtatgaagaggcaaagctcaaggcatttgatttggcttcaaagcctgaaggtgtgggcacaccaacgaaggacttccgggcactgttctcccagattactgcaaggttttgactgacccgctgagaagcctaaagccccacaagcaattctaggtttccatgctgttgcattccatcacttgtggacttgtactagatatataaagctaagtaacttgtgtgcgagggagctgtaatttgggtgacattgtcaaaacggctgaaaggaatcgatgccttattctaagatatgctgttgtagttagagggctctttctagttgccattgcctctgtgtatgctgtattataccaatcatccaacttaatcaggcgtggcagttttcataaatgccacagaacaatttattcaggca

SEQ ID NO: 1202 - DNA, 1168 bp, Setaria italica
ggccactgcggttatcgacagcaccaggtcctccacgaatcgagtcgccgcgagcagaggtcatggcggattcggccgcgccccgtccaaccgtcctcgtcaccggcgccggcggccgcacaggccatattgtgtacaacaagctgaaagagagatccgagcaatttatcgcgaggggcctagtgaggacagaggagagcaaacagaaaattgggggagcagatgatgtttacattgctgatataagggatgcagatcatctagtgcctgctgttcagggtgctgatgctctcataatcctcacaagtgccgtcccgaagatgaaaccgggtttcgaccctagcaaaggtgggagacctgagttctactatgaagatggaatgtaccctgagcaggtggattggattggccaaaagaatcagattgatgctgccaaagctgctggagttaagcatatagtgttggtgggatccatgggaggaacaaatcctaaccatccattgaacagtcttggtaatggcaacatactggtatggaagcgcaaggctgaacagtatttggcagacagtggggtcccttatacaattataaggcctggaggtttgcaagataaagatggaggagtgagggagttagttgtcggaaaagatgatgaacttctccagactgacacaaagtctattcctagagctgatgtggctgaagtttgtgttcaggctctgcagtatgaagaggcaaagttcaaggcgtttgatttggcttcaaagcctgaaggtgtgggcacaccaacgaaggactttcgggcgctgttctcccagatcatggctcggttttgaccgatccgctaagaatcctaaggtctacacaccgttggtttccatggtgttgcattccattgcttgtggacttgtactagatatataaaactaagtagcttgtgtaatggggagctgtaatttggtgtgaatccaagtgtgattgcaaaatcgcattgtcaaactactgaaaggaatcggtgccttattgtaagatcctttttctttcgataaagtaatccgtgccttattctaagatgcgctggtgtggttaaagggctctttctagttgccattgccactgtgtacgctgttaacaccaaccagccaacttattcaggcgtggcagtttg

SEQ ID NO: 1203 - DNA, 1569 bp, Saccharum officinarum
gagtccagcacgaatcgaatcgtcgcgagaagtcatggcggattcggccgcttcccgtccaaccgtcctcgtcaccggcgccgggggccgcacaggccaaattgtctacaacaaactgaaagagaggtccgagaagttcgtggcaagagggctagtcaggacagaggagagcaagcagaagattgggggagccagtgatgtttacattgcggatataagagacgcagatcgtctagctcctgctgtacaaggggtcgatgcgctcataatcctcaccagtgcagtcccaaaaatgaaaccgggtttcgaccctagcaaaggtgggcggcctgagttctactatgaagatggaatgtaccctgagcaggtggattggattggccaaaagaatcagattgatgctgctaaagctgctggagtgaagcatattgtgttggtgggatctatgggaggaacaaatcctaaccatccgctgaacagcctgggtaatggcaatatactggtatggaagcgcaaggcagaacagtatttggcagacagtggagtcccttatacaatcataaggccaggaggtctacaagacaaggatggaggagtgagagagttaattgtggggaaagacgatgaacttctccagactgacacaaagtcgattcctagagccgatgtggctgaggtttgtgtccaggctctgcagtatgaagaggccaagttcaaggcatttgatttggcctcaaagcctgaaggtgtgggcacgccaacaaaggacttccgggcactgttttctcaggtcactgctcggttttgagtgagctgctgagaagcctactccaagttctagatttcatggtgcctggagatataaccagggagcttgagcatggagctgcagtttggtgcaattgcaaagctgtattaaaactgaagaaagaaatcggtgcattgtttgcagtacactgctgaatgtctagttgccgttgtgtaaactgttaagagccaatatgacaagtaattaggaacccctgtttgcataaattgttgggcacaatttattcaattcaaattagattatttcttgatattattcattttaactatttaaaaattagttatattacttattctatattttgattttctttgacttctggctgttatctttagtattgtaagtatccattgcatgttattgttgatactcctcactctctttgactgaggatggatcttatggagatatcctctcttcctactatgtttattatatatatattattgcttttatccttcttatatcaattctatatcttatttgtacttttcataatctactgtaattgatttatactttatctgttaatacttagtatctttatataagttaatctatattttggttatttatattgatcctttatatgaattcgatataatactgttattatatcgtatgcatatacttgtatccataatatttaatatgctctgtaattaaatggcaatatcttttatgtttttctttatacgtacgtattttcatatctactatttattgtttgtgatgtttat

SEQ ID NO: 1204 - DNA, 1089 bp, Panicum virgatum
caaacgagaggggaatcctgcacgaaccgagtcgccgcgagcacgaggtcatggcggattcgaccgcaccccgtccaaccgttctcgtcaccggcgccggcggccgaacaggccatattgtgtacaacaagctgaaagagagatccgagcaattcgtagcaagaggtctggtgaggacagaggagagcaaacagaaaattgggggagcagatgatgtttacatcgctgatataagggatgcagatcgtctagcgcctgctgttcagggtgctgatgctctcataattctcacaagtgccgtccccaagatgaaaccgggtttcgaccctagcaaaggcgggagacctgaattctactacgaagatggaatgtaccctgagcaggtggattggattggccaaaagaatcagattgatgctgccaaagctgctggggtgaagcatatagtgttggtgggatccatgggaggaacaaatcctaaccatccactgaacagtcttggaaatggcaacatactagtatggaagcgcaaggcagaacagtatttggcagacagtggagttctgtatacaataataaggcctggaggtttgcaagacaaagatgggggggtgagggagttaattgttgggaaggatgatgaacttctccagactgacacaaagtcaattcctagagctgatgtggctgaagtttgtgtacaggctctgcagtatgaagaggcaaagttcaaggcatttgatttggcatcaaagcctgaaggtgtgggcacaccaacaaaggatttcagggcgctgttcgcccagattactgctcggttttgagctatcacctaagaaacctacggcatgcccacattctaggtttccatggtgttccattccattgcttgtggacttgtactgcatatataaaactagtagcttgtgaatgatggagctttagtttagtgtgattgttacaaatcgcaatatcagaactgctgaaagaaaccagtgtgtttggggctgaagacctgaagttaaagaacactttctggttgaaactttgagcactgttaaataccaatcagccaacttacctgggcac

SEQ ID NO: 1205 - DNA, 1170 bp, Sorghum bicolor
acgaccttctagacgtttctcaaacccacctccgtggtccgggctgccgccgaggctatctacggcacagaccgagacgggttgggcgtccagcacgaatcgaatcgtcgcgagaagtcatggcggattcggccgcttcccgtccaaccgtcctcgtcaccggcgccggcggccgcacaggccaaattgtctacaacaaactgaaagagaggtccgagcagttcgtggcaagagggctggtcaggacagaggagagcaagcagaagattgggggagccagtgatgtttacattgcggacataagagacacggatcgtctagcacctgctgtacaaggggtcgatgcgctcataatcctcaccagtgcagtcccaaaaatgaaaccgggtttcgaccctagcaaaggtgggcggcctgagttctactatgaagatggaatgtaccctgagcaggtggattgggttggccaaaagaatcagattgatgctgctaaagctgctggagtgaagcatattgtgttggtgggatctatgggaggaacaaatcctaaccatccgctgaacagcctgggtaatggcaatatactggtatggaagcgcaaggcagaacagtatttggcagacagtggagtcccttatacaatcataaggccaggaggtctacaagacaaggatggaggagtgagagagttaattgtggggaaagacgatgaacttctccagactgacacaaagtcgattcctagagccgatgtggctgaggtttgtgtacaggctctgcagtatgaagaggccaagttcaaggcatttgatttggcctcgaagcctgaaggtgtgggcacgccaacaaaggactttcgggcactgttctcccagattactgctcggttttgagtgagctgctgagaagcctactccaagttctagattgcatggtgtctgaagatataatcaggtagcttgagcatggagctgcagtttggtgcaattgcaaagctgtattaaaactgaagaaagaaattggtgcattgtttgcagtgcactgctgaacgtctggttgccattgtgtaaactgttaagagctaatatgacaagtaattaggaacccctgtttgcataaattgttgggcacaatttatccagcacagttagtcacctgcttggattcttc

SEQ ID NO: 1206 - DNA, 1043 bp, Cenchrus ciliaris
  misc_feature (229)..(229): n is a, c, g, or t
  misc_feature (260)..(260): n is a, c, g, or t
gagatcctgcacgaatcgagtcgccgcgagtaggccgcgagcggaggtcatggcggattcggccgcgccccgtccaaccgtcctcgtcaccggcgccggcggccgcacaggccatattgtgtacaacaagctgaaagagagatgtgaccaatttatcgcaaggggcctagtgaggacagaggagagcaaacagaaaattgggggagcagatgatgtttacattgctganataagggatgcagatcatatagtgcctgctnttcagggtgctgatgctctcataatcctcacaagtgccgtcccgaagatgaaaccaggtttcgaccctagcaaaggtgggagacctgagttctactatgaagatggaatgtaccctgagcaggtggattggattggccaaaagaatcagattgatgctgccaaagctgccggagttaagcatatagtgttggtgggatccatgggaggaacaaatcctaaccatccattgaaccaacttggtaatggcaacatactggtatggaagcgcaaggcagaacagtatttggcggacagtggagtcccttatacaattataaggcctggaggtctgcaagacaaagatggaggagtgagggagttagttgttggaaaagatgatgaacttctccagactgacacaaagtctattcctagagctgatgtggctgaagtttgtgttcaggctctgcagtatgaagaggcaaagctcaaggcatttgatttggcttcaaagcctgaaggtgtgggcacaccaacgaaggactttcgagcgctgttctcccagattactgctcggttttgaccggtccacaagaagcctaaaggcctccaaacaattctaggtttccatggtattgcatttcattgcttgtggacttctactagatatataaagctaagcagcttgtgtgtgagggagctgtaatttggtgtggcattgtcgaaactgctgaaaggaatcagtgccttattccaagatacgctgttgtaattagagggctctttctactccctccattcca

SEQ ID NO: 1207 - DNA, 849 bp, Pseudoroegneria spicata
  misc_feature (30)..(32): n is a, c, g, or t
  misc_feature (416)..(416): n is a, c, g, or t
  misc_feature (461)..(461): n is a, c, g, or t
  misc_feature (621)..(621): n is a, c, g, or t
gctcaaggagagatccgaccagttcgcggnnnggggcctggtgaggtccgaggagagcaagcagaagatcgggggagccgacgacgtctacgtcgccgacatcagggaggcggagcacctcgcgcccgccgtccagggcgccgacgcgctcgtcatcctcaccagcgcctcccccaagatgaagccggggttcgaccccaccaagggcggccggcccgagttctactacgaggacggagcgtaccctgaacaggtggactggattggccaaaagaatcagattgacgctgccaaagcagctggtgtgaagcacatagtgttggtgggatccatggggggaacaaatcccaaccatccactgaacagcctcggcaatggcaatatattggtctggaagcgcaagtccgaacagtatntggcagacagtggagtcccttatacaatcataaggcctggtggtntgcaagacaaagatgggggagtgagggagctgattgttgggaaggacgatgagcttcttcagactgacactaaggcaattcctagggctgatgtggctgaagtttgtgttcaggccctgcagtatgaagaagtaaagttcaaggcattcgatctcacttngaagcctgaaggcgagggcatcccgacgaaagatttcaaagcgctgttctcccaggtcacagcccggttttgagccatcagtccaggagcatgctggcatttttagcttataaggatcttaatgtttgagtgggtagccttgtgcatcatgaagttgctgactgtatatgaagtttttgacggtgtaattgcacaatccgtttatgaataatgctgaaaattgaaaat

SEQ ID NO: 1208 - DNA, 1114 bp, Oryza sativa
ccgcgcgcactcttggcatgcgcgagcgcgacccctccccctcgaaccgccgcgaccttctcgatgcttcccaaatcctcctcctcgtgaactcgtcgccttcgtcttcgtctcgatctccatggcggactcgagcgcggcccgccccaccgtcctcgtcaccggcgccggcggccgcacaggaaacattgtctacaacaagctcaaggaaaggtctgaccagtttgttgtgagaggtttagtgagaacagaggaaagcaaacaaaagattggtggaggcaatgatgtttacattgccgacataagggacagagatcatcttgtgcctgctgttcaaggtgtcgatgcgctcataatcctcacgagtgctgtgccaaagatgaaacctggttttgaccctagcaaaggtgggaggcctgagttttactatgaagatggaatgtatcctgagcaggtggattggattggccaaaagaatcagattgacactgccaaagctgctggagtgaagcatatcgtgcttgtgggatccatgggaggaacaaatcctaaccatccactgaacagcctaggcaatggcaatatactggtttggaagcgcaagtcagaacagtatttggcagacagtggagtcccttatacaataataaggcctggtggtctgcaagacaaagacgggggagtgagggagttgattgttggcaatgacgatgaacttctccagacagacacgaagtcaattccaagagctgatgttgctgaagtttgtgttcaggccctgcagtatgaagagacaaagttcaaggcatttgatttggcttcaaagcctgaaggcacaggcacaccaacaaaagacttcaaatcgttgttctcccaggttacagcccgattttgagccatcttgaggagcaatctcatctcggtttccttgtgtattggatatttggatgtatatcttcgtggttagtgaggtgtgaagttgtagtttgctgtaattcgtcatcgtttcctgaaaactcctattgaaatcagtgaattgttcagacaagacacaaattgatattattcaaggacatgatgtctttttaaaatgaaatccttgcgctgttataaa

SEQ ID NO: 1209 - DNA, 1152 bp, Triticum aestivum
gtctcatccttcgccgcttctctcgtgacacatcggcacttggctgcgtccaggcgctctgcagttcgcggccagctagcctgcagtaccgcgccaccaccctccggccatggccgcgccccgccccaccgtcctcgtcaccggcgccggcggccgcacagataccctttccctccttccttccccgcccgtttctccgaccaaaacccgacgaatccgcctgccacgacgggcaattccggtcctaacgctcgtcgagtcgatcgcaggccaaatcgtgttcagcaagctcagggagagatccgaccagttcgcggcgaggggcctggtgaggtcggaggagagcaagcagaagatcgggggagccgacgacgtctacgtggccgacatcagggaggcggagcacctcgcgcccgccgtgcagggcgccgacgcgctcgtcatcctcaccagcgcctcccccaagatgaagccggggttcgaccccaccaagggcggccggcccgagttctactacgaggacggagcctaccctgagcaggtggactggattgggcagaagaatcagattgatgctgccaaagcagctggtgtgaagcacatagtcttggtgggatccatggggggaacaaatcccaaccatccattgaacagccttggcaatggcaatatactggtctggaagcgcaagtctgaacagtatctggcagacagtggagttccttatacaatcataaggcctggtggtctgcaagacaaagatgggggagtgagggagctgattgtcgggaaggatgatgagcttctccagactgacactaaggcaattcctagggctgatgtggctgaagtttgtgttcaggccctgcagtatgaagaggtgaagttcaaggcattcgatttggcttcgaagcctgaaggtgagggcaccccgacgaaagatttcaaagcgctgttctcccaggtcacagcccggttttgaggcatcagttaaaggagcataagtgcatttctaagcttataaggatcttaatgtctttgagtgtgtatccttgtgcattatgaagttgctgactgatgtaattgcacaatcggtttatcaataatgctgaaaatagcctcctatggatgcatggagattggagaagcaat

SEQ ID NO: 1210 - DNA, 1193 bp, Zea mays
gcgcctcttcttggcttttttgcggcctgtcggatcggcacgaccttctagatgattctcaaacccacttccgggctgccgccgaggttatctacaacaccgagcagcgagaaggggttggtgtccagcacgaattgaatcgtcgccagaagtcatggcggattcggccacttcccgtccaaccgttctcgtcaccggcgccggcggccgcacaggccaaattgtctacaacaaactgaaagagaggtctgagcagttcgtggcaagagggctagtcaggacagaggagagcaagcagaagattggggcagccggtgatgtttacgttgctgacataagagacgcggatcgtctagcacctgctgtacaaggtgtggatgcgctcataatcctcaccagtgctgccccgaaaatgaaaccgggtttcgaccctagcaaaggtggacggcccgagttctactacgaagacggaatgtaccctgaacaggtggattgggttggccaaaagaatcagatcgatgctgctaaagctgctggagtgaagcatattgtgctggtgggatctatgggaggaacaaatcctaaccatccgctgaacagcatgggtaatggcaatatactggtatggaagcgcaaagcagaacagtatttggcagacagtggaatcccttatacaatcataaggccaggaggtctacaagacaaggacggaggagtgagagagctacttgtggggaaagacgatgaacttctccagactgacacaaagtcgattcctagagccgatgtggctgaggtttgtgtccaggctctgcagtacgaagaggccaagttcaaggcatttgatttggcctcaaagcctgaaggtgtgggcacgccaacaaaggactttagggcactgttctcccagatcactgctcggttttgagcgagctgctgagaagcctactcgagttctagattttatggtgtcacaatccattttatcgtgggcttgtcctggagatacaaccaggtagcttgttggagctgcggtttggtgcaattgcaaccaggtagcttgtatcaatccattttatggtgcattgtttgcttgtacactgctgaatgtcgtctggttgccaattgtgtgaactgttgacagccattaaaacaagttatttggaaccctgtttgcataaattgttgggaac

SEQ ID NO: 1211 - DNA, 1182 bp, Zea mays
acgaccttctagatgattctcaaacccacttccgggctgccgccgaggttatctacaacaccgagcagcgagaaggggttggtgtccagcacgaattgaatcgtcgccagaagtcatggcggattcggccacttcccgtccaaccgttctcgtcaccggcgccggcggccgcacaggccaaattgtctacaacaaactgaaagagaggtctgagcagttcgtggcaagagggctagtcaggacagaggagagcaagcagaagattggggcagccggtgatgtttacgttgctgacataagagacgcggatcgtctagcacctgctgtacaaggtgtggatgcgctcataatcctcaccagtgctgccccgaaaatgaaaccgggtttcgaccctagcaaaggtggacggcccgagttctactacgaagacggaatgtaccctgaacaggtggattgggttggccaaaagaatcagatcgatgctgctaaagctgctggagtgaagcatattgtgctggtgggatctatgggaggaacaaatcctaaccatccgctgaacagcatgggtaatggcaatatactggtatggaagcgcaaagcagaacagtatttggcagacagtggaatcccttatacaatcataaggccaggaggtctacaagacaaggacggaggagtgagagagctacttgtggggaaagacgatgaacttctccagactgacacaaagtcgattcctagagccgatgtggctgaggtttgtgtccaggctctgcagtacgaagaggccaagttcaaggcatttgatttggcctcaaagcctgaaggtgtgggcacgccaacaaaggactttagggcactgttctcccagatcactgctcggttttgagcgagctgctgagaagcctactcgagttctagattttatggtgtcacaatccattttatcgtgggcttgtcctggagatacaaccaggtagcttgttggagctgcggtttggtgcaattgcaaccaggtagcttgtatcaatccattttatggtgcattgtttgcttgtacactgctgaatgtcgtctggttgccaattgtgtgaactgttgacagccattaaaacaagttatttggaaccctgtttgcataaattgttgggaacaatttatccaggcacagttactcacctc

SEQ ID NO: 1212 - DNA, 1013 bp, Pennisetum glaucum
cgccggtggccgcacaggccatattgtgtacaccaagctgaaagagagatccgagcaatttatcgcaaggggcctagtgaggacagaggagagcaaacagaaaattgggggagcagatgacgtttacattgctgatataagggatgcagatcatatagcgcctgctgttcagggtgctgatgctctcgtaatcctcacaagtgccgtcccgaagatgaaaccgggtttcgaccctagcaaaggcgggagacctgagttctactatgaagatggaatgtaccctgagcaggtggattggattggccaaaagaatcagattgatgctgccaaagctgctggagttaagcatatagtgttggtgggatccatggggggcacaaatcctaaccatccattgaacagccttggtaatggcaacatactggtatggaagcgcaaggcagaacagtatttggcggacagtggagtcccttatacaattataaggcctggaggtttgcaagacaaagatggaggagtgagggagttagttgttggcaaagatgatgaacttctccagactgacacaaagtccattcctagagctgatgtggctgaagtttgtgttcaggctctgcagtatgaagaggcaaagctcaaggcatttgatttggcttcaaagcctgaaggtgtgggcacaccaacgaaggacttccgggcactgttctcccagattactgcaaggttttgactgacccgctgagaagcctaaagccccacaagcaattctaggtttccatgctgttgcattccatcacttgtggacttgtactagatatataaagctaagtaacttgtgtgcgagggagctgtaatttgggtgacattgtcaaaacggctgaaaggaatcgatgccttattctaagatatgctgttgtagttagagggctctttctagttgccattgcctctgtgtatgctgtattataccaatcatccaacttaatcaggcgtggcagtttcataaatgccac

SEQ ID NO: 1213 - DNA, 800 bp, Panicum virgatum
gacagctgcagcctgcatcaaacgagaggggaatcctgcacgagccgagtcgccgcgagcacgaggtcatggcggattcggccgcaccccgtccaaccgtcctcgtcaccggcgccggcggccgaacaggccatattgtgtacaacaagctgaaagagagatccgagcaaattgtcgcaagaggtctagtgaggtcagaggagagcaaacagaaaattgggggagcagatgatgtttacattgctgatataagggatgcagatcgtctggcgcctgctgttcagggtgctgatgctctcataatcctcacaagtgccgtccccaagatgaaaccaggtttcgacccaagcaaaggcgggagacctgaattctactatgaagatggaatgtaccctgagcaggtggattggattggccaaaagaatcagattgatgctgccaaagctgctggggtgaagcatatagtgttggtgggttccatgggaggaacaaatcctaaccatccactgaacagtcttggaaacggcaatatactagtatggaagcgcaaggcagaacagtatttggcagacagtggagttccttatacaataataaggcctggaggtttacaagacaaagatgggggagtgagggagttaattgttgggaaggatgatgaacttctccagactgatacaaagtcaattcctagagctgatgtggctgaagtttgtgtacaggctctgcagtatgaagaggcaaagttcaaggcatttgatttggcatcaaagcctgaaagtgtgggcacacctacaaag

SEQ ID NO: 1214 - DNA, 1332 bp, Cucumis melo
ctccatctttcttctcccttgctcgtactgcttcacgaaagagctttatatgtcgtaaccagagctttccagatggaaaccagacccttttagcttccataattctcgggccatggcgatgcttacacgtgtcccattattctactccgccacaaagcccacaccttctccaccactgccctttcatcaatgccataaatgttctttcgtagccaattctaattcaatcccatcttcatctcttcaaatccttcgctcttccatttccaccacctcccacaagggtttcagaaggcgtcgatttcctgctctttcggtggttgcaatggcggattctgctccccccaccgtcctcgtcaccggagctggtggtagaaccggtcaaatagtttacaagaaattgaaggagagatcagatcagtatgctgcaagaggtttggttagaactgaagagagcaagcagggtatcggtggagcagatgatctttttgttggtgatataagggatgcagatagccttggtcctgcaattcaaggcattgatgctctcatcattcttacgagtgcagtgccaaagatgaagccaggctttgatcctaccaaaggtggcagacctgagttttactttgaagatggagcatatcctgaacaggttgactggattggccagaagaatcagattgatgctgccaaggcagctggagttaaacaaatagttttggttggctctatgggtggaacaaatatcaaccatcccttgaacagtttgggtaatgggaatatattggtttggaaaaggaaggctgagcagtatttggctgactccggtattccatacaccattataagggctggaggtctgcaggataaggatggtgggatccgagaactgctagtcgggaaggacgatgaacttcttcaaacagagacgagaacgattgccagagccgatgttgccgaagtctgcattcaggcactacaatttgaggaggccaaattcaaggcattcgatctagcctcaaagcctgagggagtaggtactccgacaaaggatttcaaggccttgttctctcaagtcacaacgcgtttctgattgggtagagtttgtaatatcaatgagaattgttctgaattgttgtgctgctgttaaattttgaactgtgatattaaaataggtatgggagagaagaggttttgtaacttgtaaggatcttagattattgatgcattagaattagaggttgctaaatctctttcaatttgctgctttggttggcacgtcattagtttgcatttcaaataaactgttcctgagactgttgtaataaacaa

SEQ ID NO: 1215 - DNA, 1088 bp, Cajanus cajan
gtttttctcaatttgaacatatccacagtcccaattgcactgtatcattatatatctatggcagattcttccccgaaaaccgtgcttgtaaccggagctggtggtcgcacaggacaaattgtgtataaaaaattaaaagagaggtcaaacctgtatgttaccagaggccttgttagaacacaagaaagcaaacagaaaattggtggtgcagatgatgtttttgttggggatatcagagatgcaggaagtattacacctgcattacaaggtacagatgctctcattattctcacaagtgcagtaccacaaatgaagcctggatttgatccaaccaaaggtggaaggccagagttctattatgctgatggtgcatatcctgaacaggttgactggattgggcagaaaaatcaaatagatgctgccaaggatgcaggagttaagcatattgtgttggttgggtctatgggtggaacaaaccctaatcatcctttgaacagcttgggaaatgggaatatattgatttggaagaggaaggctgaacaatatctggctgattctggtgttccatacacgatcataaggcctggtggcttgctagataaagaaggaggcctaagggaactcattgtgggaaaggatgacgagcttcttcagactgaaaccaaagccatacctagagctgatgttgctgaagtctgcgttcaggcactaaactttgaggaggttaaattcaaggcttttgacttggcatcaaaacctgagggagaaggtacaccaacgaagaacttcaaggcattgttttcccagatcacggctcgtttttaatactgaatgctgtggtcatggtctataaatacttattgaataagggtgggatacccgggaatcattagtgctatttcagcaaattactgtcttggaaatcatgttaaagattgtataaacactagaacaaactatagagctcaataatacatagagagaaaaaagtctgtttttaatttataatttctttatatgtttttatttaagatgtatttaattgccaatttgccataatacagtaaagctattgcaagtatgcgtta

SEQ ID NO: 1216 - DNA, 1251 bp, Cucumis sativus
gcttccacaactctcgggccatggcgatgcttacacgtgtcccgttattctactccgcctcaaagtccacatcttctccaccactgccctttcatcaatgccataaatgttccttcgtaaccaattctaatttaatcccatcttcatctcttcaaatccttccctcttccatttccaccacctcccacaagggtttcagaaggcgtcgattccctgctctttcggtggttgcaatggcggattctgctccccccactgtcctcgtcaccggagctggtggcagaaccggtcaaatagtttacaagaaattgaaggagagatcagatcattatgctgcaagaggtttggttagaactgaagagagcaagcagagtatcggtggagcagatgatctttttgttggtgatataagggatgcagatagccttggtcctgcaattcaaggcattgatgctcttatcattcttacgagtgcggtgccaaagatgaagccgggctttgatcctaccaaaggtggcaggcctgagttttactttgaagatggagcatatcctgaacaggttgactggattggccagaagaatcagattgatgctgccaaggcagcaggagttaaacaaatagttttggttggctctatgggtggaacaaatatcaaccatcccttgaacagcttgggtaatgggaatatattggtttggaagaggaaggctgagcagtatttggctgactccggtattccatacaccattataagggctggaggtctgcaggataaggatggcgggatccgagaactgctagtcgggaaggacgatgaacttcttcaaacagagacaagaaccattgccagagctgatgttgccgaagtctgcattcaggcactgcaatttgaggaggccaaattcaaggcactcgatcttgcctcgaagcctgagggagtaggtacaccgacaaaggatttcaaggccttgttctctcaagtgacaacgcgtttctgattgggtagagtttgtaatatcaatgagcattgttctgaattgttgtgctgctgttaaattttgaaatgtgatattttaaataggtatgggagaggagaggatgtaacttggaaggatcttagattattgatgcattagaattagaggttgctaaatctctttcaatttgatgctttggttggcatgtcattagtctgcatttcagataaactgttcctgagaatgttgtaataaatgactttgctttttc

SEQ ID NO: 1217 - DNA, 1078 bp, Manihot esculenta
atggctaccttaacacgtgtccctttgatcttctcttgcccttctcctcctcgtcgtcctcctcctcgtaaatacgcatgcatgcctactacacttccagaatcttctactctttcatttcgctctttttctttttccttctttgcaccatttctctcaacacctcataataagagcaacaagagtttcaggagacttagagcagtttcagcgtcaatggcggattcgcgtccaagcactgttcttgtcactggagctggtggcagaactggttcaatagtttataggaaattaaaggagaggtctgggcaatatgttgcaagaggtttggtcagaactgaagagagtaaagagaaaattggtggagcaaaggatgtttatgttggggatataagggaagcagaaagtattgctcctgctatccaaggaattgatgctctcataattcttacaagtgcagttccaaaaatgaaacatgggtttgatccatctaaaggtgaaaggcctgagttttattatgaagatggagcttatcctgaacaggttgactggattggtcagaaatatcaaatagatgctgctaaggatgcgggagtgaagcacattgtgttggttggatctatgggtgggacaaatccaaataatcccttgaacagtttgggcaatgggaatatattgatttggaagagaaaggctgaacagtatttagctgattctggcattccatacacaattataagggctggaggcctgcaagacaaagagggaggtatccgagaattacttgttgggaaggatgatgagcttcttcagacggagacaagaaccattgcaagggctgatgttgcagaagtctgcattcaggcattacaattcgaagaagctaaattcaaggcaattgacttggcctcaaagccagaaggaacaggcactccaaccaaagattttaaggctctcttttcccaagtcactgctcgattttgattctcagttgaccatttttaccggtcttggatggatgtattattttgcgttttaacatcagaacatggtagcaattcagtttttactttccttc

SEQ ID NO: 1218 - DNA, 1097 bp, Lotus japonicus
cgaaacttccagaataaattttctctcttgtcatcattttcctcaatctccttcatttcagtaccagtttcactccattttctaaatccatggcgccaagcactgtgcttgttactggagccggtggtcgcacaggacaaatagtatataaaacactaaaagagaggcaatatgttgccagaggtctggttagaacagaagaaagcaaacagaaaattggcggtgcagatgatgtttttattggggatatcagagatgctggaagtattgttcctgcaattcaaggtatagatgctctcataattcttacaagtgcaaccccaaaaatgaagcctgggtttgatccaaccaaaggtggaaggcctgagttctattttgatgatggtgcatatcctgaacaggttgactggattggtcagaaaaatcaaatagatgctgctaaggctgcaggagtgaagcgtgttgtgttggttgggtctatgggtggaacaaaccttaaccatcctttgaacagcttgggtaatgggaacatattggtttggaaaagaaaggctgagcaataccttgctgattctggtattccatacacgatcataaggcccggtggcttgctagataaagatggaggtcttcgggaactcatcctagggaaggatgatgagcttctccagactgaaaccaaaaccattcctagagctgatgttgcagaagtctgtgttcaggcattaaattatgaggagactcagttcaaagcgtttgacttggcatcaaaacctgagggagttggtacaccaacaaaggacttcaaggctttgttttcccagatcacttcccgattttaattttgaatgttattatcatggtctatttgcttattatggtggtttgggattgaacccaactcaatagtgctatgctgtctaaaacaaagtactttgtcccggcaataagttgaaggtagtctatagctaatcttatatttggtcggtaatttagaaaaaaaataattccatattgtttttaaattgttttaaaacagaaaggatgtatgtgatgagcacaagtagaaaaatatagcacagttactagttacaact

SEQ ID NO: 1219 - DNA, 1145 bp, Medicago truncatula
aagcagtggtatcaacgcagagttgccattacggccgggatccagaactttccattcttcatcttcatcatcagtatcacattttcaatccattgaacattgttattgtttcaaattcaattcaatggcaggttcatctcaaaccactgtccttgttactggtgctggtggtcgcacaggacaaattgtgtataaaaaattgaaagagaagcgagaccaatatattgccagaggtttggttagatctgaagaaagcaaacagaaaattggtggtgcagatgatattttccttggggatatcagaaatgccgaaagtattgttcctgcaattcaaggtacagatgctctcatcattctcacaagtgctgtcccacaaatgaaacctgggtttgatccaaccaaaggtggaaggcctgagttttattttgatgatggtgcatatcccgaacaggttgactggattggacagaaaaatcaaatagatgctgctaaggctgcgggagtgaagcatattgtgttggttgggtctatgggtggaacaaaccctaaccatcctttgaacagtttgggaaatggaaatatactggtttggaaaagaaaagctgaagaatatctgtccaattctggtgttccatacacgatcataagacctggtggcttgcttgataaagaaggaggtgttcgggaacttattgtagggaaggatgatgaacttcttcagaccgaaactaaaactatacctagagctgatgtagcagaagtctgcgttcaggtactaaattatgaggagactaaattgaaggcatttgacctagcatcaaaacctgagggtgcaggtgaaccaacaaaggacttcaaggctttgttttcccagctcacttctcgtttttgagggttttcatgatgtatgattgtatgtgattattgtctaacaatgcttttgaaacccaaagtcattagtgctttgcttctaaagcaaattactttgccttcacaaataagttagatataggactaatcatagacttcaataagtgatttcaggaatcaaatctaagaataaaagttcattgaattacatgtataaactgatatttataaatttatcatctacagcagaagcaatattatgttacataattatg

SEQ ID NO: 1220 - DNA, 1115 bp, Arachis hypogaea
caaaggagcaaagcagaacataaaaagagtggcatctgcattgcacgctgtaataacaacaaaccatggctgcttcttccccaattactgtgcttgttactggagctggcggtcgcacaggccaaattgtgtataggaaattaaaagaaaagccaaaccaatttgttgccagaggtttggttagaactgaagaaagcaaacagaaaattggtggtgatgatgatgtttttgtaggggatataagagatgctgcaagtattgttcctgcaattcaaggtatagattctctgataatcctcacaagcgccgtgccgcttatgaagcccgggtttgatccaaccaaaggtcaaaggcctgagttctatttcgatgacggcgcatatcctgaacaggttgattggattgggcagaaaaatcaaatagatgctgctaaggcggcaggagtgaagcatattgtgttggtggggtctatgggcggtacgaaccctaaccatcctttgaacagcttgggcaatgggaatatattggtatggaaaagaaaggccgagcagtatttggctgattccggtgttccatacacaatcataagggctggtggcttgctcgataaggatggaggtcttcgggagctgattgttgggaaagacgacgagctcctccagactgaaaccaaaaccatacctagagctgatgttgcagaagtctgtattcaggcagtaaattatgaggaggctaagttcaaggcgtttgacttggcatcaaagcctgagggagtagctgcaccaaccaaggacttcaaggctttgttttctcggatcactactcgtttttaaactttgaatgatgttattactataccatcaagatgataaatgcatttaacttttaccttgcttacatattaggaggataattagtagggtaattgagtgggcatatctttgctcgtacttattatacctaaagtcattagtgttatgctctctgaagcaaattactatatgatcttcaaaggtgagtaattcatacgctgtatcaattccatcgagaataatttgtgtttttaactccctgttttgttgaagcaaattcctttaattgcatttatattgtct

SEQ ID NO: 1221 - DNA, 1312 bp, Arachis hypogaea
ctctgacaaaacttctcgagccaactacgaagccagcggcaaaggagcaaagcagaaaagcagaacataaaaagagtggcatctgcattgcacactgtaataataacgaaacatggctgcttcttccccaattactgtgcttgttactggagctggcggtcgcacaggccaaattgtgtataggaaattaaaagaaaaaccaaaccaatttgttgccagaggtttggttagaactgaagaaagcaaacagaaaattggtggtgctgatgacgtttttgtaggggatataagagatgctgcaagtattgttcctgcaattcaaggtatagattctcttataatcctcacaagcgccgtgccactcatgaagcccgggtttgatccaaccaaaggtcaaaggcctgagttctatttcgatgatggcgcatatcctgaacaggttgattggattgggcagaaaaatcaaatagatgctgctaaggaggcaggagtgaagcatattgtgttggtgggatctatgggcggtacgaaccctaaccatcctttgaacagcttgggcaatgggaatatattggtatggaaaagaaaggccgaacaatatttggctgattccggtgttccatacacaatcataagggctggtggcttgctcgataaggatggaggtcttcgggagctcattgttgggaaagacgatgagctccttcagactgaaaccaaaaccatacctagagctgatgttgcagaagtctgtattcaggcagtaaattatgaggaggctaagttcaaggcgtttgacttggcatcaaagcctgagggagtagctgcaccaaccaaggacttcaaggctttgttttctcggatcactactcgtttttaaactttgaatgatgtgatgataaatgcatttaacttttatcttgcttacatgttaggaggataattagtagggtaattgagtgggtatatctttgctcgtacttattatacctaatgtcattagggttatgctctctgaagcaaattactatatgatcttcaaaggtgagtaattcataggctctatcaattccatcgagaataatttgtgtttttaagtccctgttttgttgaaacaaattcttttaattgcatttatattgtctcaactggaccatagccgaactacagctgaacctctgctgaccgccgctggcaatccagtgtgggtccagagccagtcagggggttaccttgtcttgtagatcactaccaaactaatgtctctgtatttcttcatctttacattgtctagtgtttttgtgtttgttcc

SEQ ID NO: 1222 - DNA, 1276 bp, Capsicum annuum
ttggtaaatcatagacttccagaattgtcttctacacttgtaacaactgctacctcatcatcatatgtttcatttccaaacaaaaacaagaaatttagcagattttcagtgttggccatggctgatttgagcataaatactgttcttgttactggtgctggtggtagaactggatcaattgtctataagaagttgaaggagaggtcagagaaatatacagcaagaggattggttagaacagaggaaagcaaacaaaaaatttgtggtgcagatgatgtttatattggtgatatcaggaatactgagagtcttgttcctgctatacaaggtatcgatgctctcgttattcttacaagtgctgtgccaaaaatgaaacctggatttgatccaacaaaaggtggaagacctgaattctattttgaggatggggcaaatcctgaacaggtggattggattggccaaaagaaccaaatagatgctgctaaagcagctggtgtgaagcagatcgtgctagtcgggtcaatgggagggacaaatcctaaccaccccttgaatagtttggggaatgggaatatattgatttggaagagaaaggctgaacaatatttggctgactctggaattccatatacaattataagggctggagggctacaagataaagaaggtggtataagggaactacttgttggaaaggacgatgaacttctccagacagaaactaaaactgtcgctagagctgatgttgcagaagtctgcattcaggcactgcagtatgaggaagcaaaatttaaggcatttgatctggcctcaaaacctgagggaactggcactccaactaaggatttcaaggctctatttgcacaaatcactactcgtttctgatgcacaactcacttggactatgtccaaaattttcatcactctattcttcccaacatttgttcaaaagagagtctattaacttaaggtatataggcctctgagtttggttgtaccattgcagctttctcaccgttcccccctgcatattatcctcatcgacaccatggcacactcagagatgacttgccagtagttcaatgatacagtagagggttatgttatgtgcctctgtaggtttatcttgatttttctgatgtttggaaggcaattaactcaataagcatttttgaactactgcaagaggcaaacaactatgttattgttgcttgcatttgctgcatacttcacccaaaaatgttccaattttatgattttcattttatcctcgtgc

SEQ ID NO: 1223 - DNA, 1149 bp, Cucumis melo
  misc_feature (606)..(606): n is a, c, g, or t
  misc_feature (942)..(942): n is a, c, g, or t
atcaatgccataaatgttctttcgtagccaattctaattcaatcccatcttcatctcttcaaatccttcgctcttccatttccaccacctcccacaagggtttcagaaggcgtcgatttcctgctctttcggtggttgcaatggcggattctgctccccccaccgtcctcgtcaccggagctggtggtagaaccggtcaaatagtttacaagaaattgaaggagagatcagatcagtatgctgcaagaggtttggttagaactgaagagagcaagcagggtatcggtggagcagatgatctttttgttggtgatataagggatgcagatagccttggtcctgcaattcaaggcattgatgctctcatcattcttacgagtgcagtgccaaagatgaagccaggctttgatcctaccaaaggtggcagacctgagttttactttgaagatggagcatatcctgaacaggttgactggattggccagaagaatcagattgatgctgccaaggcagctggagttaaacaaatagttttggttggctctatgggtggaacaaatatcaaccatcccttgaacagtttgggtaatgggaatatattggttnggaaaaggaaggctgagcagtatttggctgactccggtattccatacaccattataagggctggaggtctgcaggataaggatggtgggatccgagaactgctagtcgggaaggacgatgaacttcttcaaacagagacgagaacgatagccagagccgatgttgccgaagtctgcattcaggcactacaatttgaggaggccaaattcaggcattcgatctagcctcaaagcctgagggagtaggtactccgacaaaggatttcaggccttgttctgtcagtcacacgcgtttctgattgggtagagtttgtaatatcatgagaattgtctgaantgtgtgtgctgtaaattttgactgtgaataaaataggtatgggagagaagaggttttgtaacttgtaaggatcttagattattgatgcattagaattagaggttgctaaatctctttcaatttgctgctttggttggcacgtcattagtttgcatttcaaataaactgttcctgagactgttgtaataaacaactctgctttttccc

SEQ ID NO: 1224 - DNA, 979 bp, Zingiber officinale
  misc_feature (410)..(411): n is a, c, g, or t
  misc_feature (413)..(413): n is a, c, g, or t
  misc_feature (416)..(416): n is a, c, g, or t
  misc_feature (444)..(444): n is a, c, g, or t
  misc_feature (790)..(790): n is a, c, g, or t
  misc_feature (795)..(795): n is a, c, g, or t
  misc_feature (810)..(812): n is a, c, g, or t
  misc_feature (817)..(817): n is a, c, g, or t
  misc_feature (819)..(822): n is a, c, g, or t
  misc_feature (824)..(824): n is a, c, g, or t
  misc_feature (827)..(827): n is a, c, g, or t
  misc_feature (865)..(865): n is a, c, g, or t
  misc_feature (882)..(882): n is a, c, g, or t
  misc_feature (885)..(885): n is a, c, g, or t
  misc_feature (938)..(938): n is a, c, g, or t
  misc_feature (943)..(943): n is a, c, g, or t
  misc_feature (950)..(952): n is a, c, g, or t
gcaccatggtttcgaacgcgcggaaagttttgagccatggccgatgcttcctccaggatcaccgttctcgtcactggcgccgctggtcgcacagggcaaattgtttttaaaaaattgaaagagaggtcagatcagtttattgcaagaggacttgtacgtaccgaggagagtaaagaaaagattggaggagctgatgacatttttgtggcagacataagggatgataaggctattgttcctgctgtgcaaggcatagatgcactgataattctcacaagcgcggtgccaaaaatgaagccaggatttgatccaagcaaagggggaaggcctgagttctattttgaagatgggttatatcctgaacaggttgattggattggtcaaaagaatcaaattgatgcagccaaagnngnagntgtaaagcatattgttttggttggttcnatgggtggaacaaacccaaatcatccattaaatagtcttgggaatggtaacatattggtctggaaacgaaaggcagaacagtacttagctgaatctggtgtaccttacacgattataaggcctggaggtttgctcgataaagatggttcacagcgagagttggtggtgggaaaagatgatgaacttctccagactgaaaccaaatctataccaagagctgatgttgcagaagtctgcattcaggctctgctaaatgaagagacaaagttcaaggcttttgatctggcatcgaagcctgagggtgctggtactgcaacaaaggatttcaagtccttgttctcccaantcacngctcggttctgagcnnntgagnannnnantanaattgaacttaccaacgagggaataaattctaaaattnaattgtgttttatactnaanaaaatatattttgagatgtgctgcagctttagctttcacatgattcttgtgangatgnctaaatnnnaatacagttcacccagttcaaactact

SEQ ID NO: 1225 - DNA, 1113 bp, Arachis hypogaea
ctctgacaaaacttctcgagccaactacgaagccagcggcaaaggagcaaagcagaaaagcagaacataaaaagagtggcatctgcattgcacactgtaataataacgaaacatggctgcttcttccccaattactgtgcttgttactggagctggcggtcgcacaggccaaattgtgtataggaaattaaaagaaaagccaaaccaatttgttgccagaggtttggttagaactgaagaaagcaaacagaaaattggtggtgatgatgatgtttttgtaggggatataagagatgctgcaagtattgttcctgcaattcaaggtatagattctctgataatcctcacaagcgccgtgccactcatgaagcccgggtttgatccaaccaaaggtcaaaggcctgagttctatttcgatgacggcgcatatcctgaacaggttgattggattgggcagaaaaatcaaatagatgctgctaaggaggcaggagtgaagcatattgtgttggtgggatctatgggcggtacgaaccctaaccatcctttgaacagcttgggcaatgggaatatattggtatggaaaagaaaggccgagcagtatttggctgattccggtgttccatacacaatcataagggctggtggcttgctcgataaggatggaggtcttcgggagctgattgttgggaaagacgacgagctcctccagactgaaaccaaaaccatacctagagctgatgttgcagaagtctgtattcaggcagtaaattatgaggaggctaagttcaaggcgtttgacttggcatcaaagcctgagggagtagctgcaccaaccaaggacttcaaggctttgttttctcggatcactactcgtttttaaactttgaatgatgttattactataccatcaagatgataaatgcatttaacttttaccttgcttacatattaggaggataattagtagggtaattgagtgggcatatctttgctcgtacttattatacctaaagtcattagtgttatgctctctgaagcaaattactatatgatcttcaaaggtgagtaattcatacgctgtatcaattccatcgagaataatttgtgtttttt

SEQ ID NO: 1226 - DNA, 1350 bp, Castanea mollissima
acagcacatattagtgtccgtactactacttactattttcctcaatggctatcgttacacgtgtcccattgggcttccctacacctagcttctcctcctcattaagcaaatgcaaatcaagtcaatatcataaacaatatagacatagtttggtggcattatcatcaccatctacaagggttcccgaaacttccacacttttctctccttatattatatcgagtaattcttcttattcaccatttctgcaaaagaaggacacaaagggttttagaagggttaaagtggtatcagcagcaatggcagatttggctccaagcactgttcttgttactggagctggcggcagaacaggtcaaattgtttataagaagttaaaggagaggtcagagcagtatgttgcaagaggtctggtcagaacagaagagagcaaggagaaaattggtggagcagatgatgtttttgttggggatataagggatgctggcagcctagttcctgcaatccaaggtattgatgctcttgtaattctgacaagcgctgtgccaaagatgaagcctggttttgacccaagcaaaggtggaagacccgagttctactttgaagatggagcatatcctgaacaggttgattggattgggcagaaaaatcaaatagatgctgctaaggctgcgggagtgaagcaaattgtgttggttggctctatgggtggaacggatctaaataatcccttgaacagcttgggtaacggcaatatattggtttggaagagaaaggctgagcagtatttggctgactctggtgttccatacacaattataagggctggaggcctgcaagataaagaaggaggtatccgagaattacttattggaaaggatgatgagcttcttaagacagacacaagaacaatcgcaagggctgatgttgcagaagtctgccttcaggcactacaatttgaggaggctaagtttaaggcgtttgatttgtcctcaaagcctgagggagctggtacaccaacaaaggattttaaggctctttttgctcaaatcaccacccgtttctgatttttgatggccaatatactttgtctaggacagtgtttcctcattcaaacttcaaagttctagttcaaaacgttgttatttgacatcataattagctatgttgaacaaagctactgtaaccggtttattagctctaaatgctcaggttcctgaagctttgtataaaacactttttattcctagagcgatcttgaggttagaagcctggatttatgtgtgttatcgcctgctagtgaaacagtcatcatgggtctattagcatcttatattattggccctttga

SEQ ID NO: 1227 - DNA, 1302 bp, Solanum tuberosum
taatctttgctataaaaatggctgccttgacacgtgtatctccttaccaatgtcataaattaagtttggtaaatcagagacttccagaattgtttgtttcatttccaaagaaaaacaagaatttttgcaaattctcagtgttggcaatggctgatttgaatacaagcactgttcttgttacaggtgctggtggaagaactggatcaattgtctataagaagttgaaggagaggtcagagaactatacagctagaggattggttagaacagaggaaagcaaacaaaaaattggtggtgcagatgatgtttatattggcgatatcaggaataccgagagtcttattcctgctatacaaggtattgatgctcttgttattcttacaagtgctgttccaaaaatgaaacccgggtttgatccaacaaaaggtggaagacctgaattctattttgaggatggggcaaatcctgaacaggtagattggatcggccaaaagaaccaaatagatgctgctaaagctgctggtgtgaagcagatcgtgctagttgggtcaatgggagggacaaatcctaaccaccccttgaacagtttggggaacgggaatatattgatttggaaaagaaaggctgaacaatacttggctgactctggaattccatatacaattataagagctggaggtctacaagataaagaaggtggaatacgcgaactacttgttggaaaggatgatgaacttctcgagacagatactaaaactgttgctagagctgatgttgcagaagtttgcattcaggcactgcagtatgaggaagcaaaatttaaggcatttgatctggcctcaaaacctgagggaactggcactccaactaaggatttcaagactctatttgcacaaatcgctactcgtttctgatatacatctccctaggactatgtccaagattttcatcactcttttctgccaacatttgttcaaaggggaggctatagacttaaggtagataggcatctgagtttggttgtactattgcagatccctcccccctgcgtagcagctaacctcatcgacaccatggcatactcatagatgacttgccaatagttcaatgatgcaatagagggttatgttatgtgcctctcttgatttttctgatgtttggaaggcaaataactcaataagcattgttgcacttgtgcaaaaagcaaattactatcttattattacttgcttgcatttgcatgcttcgccaaataatgtttcaactttatgattttcattttatgcatcattgatggcaatc

SEQ ID NO: 1228 - DNA, 1415 bp, Solanum phureja
atgaaaatctgacaaatggataagaaaatgtacaaaaatcccaactaataactaatatactctaataagttcacacactacatttgattattgaatggactactaaaaaaaaaaaatctttgctataaaaatggctgccttgacacgtgtatctccttaccaatgtcataaattaagtttggtaaatcagagacttccagaattgtttgtttcatttccaaagaaaaacaagaaattttgcaaattctcagtgttggcaatggctgatttgaatacaagcactgttcttgttactggtgctggtggaagaactggatcaattgtctataagaagttgaaggagaggtcagagaactatacagctagaggattggttagaacagaggaaagcaaacaaaaaattggtggtgcagatgatgtttatattggcgatatcaggaataccgagagtcttattcctgctatacaaggtattgatgctcttgttattcttacaagtgctgttccaaaaatgaaacccgggtttgatccaacaaaaggtggaagacctgaattctattttgaggatggggcaaatcctgaacaggtagattggatcggccaaaagaaccaaatagatgctgctaaagctgctggtgtgaagcagatcgtgctagttgggtcaatgggagggacaaatcctaaccaccccttgaacagtttggggaacgggaatatattgatttggaaaagaaaggctgaacaatacttggctgactctggaattccatatacaattataagagctggaggtctacaagataaagaaggtggaatacgcgaactacttgttggaaaggatgatgaacttctcgagacagatactaaaactgttgctagagctgatgttgcagaagtctgcattcaggcactgcagtatgaggaagcaaaatttaaggcatttgatctggcctcaaaacctgagggaactggcactccaactaaggatttcaagactctatttgcacaaatcgctactcgtttctgatagacatctccctaggactatgtccaagattttcatcactcttttctgccaacatttgttcaaaggggaggctatagacttaaggtagataggcatctgagtttggttgtactattgcagatccctcccccctgcgtagcagctaacctcatcgacaccatggcatactcatagatgacttgccaatagttcaatgatgcaatagagggttatgttatgtgcctctcttgatttttctgatgtttggaaggcaaataactcaataagcattgttgcacttgtgcaaaaagcaaattactatcttattattacttgcttgcatttgcatgcttcgccaagtaatgtttcaactttatgattttcattttatgcatcattgatggcaatc

SEQ ID NO: 1229 - DNA, 1352 bp, Cleome gynandra
ttcggggttaattacaatgcgaaatcgaacattcaaactaagataaggtgacatgataaggtgtctatgttcctatgtttagacaacataaggaagaagatcccggcgacgtcacaatcggcggtccaaagttctcagaaccaccggagctggagaatttacctctggtaaccgccattgtcttcgatcagtggtgacgatgatgatccttgcatgccctgtggtcgctccggttactggttataaatccggcattatggcgtcgtcgtcagtgtcagcacgacgttctccatctctgtcgtgttcgtcttcgtcgtcgtctcttcgatatagttctttggtctcggatccaaagtcttgttcaattcggagaaattgtgtcgtaaagtaccgcagagtatcggttgtagtggccgctgcagcaatctcagaacctcgcaccgtccttgtcaccggcgccggcggaagaacagggcagattgtgtacaggaaactaaaggagagacccgaccagttcgtggcgaggggtttagtgaggacgaacgaaagcaaggagaagattggtggagaggatgatgtctatgtcggagatatcagggacgttgccgccattgctcctgctgtccaaggaatcgatgctcttataattctcacgagtgctgtcccgcaaatgaaacctggttttgatcctaccaaaggcgggagaccggagttctactttgaagatggagcttatccagaagaggtggattggattggtcagaagaatcagatagatgcggccaaggctgctggagtcaagcagattgtcgtggttgggtcaatgggaggaactaaccctaatcaccctctaaatagcatcggcaatgggaatattctggtatggaagaggaaggccgagcagtatttagctgattctggtatcccatacacaataatcagggccggcggtctgcaggataaagaaggtggaattcgagaactgctcgttgggaaagatgatgagcttctcgagacagacacgagaacaattgcgagggctgacgtagccgaagtctgcgtccaggccttgcagttcgaggaggcgaaatacaaagcactagacttggcctcgaagcccgagggaacaggcaccccaacaaaagatttcaaggcgctcttcgcccaagtaacaacccgattctgatcttatatctgcctctctttactagtctagcaaaattttgagattataactccgaactgtccatgtgatgtagagatcctcatgtgttttaatggctctctccgttatttcaaaggtttgggccgttaatctaatgcattggagcaactctatgaacttagagatt

SEQ ID NO: 1230 - DNA, 1271 bp, Cleome spinosa
aacacaacgagaagggggaagagaagtttccggcgaagtcgcaatcaccggcgccgaagatttcactaccggtagagtaaaccgctgctgacttctaacaatggagacgatgatgacgctcgtatctcccccggtcgttccggtttctggttataaatccggcattgtgacttgttcgtcggtgtcagtacatcgttctccatctctgtcgtgtttgtcgtctcttcgctctggttcttcggtttgggatctgaagtcttgttctggtcggagaaagtgtgtcgcaaagtttagcagaatgtcggttgttgttgccgctgcagccattgcagaacctcgaaccgtcctggttaccggcgccggcggaaggacagggcagattgtgtacacgaaactaaaggagagacccgaccagttcgtggcaaggggtctggttaggactgatgagagcaaggagaagattggcggagaggatgatgtctatgtcggagatatcagagacgctgccgccattgctcctgcggtccaaggaatcgatgcccttatcattctcactagtgctgtccctaaaatgaaacccggttttgatcctaccaaaggcggaagaccagagttctacttcgaagatggggcttatccagaacaggttgactggattggtcagaagaatcagatagacgcagccatggctgctggagttaagcagattgtcttggttgggtcaatgggaggaacaaatcttaataaccctctgaacagcattggcaatggcaatattctggtatggaagaggaaggccgagcaatatttggcagattctggtgtcccctacacaatagtcagggccggtggtctgcaggataaggaaggtggaatccgagaattgctcgtggggaaagacgatgagcttctcgagacggacacgagaacgatcgcgagggctgatgtagcagaagtctgcatccaggcattgcagttggaggaggcgaaaaacaaagcaatagatctggcctccaagccggaggggactggaactccaacgaaagatttcaagtcactcttcgcacaagtaacgtcccggttctgatctttctgtttgttcctgtttttagattcagagttgagagaactactactgtccatttaatgcagtagacacccttttgtcttaacggctctttctgtatttccaagggttttgtcctttaattttagtgcattgaagactgaagagcaacactccaacaaactcaagagattagcaaatatcc

SEQ ID NO: 1231 - DNA, 1114 bp, Solanum melongena
agcagattctcagttttggccatggctgatttgaacacaagcactgttcttgttactggtgctggtggcagaactggatcaattgtgtataagaagttgaaggagagatcagagaaatatatggctagaggatttgttagaacagaggaaagcaaacaaaaaattggtggtgcagatgatgtttatattggtgatatcaggaattccgagagtcttgttcctgctgtacaaggtattgatgctctcgttattcttacaagtgctgttccaaaaatgaaacccggatttgatccatcaaaaggcggaagacctgaattctattttgaggatggggcatatcctgaacaggtagattggattggccaaaagaaccaaatagatgctgctaaagctgctggtgtgaagcagatcgtgctagttgggtcaatgggagggacaaatcctaaccacccgttgaacagtttggggaatgggaatatattgatttggaagagaaaggcggaacaatatttggcggactctggaattccatatacaattataagggctggagggttacaagatacagaaggtggtataagggaactacttgttggaaaggacgatgagcttctcgcgacagaaactaaaactgttaccagagctgatgttgcagaagtctgcattcaggcactgcagtatgaggaagcaaaatttaaggcatttgatctggcctcaaaacccgagggaagtggcactccaactaaagatttcaagtctctatttgcacaaatcactactcgtttctgatatacttctcactaggactatcatcattcttttctgtcaacatttgttcaaaggggatcggaggctataaacttaaggtagataggcatctgagtttggttgtactattgcagctccctccccgttcccccctgcgtagcagctaacttcatcgacaccatggtacactcaatgatacagtgcagggttatgttatgtgcctctatcttgattttttttgatgtttggaaggcaaataactaaataagcattgttgaactagtgcaagagccaagaggtattctactatgttatcattaattgtttgcttatgcatgcttcacac

SEQ ID NO: 1232 - DNA, 1219 bp, Helianthus annuus
cgaatcctcttggaaaccaaaccaaaccagtccaccatagtctactccatacctccatggctaatctgacacgtgtccttctaccacaatttcctcaatgcaccacgtctatctgcaccatttctctcaacctaaaccctaacactaccagaaggcgattttcagttctcgcaatggcggaatccaaccgtaccaccgttctcgtcaccggagccggcggccgtactggtcaattagtttataagaagctgaaggagaggtcaggggagtatattgcacgaggtttcgttagaagtgaggaaagtaagcagaaaattggcggagccgacgatgttttgatcggcgatataacgaatgccgcaactctggaaccggctatacaaggcacagatgctattgtgattcttaccagtgcagttcctaaaatgaaacctggttttgatccgactaaaggtggaagacctgaattctatttcgaagagggagcataccctgagcaagttgactgggaagggcaaaagaatcaaatagatgctgctaaagctgcaggagtgaaacacattgtgctggttggctcgatgggtggaacaaatctcaaccatcctttaaacagccttggaaacgggaatatactggtctggaagcgaaaggctgaacagtatctagcagactctgggattccatacacaattataagggctgggggtttgcaagacaaggaaggtggcattcgggagctacttgtcggaaaagatgacgagcttcttcagaccgaaactaaaaccattgcccgagcagatgtcgctgaagtctgtatacaggcgttgcaatttgaggaggcgaagtttaaggcatttgatcttgcctccaaacccgagggaagtggaacgccgacaaaagacttcaagagcttatttgcccagatcacctctcggttttaagttttaacttccttcgtgttgtgctataataattgccatagtgtcacttgtttgatgtattgtcgggactagtgtcaatgccggattcgggtgagatgtgataattttggatattttcagacgtggcaaactttacaattaatgggtgttgcctcttcaacccgttaagagacataagcttaaccaattgttggtgcatttaacacgttacatctcgcttcgtcgtagaacgtgtttgagctagtaacatcttcctgtttacatacaggaatgaagat

SEQ ID NO: 1233 - DNA, 1124 bp, Helianthus annuus
gcttcggcgggggcgatcctcttggaacaaaccaaaccagtccacatagtctactccatacctccatggctaatctgacacgtgtccttctaccacaatttcctcaatgcaccacgtctatctgcaccatttctctcaacctaaaccctaacactaccagaaggcgattttcagttctcgcaatggcggaatccaaccgtaccaccgttctcgtcaccggagccggcggccgtactggtcaattagtttataagaagctgaaggagaggtcaggggagtatattgcacgaggtttcgttagaagtgaggaaagtaagcagaaaattggcggagccgacgacgttttgatcggcgatataacgaatgccgcaactctggaaccggctatacaaggcacagatgctattgtcattcttaccagtgcagttcctaaaatgaaacctggttttgatccgactaaaggtggaagacctgaattctatttcgaagagggagcataccctgagcaagttgactgggaagggcaaaagaatcaaatagatgctgctaaagctgcaggagtgaaacacattgtgctggttggctcgatgggtggaacaaatctcaaccatcctttaaacagccttggaaacgggaatatactggtctggaagcgaaaggctgaacagtatctagcagactctgggattccatacacaattataagggctgggggtttgcaagacaaggaaggtggcattcgggagctacttgtcggaaaagatgacgagcttcttcagaccgaaactaaaaccattgcccgagcagatgtcgctgaagtctgtatacaggcgttgcaatttgaggaggcgaagtttaaggcatttgatcttgcctccaaacccgagggaagtggaacgccgacaaaagacttcaagagcttatttgcccagatcacctctcggttttaagttttaacttccttcgtgttgtgctataataattgccatagtgtcacttgtttgatgtattgtcgggactagtgtcaatgccggattcgggtgagatgtgataattttggatattttcagatgtggcaaacttcataatagaaaattattgatcatagtgttgtcaatttggct

SEQ ID NO: 1234 - DNA, 2053 bp, Eucalyptus grandis
aatcccgggagaaacgattataaaaatgaggaattgaaacgacgaattttcccggctccgctgcggaaactgtagagcagccgagcttatcccttccttcgcgctcccgctgagcgacgtttcgtgtgtcttctccatcgccagattttcaggcgacggttggatgggataggacccggtgcggctgagcgcatattttcgtagggtcggcaatggcgacgcgtgtcccttcggtcttcgctgtcgctccatcaccaccgtcatcgtcgtcacgtcagggtcataaattgaggtcggtgacagctcgcgtgattaatcaccgaaacaatcgctgcagcagcagcagctccagtcaaattagggtctctcctgcctcttcgcttcgcttcgccttggcttccccgtcggcggcgccgtcatctccttctccttcgtcgccgaggaagcggttcctgacttttgctgctgtatccatggccgccgcgcctccgccgaccgtgctcgtcaccggtgccggtggtcggactggtcaaatagtttataagaaattgaaggagaggccagaccagtttgttgcaagaggtcttgtcagaacagaagagagcaagggaaaaattgagggagctgatgatgtttatgttggtgatataagggatgctggtagtatacttcctgcaatacaaggcactgactttcttgttattctcaccagtgctgttccaaagatgaagcctgggtttgatcccactaagggtggaaggccggagttttattttgaagaaggagcttatcctgagcaggttgattggcttggacagaaaaatcaaattgatgctgctaaagctgctggagtaaagcaaatagttttggttggttcaatgggcggaacaaatctcaatcaccctttgaacagcttggggaatggaaacattctggtgtggaagaggaaggctgagcagtatttggctgattctggcattccatacacaataataagggctggaggcttgcaagacaaagaagggggtgtccgtgaattaattgtgggcaaggatgatgagcttcttcagacaccaacaagaaccatcacaagggaggacgttgcagaagtttgcattcaggcgctgcaatttgaggagtcaaaatacaaggcgctcgatctggcctcgaaacccgaagattctggtacacccacaaaagattttaaggctctgtttgccagcgtgaccactaaattttaacattacaagtggccctcggtttttagctcaatcgtttctcagttattgttgctaagtttgtggagagggggggaaacaaagacaatgcaaataacaaaaggtgtacaagaattcatgtctccacaggacggtgcaagtctcaattctgtggtaaatttcatttggtgtggcccaagaatatgatcaaacaacaaaattgggttattatttacttgtaaaaactgcatgcctatttgactaatgtgcatcggaaatggtttacctagcaggtgctatatgcttacatctctcctttgtgtatgcctgaccaacctttgttcgcaactgtgttggagaaacttttgcatggtttatagatcatgtaaaattgaagccatctggaatgttgctcatatcagtcccactgtcagcctatatgaccaatggtttagatgatatcgacacattgtggcctacgaaccatgctacaacttccatgggctgatggaacgaaatttagtcgagtagtacagaccaatctatctggaatgagatttctatatttgaatttgcgtgacgtaatgtcggtaagaagattgaaattgtaatgttggtaagcaacaagatgtcatcgcatgctttcaaacggcgtttcacaaattcaaaccgtctactgcaaggctattttaaccgcacttgtcttcaaattgagattttgtcttttagtactttttcttcgaaagcaaattctagtggcgtcagctctccgagggtgctaccgttacatttctacaccaactaaaaaggtacttcgtttttaaaatcatctatcg

SEQ ID NO: 1235 - DNA, 1003 bp, Manihot esculenta
attttcccaacaacccataataacctcaagtcttcttggagcttcgcgcgctttcgctggcaatggcagattcgcgtccaaccactgttcttgtcactggagctggcggcagaactggttcaatagtatataagaaattgaaggagagatctgacgaatatgttgcaagaggattggtcacaactcaagatagcaaagagaaaattggcggagcagaggatgtttttgttggggatataagggaagcagaaagcatcaccccagccttccaaggaattgatgctctcataattctaacaagtgcagtgccaaagatgaagcctgggtttgatccgtccaaaggtggaaggcctgagttctattatgaagatggagcatatcccgaacaggtcgactggattggtcagaagaatcaaatagatgctgctaaggctgtgggagtgaagcagattgtgttggttggttctatgggtgggacgaatccgaatcatcccttgaacagtttgggcaatgggaatatattgatctggaagagaaaggctgaacagtatttggctgattctggtattccatacacaattataagggctggaggcctgcaagataaagaaggaggtgtccgggaattacttgttgcaaaggatgacgtgcttcttcaaacagatacaaaatccattacaaggtcagatgttgcagaagtctgcattcaggcattagcatttgaggaagctaaatttaaggcatttgacttggcctctaagccagagggaactggcactccaacaaaagattttaaggctctcttcgcccaagtgactagtcgattttgaatctcagttgaccattgttgctctggtcttagatattgtatttatgtgtttaactcaataaagagttgctacctgttgattaggagaaagaaaataataagaggatacagggtggatctatgatatacaatttcttaattgataatacaaagggaactctcaattgacgtact

SEQ ID NO: 1236 - DNA, 1259 bp, Aristolochia fimbriata
cgttacaagataaggaaagctgattagccagagtaaaatactggggaaaatctttcccgtcgccgcagcagctccggagtcttcgcgtcgaatggattcggaccttcttctataatggcgttggtgacacgtgtccctgcgctttctcctcctctctcttcttcctacattggtcaaaaccttccacccgtcactattttgccatttatacgtaggagagtttcaagagctcgggttgtttcagccatggccacttcctccctgccgacggttcttgtcactggcgctggtggtagaacaggacaaattgtgtacaaaaagttgaaggaaaaaacagaccagtttattgcaaagggtctggtcagaacagaagagagtaaagaaaaaattggaggggcagatgatgtttatgtaggtgatataaggaatgcagacagcattgctcctgctatccagggtattgatgcactgataatccttactagtgctgtgccgaagatgaaacccgggtttgatccaagcgcaggtggtcgacctgaattctactttgaagatggtgcataccctgaacaggttgactgggttggtcagaaaaaccaaattgatgctgctaaagccgttggagtcaagcaaattgttctagtagggtctatgggtggaacaaatctgaatcatcccttgaacagtctaggaaatggaaatatactggtgtggaagagaaaatctgagcaatacttggcagattctggtattccatacacaattataagggctggtgggttacaagataaagaaggcggcgtcagggagctagttgttgggaaagacgatgaacttcttcagactgagataagaacaattgccagagctgatgttgcagaagtctgtattcaggcattgctgattgaagaatccaagttcaaggcatttgatctggcatcaaaaccagagggcactggtacaccaacaaacgatttcaaaactctcttttcccaaatcactactagattttgagatgtagagcctccttgttctgctctttccagaaatgatttgccgttactgtttaaacagataagcatcgttagaggatcctatattgggttctgaaaaaagtggcttgatttataactgtttcaaactagggtgtagctgttctatgctcttgcatgggtacgtgcttgtgtggttgtattccgtgcatttcagcaaatatcagggagttctaggaataaacatcagagatacgcaataattta

SEQ ID NO: 1237 - DNA, 1102 bp, Artemisia annua
ggtgcaacattaacacattctgtttcaaccctttaataaaatctaacaacaacacaaccagaagaacattagttgttttgtcgatggctgaatccaaccgtagcactgtcctcgttaccggagccggtggcagaactggtcaaatagtttataagaagcttaaggagagatcaagtgaatttactgcaagaggtcttgttagaagtgaggagagtaaatccaaaattggtggagcagatgatgttttcattggagatatcacaaaacccgaaactcttgctcctgctattggaggcatagacgctcttgtgattctcacaagtgcagttcctaaaatgaaacctggtttcgatccaactaaaggcggaaggcccgaattctattttgaggatggacaataccctgaacaagttgactgggaagggcagaaaagtcaaattgatgctgctaaagctgccggagtgaagcaaattgttctggtcggttccatgggtgggacaaatattaaccatcctttaaacagcttaggaaacgggaatatactggtttggaagagaaaggctgaacagtatctagcagactctggtattccatacacaattatcagggcggggggtttgcaagacaaggaaggtggtatcagggaattgcttatcggaaaagatgatgagcttcttcaaactgaaaccaaaactgttgccagcgctgaagtttgtgttcaggcactgcaaattgaggaggcgaaattcaaggcatttgatcttgcctccaaacctgagggaactggaacgccaacaaaagatttcaaggccttattttctcagatcacaactcggttttgaggtacaacatctttaaaaattgtgttccgttaagggacatatcaatatacactaagcattgcaagatatggatgagttgtaataatttcggatattttcaaatctggccgaaatacatgttctgtatgaggatgtattcagtatttttgtattagtatatgtccttgcattatctttgtgctttgttatagcactatgtacacggcttgcttgctgtagcatttggtttggcctacactaataaagatttgaacttatcg

SEQ ID NO: 1238 - DNA, 1463 bp, Eucalyptus grandis
  misc_feature (3)..(3): n is a, c, g, or t
cgngtgtcttctccatcgccagattttcaggcgacggttggatgggataggacccggtgcggctgagcgcatattttcgtagggtcggcaatggcgacgcgtgtcccttcggtcttcgctgtcgctccatcaccactgtcatcgtcgtcacgtcagggtcataaattgaggtcggtgacagctcgcgtgattaatcaccgaaacaatcgctgcagcagcagcagcagctccagtcaaattagggtctctcctgcctcttcgcttcgcttcgccttggcttccccgtcgtcggcgccgtcatctccttctccttctccttctccttcgtcgccgaggaagcggttcctgaccgttgctgctgtatccatggccgccgcgcctccgccgaccgtgctcgtcaccggtgccggtggtcggactggtcaaatagtttataagaaattgaaggagaggccagaccagtttgttgcaagaggtcttgtcagaacagaagagagcaagggaaaaattgagggagctgatgatgtttatgttggtgatataagggatgctggtagtatacttcctgcaatacaaggcactgactttcttgttattctcaccagtgctgttccaaagattaagcctgggtttgatcccactaagggtggaaggccggagttttattttgaagaaggagcttatcctgagcaggttgattggcttggacagaaaaatcaaattgatgctgctaaagctgctggagtaaagcaaatagttttggttggttcaatgggcggaacaaatctcaatcaccctttgaacagcttggggaatggaaacattctggtgtggaagaggaaggctgagcagtatttggctgattctggcattccatacacaataataagggctggaggcttgcaagacaaagaagggggtgtccgtgaattaattgtgggcaaggatgatgagcttcttcagacaccaacaagaaccatcacaagggaggacgtcgcagaagtttgcattcaggcgctgcaatttgaggagtcaaaatacaaggcgctcgatctggcctcgaaacccgaagattctggtacacccacaaaagattttaaggctctgtttgccagcgtgaccactaaattttaacattacaagtggccctcggtttttagctcaatcgtttctcagttgctgttgctaagtttgtggagaggggggaaacaaagacaatgcaaataaagaaagttgtacaagaattcatgtctccacaggacggagcaagtctcaattctgtggtaaatttcatctgatgtggcccaagaatatgatcaaacaacaaaattgggttattatttacttgtgaaaactgtatgcctatttgactaatgtgcatcggaaatggttttcctccttaagatgatggtccgctactgatgctggtggtagcgggtgatttagatcaagatttacctagc

SEQ ID NO: 1239 - DNA, 1475 bp, Quercus alba
aacctaacctaacctgattaacggcaacgaggaaaaagcaagccaaaaagctcggaacaaaagaaaatctgaatctcaccgacggcaaaatggacagcacatattagtgtccgtactactttctattttcctcaatggctatcgttacacgtgtcccattgggcttccctacacctaggcctagcttctcctcctcattaagcaaatcaagtcaatgtcataaacatagacatagtttggtggcattatctacaacatctataagggttccagaaacttccacacttttctctccttatattatattgagtaattcaccatttctgcaaaagagggacacaaagggttttagaagagttaaagtggtatcagcagcaatggcagatttggctccaagcactgttcttgttactggagctggtggcagagcaggtcaaattgtttataagaagttaaaggagaggtcagagcagtatgttgcaagaggtctggtcagaacagaagagagcaaggagaaaattggtggagcagatgatgtttttgttggggatataagggatgctggcagcctagttcctgcaatccaaggtgttgatgctcttgtaattctgacaagcgctgtgccgaagatgaagcctggttttgacccaagcaaaggtgaaaggcccgagttctactttgaagatggagcatatcctgaacaggttgattggattgggcagaaaaatcaaatagatgctgctaaggctgcgggagtgaagcaaattgtgttggttggctctatgggtggaacagatctaaataatcccttgaacagcttgggtaacggcaatatattggtttggaagagaaaggctgagcagtatttggctgactctggtgttccatacacaattataagggctggaggcctgcaagataaagaaggaggtatccgagaattacttattggaaaggatgatgagcttcttaagacagacacaagaaccattgcgagggctgatgttgcagaagtctgccttcaggcactacaatttgaggaggccaagtttaaggcgtttgatttgtcctcaaagcctgagggagctggtacaccaacaaaggattttaaggctctttttgctcaaatcaccacccgtttctgattttcgatggccaatatactttgtctaggacagtgtttcctcattcaaacttcaaagttctagttcaaaacattgttatttgacatcataattagctatgttgaacaaagctactgtaaccggcttattatctctaaatgctcaggttcctgaagctttgtatgaaacactttttattcctagagcgatcttgaggttagaagcctggatttatgtgtgttatcgcctgctagtgaaacagtcatcataggtctgttagcatcttatattacttgccctttttgacaatcttgccttttcttgtgttgtgaatatgatctaccttcagga

SEQ ID NO: 1240 - DNA, 1411 bp, Quercus alba
  misc_feature (1392)..(1392): n is a, c, g, or t
cctaacctaacctaacctgattaacggcaacgaggaaaaaaagcaagccaaaaagctcggaacaaaagaaaatctgaatctcaccgacggcaaaatggacagcacatattagtgtccgtactacttactattttcctcaatggctatcgttacacgtgtcccattgggcttccctacacctaggcctagcttctcctcctcattaagcaaatcaagccaatgtcataaacatagacatagtttggtggcattatctacaacatctataagggttccagaaacttccacaattttctctccttatattatattgagtaattcaccatttctgcaaaagagggacacaaagggttttagaagagttaaagtggtatcagcagcaatggcagatttggctccaagcactgttcttgttactggagctggtggcagaacaggtcaaattgtttataagaagttaaaggagaggtcagagcagtatgttgcaagaggtctggtcagaacagaagagagcaaggagaaaattggtggagcagaggatgtttttgttggggatataagggatgttggcagcctagttcctgcaatccaaggtattgatgctcttgtaattctgacaagcgctgtgccgaagatgaagcctggttttgacccaagcaaaggtggaaggcccgagttctactttgaagatggagcatatcctgaacaggttgattggattgggcagaaaaatcaaatagatgctgctaaggctgcgggagtgaagcaaattgtgttggttggctctatgggtggaacagatctaaataatcccttgaacagcttgggtaacggcaatatattggtttggaagagaaaggctgagcagtatttggctgactctggtgttccatacacaattataagggctggaggcctgcaagataaagaaggaggtatccgagaattacttattggaaaggatgatgagcttcttaagacagacacaagaaccattgcgagggctgatgttgcagaagtctgccttcaggcactacaatttgaggaggccaagtttaaggcgtttgatttgtcctcaaagcctgagggagctggtacaccaacaaaggattttaaggctctttttgctcaaatcaccacccgtttctgattttcgatggccaatatactttgtctaggacagtgtttcctcattcaaacttcaaagttctagttcaaaacattgttatttgacatcataattagctatgttgaacaaagctactgtaaccggcttattatctctaaatgctcaggttcctgaagctttgtatgaaacacattttattcctagagcgatcttgaggttagaagcctggtattttatgttgttatcgcctgctagtagaaacngtcatcagtgggtctatta

SEQ ID NO: 1241 - DNA, 1215 bp, Brassica napus
gggcgagaatctgagaaacgataaggtgtgtctcctccgactctctcgtcatcgtctgagcttaccaaactccagtcaatggcgatgacaacgactacactcttccatgcacttgttccttccaccacttacaaaccaggagctgtctcctcttccttcgtctcagttccgtcttcttcgccgtctctccaattccgctcgcttgtttcagacacgacgtcgatctacggtcggaggaagtttaccgggaatctcagaagagtatccttaaccgtctccgctgccgcagcagctgagcctctcaccgtcctcgtcaccggtgcgggtggaagaacagggcaaattgtgtacaagaagttgaaggagaggtcggatcagttcgtggcgagaggtttggtgaggacgaaagagagcaaggagaagatcggtggagaggatgaagtgttcgtcggagatattcgtgaccctgaagccattgctcctgctgttcaagggattgatgctttggtcattcttacgagcgctgtaccgaagatgaaacctggttttgatcctagcaaaggagagagacctgagttttattttgaagaaggagcttatcctgaacaggttgattggattggtcagaagaatcagatagatgctgctaaggcagcaggagttaagcagattgttttggtcgggtcaatgggaggaacaaacataaacaaccccttgaatagtattggcaatgccaacattctggtttggaagaggaaagctgagcagtacttggctgactccggtattccatacaccatcatcagggcgggtggtctgcaggacaaggaaggtggcattcgagaactaattgtgggaaaagatgacgagattcttgagacagaaatgagaacaatagcaagggctgatgttgctgaagtctgcgttcaggcgttgcagctcgaggaggcaaagtttaaagcacttgatctggcctcaaagccagagggaacaggcaccccaacaaaggatttcaaggcacttttcgctcaagttaccgctcggttttgatcttctgttactttgtctttgtagcagagtcataggattagagactgagagggataataagttcattatgtgagataaacatgtctgaatcagctctttctatatttttcaaggggtcttcccctaagtatattttgtatgcaccattcacaaaatcccaaagtc

SEQ ID NO: 1242 - DNA, 1157 bp, Petunia hybrida
tgttgattcttgaatggactaaaatcttttcttgctataaaaatggctactttgacacgtgtatctccttttcaatgccataataaattaagtttggcaaatcataataacactaatagacttattaaagagttctcctcacattttgttacatttccaaagaaaaacaaaaactttagtagattctcagtatttgctatggctgatttgaacacaagtactgttcttgttactggtgctggtggcagaactggatcaattgtttataagaagttgaaagagaggtcagagaactatacagctagaggattggttagaacagaggaaagcaaacaaaaaattggtggtgcagatgatgtttatattggtgatatcaggaacactgagagtattgttcctgcaatacaaggtatcgatgctctcgtaattcttacaagtgctgtgccaaaaatgaaacccgggtttgatccaactcaaggtggaaggcctgaattctattttgaggatggggcaaatcctgaacaggtagattggattggccaaaagaaccaaatagatgctgctaaagctgctggcgtgaagcaaattgtgctagttgggtcaatgggagggacaaatcctaaccaccccttaaacagtattgggaacgggaatatattggtatggaagagaaagctgaacaatacttggctgattccggtattccatacacaatcataagggctggaggattacaagataaagatggtggtataagggagctactcgttggaaaggacgatgaacttcttcagacagaaacaagaactatcgccagggctgatgttgcagaagtctgcattcaggcattgcagtatgaggaagcaaaatttaaggcatttgatctggcctctaaacccgagggaactggcacaccaaccactgatttcaggctctcttcgcacaaatcagttctcgtttttgatgtattgctcgcgaggactgcgtctaatttcatcactctattctgtgtctaaacgggagcctaaacacttgaagttagataggcatttgagtatggttgtatcaccgaccccatggcacgttcatgagcctctgtaggtttcttggggtctttctgatgcttggaaggcaataaactctatgcattttctgaa

SEQ ID NO: 1243 - DNA, 1217 bp, Raphanus sativus
gggataaggtgtgtgtctctctcacttcccctcgtcatcgtctgagcttaccaaaactccggtcaaatggcgatgacgactgctacactcttccatgcacttgttccttccaacagttacaaaacaggagctgtgtcctcttcgttagtctcagttccgtcttcttcgtcgtctctccaattccgctcgcttgtctcggattcaacgtcggtttatgctcggaggaagttaaccggagatctcagaagagtatccttaactgtctccgccgccgcagcaactgagcctctcaccgttctggtcaccggtgccggtggaagaacagggcaaatcgtgtacaagaagttgaaggagaggtcggatcagttcgtggcgagaggtttggtgaggacgaaagagagcaaggagaagatcggtggagaggaggaagtgttcgttggagacattcgagaccttgaagccattgctcctgctgttcaagggattgatgctttggtcattcttacgagcgctgtaccgaagatgaaacctggttttgatcctagcaaaggagagagacctgagttctactttgaagaaggagcttatcctgaacaggttgattggattggtcagaagaatcagatagatgccgctaaggcagctggagttaagcagattgttttggtcgggtcgatgggaggaacaaacataaacaaccccttgaatagcattggcaatgccaacattctggtttggaagaggaaagctgagcagtacttggctgactccggtattccatacaccatcatcagggcgggtggtctgcaggacaaggaaggtggcatccgggaactaattgtgggaaaagatgacgagattcttgagacagagacgagaacaatagcaagggctgatgttgcagaagtctgcgttcaggcgttgcagctcgaggaggcaaagtttaaagcacttgatctggcctcaaagcctgagggaacaggcaccccaacaaaggatttcaaggcacttttcgctcaagttaccgctcggttctaatcttctgttactctgtctttgtagcagagtcataggattagagacttcgaggaataataaatacattttgtgagatacactcgtctgaatcggctctttctatatttctgaagtagtcttactctaaagattctagataatatcaaaagcctttgaaatttgatatcaaaaaaaaaaaa

SEQ ID NO: 1244 - DNA, 1005 bp, Vigna unguiculata
gtctttaccattttcaacacattcacagtaccaataacagtccactattatgttcatggctgattcttcccctaaaaccgtgcttgtaaccggatctggtggccgcacaggacaaattgtgtataaaaaattaaaggagaggccaaaccagtatgttaccagaggacttgttagaacagaagaaagtaaacagaaaattggcggtgcaaatgatgtttttattggggatatcagagatgctggaagtattactcctgcatttcaaggtatagatgctctcataatcctcacaagtgcagttccacaaatgaagcccgggtttgatccaacaaaaggtggaaggcctgagttctactttgatgatggtgcatatcctgaacaggttgactggattgggcagaagaatcaaatagatgctgccaaggctgcaggagtgaagcatgttgtgttggttgggtctatgggtggaacaaacactaatcatcctctgaacagcttgggaaatgggaatatattgatttggaagagaaaggctgaacaatatctggctgattctggtctgccatacacaatcataaggcccggtggtctactagataaagaaggaggtattagggaacttattgtgggaaaagatgacgagcttcttcagactgaaaccaaaaccattcctcgagctgatgttgccgaagtctgcattcaggcactgaattttgaggaggtgcaattcaaggcttttgacttggcatcaaaacctgagggagtgggtaccccaacgaaggacttcaaggcattgtttgccaatatcacagctcgtttttgatagataatgcaatggtcgttttttattaactgaagagggataccataatgctcaataaatgttttggaaatcatgttaaaggttattccatggacaccaaaataaataatgtagctcaataataccattgaatacaaaattaatatttatgcttttagttatttataaaaaaaaagaaaaaa

SEQ ID NO: 1245 - DNA, 1488 bp, Solanum lycopersicum
atgaaaatctaataaatggataagaaaatgtacaaaaatctcttttgactctaaataagtttcacacaatacatttgattcttgaatggactactaaaaaaaaagtttctttggctataaaaatggctgccttgacacgtgtatctccttaccaaagccataaattaagtttggtaaatcagagacttccagaattgtcttcttcacttgtaaaaaatacctcatcatttgtttcatttccaaagaaaaacaagaaattttgcagattttctgtgttggcaatggctgatttgaacacaagcactgttcttgttactggtgctggtggaagaactggatcaattgtctataagaagttgaaggagaggtccgagacttatacagccagaggtttggttagaacagaggaaagcaaacaaaaagttggtggtgcagatgatgtttatattggtgatatcaggaatatcgagagtcttgttcctgctatacaaggtattgatgctcttgttattcttacaagtgctgttccaaaaatgaaacccgggtatgatccaacaaaaggcggaagacctgaattctattttgaggatggggcaaatcctgaacaggtagattggatcggccaaaagaaccaaatagatgctgctaaagctgctggtgtgaagcggatcgtgctagttgggtcaatgggagggacaaatcctaaccaccccttgaacagtttggggaacgggaatatattgatttggaaaagaaaggctgaacaatacttggctgactctggaattccatatacaattataagggctggagggctacaagataaagaaggtggtataagggaactacttgttggaaaggacgatgaacttctcgagacagaaactaaaactgttgctaggactgatgttgcagaagtctgcattcaggcactacagtatgaggaagcaaaattcaaggcatttgatctggcttcaaaacctgagggaactggcactccaactaaggattttaaggctctatttgcacaaatctctactcgtttctgatatacgtctccctaggactatgtccaaaattttcatcagtctattctaccaacatttgttcaaaggggaggctataaacttaaggtagacaggcatctgagtttggttgtactattgcagatccctccccgtgcccctctgcgtagcagctaacctcatcgataccatggcatactcagatatgacttgccaatagttcaatgatacagtagagggttatgttatgtgcctctcttgatttatctgatgtttggaaggcaaataactcaataagcactgttgaacttgtgcaagaggcaaagtactgtcttattattacttgcttgcatttgcatgcttcaccaaataatgtttcaactttatgattttcattttatgcatcattgatggcaatcaaacttatctggtggatcaaggccatggttttatagttcatatg

SEQ ID NO: 1246 - DNA, 1099 bp, Tropaeolum majus
cggccggggatccgtttcactattactttccatcttctcctccattgtcaattcctgaaattaaaggaaatcatactaaggattttaagataatagaaaaatagttgcatcaatggctgatctgaatcgtactacagtccttgtcaccggtgctggtggcagaacaggtcaaatagtttataggaaattgaaggagagatctgaccactttgctgcaaaaggtttggtaagaactcaggagagcaaggagaaaattggtgcagctgatgatgtttttattggggatataagggatgctagcagcattgttcctgccattgaaggaactgatgctcttgtaatcctaacaagtgctgtgccaaaaatgaaacctggttttgatcccagtaaaggtggaaggcccgagttctactttgaagaaggaggatatcctgaagaagttgactggatcggtcagaagaatcaaattgatgctgctaagactgctggcgtgaagcacattgttttggttggttccatgggaggaactgatgtcaatcatccgttaaacagtttgggaaacggcaatattttggtctggaagagaaaagctgagcagtatctggctgattctggcattccgtacacaatcataagggccggtggcctacaagataaagaaggtggtgttagagaattgcttgttggaaaggatgacgagcttctcaagacagaaacaaaattaattgcaagggctgatgttgcggaagtctgcattcaggcactccaatttgaagaggccaaatttaaggcatttgatctggcctcaaagcccgagggaagtggtactccaacgaaggattttaaggcattgttttcgcaaatcactactcgtttctgattatttatggtaatgatcgttgtttgtccaggactacattaacttatggtattctactgtggaagtacacgcatacaacttagtgccaacaggtcctttataatatatgctcatttcttgagaaacatatataaaataatttgaaaatgaaaataaacttccaactcctttgtgtatgttagcataatagtgtcgtgtgagtgtgcgtatgttagcata

SEQ ID NO: 1247 - DNA, 1016 bp, Brassica rapa
ctccagtcaatggcgatgacaacgactacactcttccatgcacttgttccttccaacacttacaaaccaggagctgtctcctcttccttcgtctcagttcctcgctcctcaactccaccttcttcgccctctctccagttccgctcgcttgtttcagacacgacgtcgatctacggtcggaggaagtttaccggaaatctcagaagagtatccttaaccgtctccgccgccgcagcagctgagcctctcactgtcctcgtcaccggtgccggtggaagaacagggcaaatcgtgtacaagaagctgaaggagagggcggatcagttcgtggcgagaggtttggtgaggacgaaagagagcaaggagaagatcggtggagaggatgaagtgttcgtcggagatattcgtgaccctgaggccattgctcctgctgtgcaagggattgatgctttggtcattcttacgagcgctgtgccgaagatgaaacctggttttgatcctagcaaaggagagagacctgagttctactttgaagaaggagcttatcctgaacaggttgattggattggtcagaagaatcagatagatgctgctaaggcagctggagttaagcagattgttttggttgggtcaatgggaggaacaaacataaacaaccccttgaatagtattggcaatgccaacattctggtttggaagaggaaagctgagcagtacttggctgactccggtattccatacaccatcatcagagctggcggtctgcaggacaaggaaggtggcattcgagaactaattgtgggaaaagatgacgagattcttgagacagaaatgagaacaatcgcaagggctgatgttgctgaagtctgcgttcaggcgttgcagctcgaggaggcaaagtttaaagcacttgatctggcctcaaagccagagggaacaggcaccccaacaaaggatttcaaggcacttttcgctcaagttaccgctcggttttgatcttctgttactttgtcttt

SEQ ID NO: 1248 - DNA, 1459 bp, Citrus clementina
gcagcgcgtggtaaaaaatggtgagtggaaaaaacttacgacaagagataaggtgacatcagagagaagaggataagaaaatcaatgtaacaaccaaccaaccaacctgattgattaacggctacgaaggaaaaaggaggggcagttgcgcgtcgctcgtcacagtttcgctcctgtgattgactgacggccggatggacaagtaagctaattcttgatcaatggctacgcttacacgcgtcacattcatttccgcatcgtcaccatcaggcagcattggtcactctcgtaataaatgccgtcaggtggcgtcatcaataccattcctcaacagccttccagaattttcttctcacgctttccgcgctcgctattctccttcttcactaacatcacttccgagaacgagataccgaaggagttgcgtcagtaaaaccgaagcagtcaaagttttatcgatggctaagagtaccgttcttgtcaccggcgctggtggtcgaaccggtcaaatagtttataagaaattaaaggagaggtcagagcaatatgctgctagaggtttggtcagaactgaggagagcaagcagaaaattggcggagcagatgatctttttattggtgacataagggactctaatagcatcattcctgcaatccaaggaatcgatgctctcttaattctcacaagtgcagtaccaaagatgaaacctgattttgatcctgccaaaggtggaaggcctgagttctactttgaagagggtgcatatcctgaacaggttgattggattggtcagaaaaatcaaattgatgctgctaaggctgctggagtgaagcaaattgtgttggttggatcgatgggaggaacaaatcttaatcatcccttgaacagtttgggcaatggcaatatattggtttggaaaagaaaggctgagcagtatttggctgactctggtattccatacacaattataagggccggaggccttcaggataaagaaggtggtatccgagaattgcttgtcggtaaggatgatgaacttcttcagacagaaacaaggacaattgccagggccgatgttgccgaagtctgcattcaggcactacagtttgaggaggccaaatttaaggcatttgatctggcctcaaagcctgagggaactggcacacccacaaaggattttaaagctctcttttctcaaattactactcgtttctgagtctcagtcgccattctcctcctgagtttttatgttagaaaactgtaatgccttgtattaaaaaggggaatgaataaatgaatgccgaagatttctaaaagctggtgtaaaacaattttatgcgaaagatattctccgcacttgcattggatagttgtctattggtattggaacttttcacatggatgaatagagtggattcggtgcttttgattttcaagcttctcctaaggtaagatcaa

SEQ ID NO: 1249 - DNA, 944 bp, Cleome spinosa
atcttccactctcttctcttgattaatatcctaacggagaatttcgaatttggggaaaagttcagggagcttagtagattctccaatggcggatcatcccactgtcctcgtcaccggcgccagtggcagaacaggtcagattgtttataagaagttgaaggagaggtcggatcaatttgttgccaagggccttgtcagaactccagaagggaaggagaaaatcggaggaaaggatgatgtttttgtcggggatataagggatgagcatagcattaaccccgcgattcaagggattgattccctcataattctcacaagtgctgtgcccaaaatgaagcctggttttgatcctactgcaggtggaaggccggagttcacattcgaggatggacaatatcctgaacaggttgattggattggtcagaagaatcaaatcgatgtagccaaagctgctggtgttaagcatattgtcttggttgggtccatgggaggaaccaatcctaatcatccgctgaacaaactggggaacggaaatatactgatttggaagcgaaaggctgaacaataccttgctgattccggaattccctacacaattatacgggctggagggcttatagacaaagaaggcggggctcgagagctcatagttggtaaagatgacgagcttcttcaaaccgatacaaaaacaatcccgagggcagatgttgcagaagtctgcgtccaggcattgctgtttgaggaggcgaaattcaaagctttcgacttagcctcgaagccggagggaactggcactccgaccaaagacttcaaggccctcttctcccaattgacttctcggttttagtctcgagaacaaacaaatgtcggtcttctgaatatctatcacaagatctgatgaacattgtatcctctcatgatatggattatgtgattttcaatgc

SEQ ID NO: 1250 - DNA, 1555 bp, Gossypium hirsutum
aaattcataatatattataatattataaacatttcttaccattcaactccctctttgtaacggcagcaaccaatccaaaagctttaatttattcctcgtcacaattttgctagccttaccggcggtcggatacaacccactctaacccaacccttctggatcaatggctacgcttacacgtgtcccattggtattttccagcaacagggttgcaccagctccagctgcttcattaaatcacaaatgtaattgcgtggcgtcatcatcacccttaacaagaaaacttccacattgttctactccctcttctcttagcttcaaccctttttcatcttcattcccttctttctcaacgcgacaaaacaagggttttaggagaacatctctggtagtagcttccatggctgatctcagcactgtgctcgtcactggagccgctggcagaacaggtcagatagtttacaagaagctgaaagagaggtcggatcagtttgtcgtgagaggactcgttagaactccagaaagcaaggagacaatcggtggagcagatgatgtgtttgttggggatatcagggataccacctctctggttcctgccatgcaaggaattgatgcactcataattcttactagtgctgttcctagaatgaaacctgggtttgatccgacgaaaggcggaaggcctgagttctattttgaagatggagcatatcctgagcaagttgactggattggtcagaaaaaccaaatagatgttgctgaggaggctggagtgaagcaaattgtgttggttgggtccatgggtggaacaaaccctaaccatcccttgaacagcttgggcaatgggaacattttggtctggaagagaaaggctgagcagtatttggctgactctggtgtcccatacacaattatcagggctggaggactgcaagatagagatggtggcatcagagaactacttgtcgggaaggatgatgagcttcttcagactgaaacaaaagcaattgccagacctgatgtagcagaagtctgcattcaggcactgaaatttgaggaggccaaatttaaggcgtttgatttagcctcgaaacctgagggagttggcaacccaacaaaggattttaaggctcttttttcccagatcactactcgtttctaattctcaagttccataacttccgtcttagactttgagtgatgttatgctcctaaagactttttatcagtatctcgaacttctaaaaccatgctatgatctgcagagaggtctacaaacaagcaactctcagctggtctactaaggtgatggtgtgatgatattatcaaagaattagcattcctagtgttatttttgtctgacattgctatggaactcgatattttagtaatatttgctctcatctctgtcttttgatttgctttgaaagccatacaatttttaggaacatgagatatgatatggagactgttgtaaaaggagcagccaaaacatcatgtaataaagttgtttgagaaaaagaaaaaagtaccgactgcgactctgcgttgatac

SEQ ID NO: 1251 - DNA, 1534 bp, Gossypium hirsutum
aaattcataatatattattatattataaacatttcttaccattcaactccctctttgtaacggcagcaaccaatccaaaagctttaatttattcctcgtcacaattttgctagccttaccggcggtcggatacaacccactctaacccaacccttctggatcaatggctacgcttacacgtgtcccattggtattttccagcaacagggttgcaccagctccagctgcttcattaaatcacaaatgtaattgcgtggcgtcatcatcacccttaacaagaaaacttccacattgttctactccctcctctcttagcttcaaccctttttcatcttcattcccttctttctcaacgcgacaaaacaagggttttaggagaacatctctggtagtagcttccatggctgatctcagcactgtgctcgtcactggagccgctggcagaacaggtcagatagtttacaagaagctgaaagagaggtccgatcagtttgtcgtgagaggattggttagaactccagaaagcaaggagacaatcggtggagcagatgatgtgtttgttggggatatcagggataccaccactctggttcctgccatgcaaggaattgatgcactcataattcttactagtgctgttcctagaatgaaacctgggtttgatccgacgaaaggcggaaggcctgagttctattttgaagatggagcataccctgagcaagttgactggattggtcagaaaaaccaaatagatgttgctaaggaggctggagtgaagcaaattgtgttggttgggtccatgggtggaacaaaccctaaccatcccttgaacagcttgggcaatgggaacattttggtctggaagagaaaggctgagcagtatttggctgactctggcgtcccatacacaattatcagggctggagggctgcaagatagagatggtggcatcagagaactacttgtcgggaaggatgatgagcttcttcagactgaaacaaaaacaattgccagacctgatgtagcagaagtctgcattcaggcactgaaatttgaggaggccaaatttaaggcgtttgatttagcctcgaaacctgagggagttggcaacccaacaaaggattttaaggctcttttttcccagatcactactcgtttctaattctcaagttccataacttccgtcttagactttgagtgatgttatgctcctaaagactttttatcagtatctcaaacttctaaaaccatgctatgatctgcagagaggtctacaaacaagcaactctcagctggtctactaaggtgatggtgtgatgatattatcaaagaattagcattcctagtgttatttttgtctgacattgctatggaactcgatattttagtaatatttgctctcatctctgtcttttgatttgctttgaaagccatacaatttttaggaacatgagatatgatatggagactgttgtaaaaggagcagccaaaacatcatgtaataaagttgtttgagaaaaggaaattgtttgca

SEQ ID NO: 1252 - DNA, 941 bp, Nicotiana tabacum
  misc_feature (118)..(118): n is a, c, g, or t
  misc_feature (148)..(148): n is a, c, g, or t
  misc_feature (241)..(241): n is a, c, g, or t
  misc_feature (290)..(290): n is a, c, g, or t
  misc_feature (292)..(292): n is a, c, g, or t
  misc_feature (298)..(298): n is a, c, g, or t
  misc_feature (304)..(304): n is a, c, g, or t
  misc_feature (311)..(311): n is a, c, g, or t
  misc_feature (391)..(391): n is a, c, g, or t
  misc_feature (424)..(424): n is a, c, g, or t
  misc_feature (427)..(427): n is a, c, g, or t
  misc_feature (439)..(439): n is a, c, g, or t
  misc_feature (481)..(481): n is a, c, g, or t
  misc_feature (517)..(517): n is a, c, g, or t
  misc_feature (528)..(529): n is a, c, g, or t
  misc_feature (541)..(541): n is a, c, g, or t
  misc_feature (544)..(544): n is a, c, g, or t
  misc_feature (559)..(559): n is a, c, g, or t
  misc_feature (584)..(584): n is a, c, g, or t
  misc_feature (589)..(589): n is a, c, g, or t
  misc_feature (595)..(595): n is a, c, g, or t
ccggggagagttgtcctcacttctagcaactacctcatcacttgtttcatttccaaagaaaaacaagaaatttagcaaattctcagttttggccatggctgatttgaacacaagtacngttcttgttaccggtgctggtggcagaacnggatcaattgtttataagaagttgaaggagaggtcagagaaatatacagcgagaggattggttagaacggaggaaagcaaacaaaaaattggnggtgccgatgatgtttatattggtgatatcagggatactgagagtattntncctgcnatacanggtattnatgctcttgttattcttacaagtgctgtgccaaaaatgaagcccgggtttgatccaactcaaggtggaagaccggaattntattttgaggatggggcataccctgaacaggtngantggattggccanaagaaccaaatagatgctgctaaagctgctggtgtgaagcanatcgtgctagttgggtcaatgggagggacaaatccnaaccacccctnnaacagtattggnaangggaatatattggtntggaagagaaaggctgaacaatacntggcngactcnggtattccatacacaattataagggctggaggattacaagataaagaaggtggtattagggaactacttgttggaaaggacgatgaacttctccagacagaaacaagaaccattgccagggctgatgttgcagaagtttgcattcaggcactggagtatgaggaagctaaatttaaggcacttgatctggcctcgaaacctgagggaactggcacaccaaccacagacttcaaggctctatttgcacaaatcagtgctcgtttctgataataccgctcaccatgactgtgcgaattttcatcactctattattccaacatttgttcaaaagtgaggctaaagcctt

SEQ ID NO: 1253 - DNA, 1112 bp, Centaurea maculosa
gattggatatcgaaatcaagtgctcctctcgaatcatatactccatcccttttggttggcggaatcttctggaaaccaccataataaacgaaacggactccatgatggcctctctgccacgtgtcctcctatctacttcctccttttcacattgttgccctcaattgactaccaccaaattaccaaccaccaccaccaccagaagaagcagattctcagttttcgcaatggcggaatccaatcgcaccaccgttcttgttaccggcgccggtggtagaaccggtcaaatagtttacaagaagctgaaggagcggtcaggagagtatattgcaagagggttggttagaagcgaggagagtaaggagaaaataggtggagcagatgacgttttcattggcgatataacgaaggccgaaactatcgttcctgctatcgagggcatagatgctcttgtaattctcacaagtgcagtccctaaaatgaaacctgggtttgatccaagtaaaggtggaaggccggaattctatttcgaagaaggagcaaaccctgaacaagttgactgggaaggccagaaaaatcaaatagatgctgctaaagctgttggagttaagcaaattgttctggtgggctccatgggcggaacaaatattaaccaccctttaaacagcttgggaaacgggaatatactggtctggaagagaaaggctgaacaatatctagcagattctggtattccatacacaattataagggctgggggtctgcaagacaaagaaggcggtgtccgggagttgcttatcggaaaagatgacgaacttctacagactgaaactaaaaccattgccagagccgatgtggctgaagtctgtattcaggcattgcaaatcgaggaggcaaaatgcaaggcactggatcttgcctccaagccggagggaactggaacgccaacaaccgacttcaaggccttattttcccaagtcactactcggttttgaggtaaaaaaataagtaacctgacatatcgatccatttgttccatcgagagaatgatcaccgtgttgtactgaattatctgcgtttaatgttttcgctcttgatggatgcgacgagat

SEQ ID NO: 1254 - DNA, 1128 bp, Cichorium intybus
ggttttctttttcaaataagggactgcccatttaatcgattggatagctccatccatggcttctctcacacgtgtccttctaccaacctcttcacaatttcctcaacagtgtgccacttctacctgcaccaaaaattataccatttctaccacatccagaaggagattctcagttttctcaatggcggaacccaaccgtagcaccgtcctcgttaccggagctggtggcagaaccggtcagatagtttacaaaaagctaaaggaaagatcaactgagtacattgcaagaggtttggttagaagcgaagagagtaaagagaaaattggtggtgcagatgatgttttcattggtgacataagaaataccgaaactatccttcctgccattcaaggcatagatgctcttgtaatcttaacaagtgcagtccctaaaatgaaacctggttttgacccaagtaaaggtggaagacccgaattctattttgaagaaggacaaaaccctgaacaagttgattgggaagggcagcaaaatcaaatagatgcagctaaagctgctggagtgaagcaaattattcttgtggggtccatgggtgggacaaatattaatcaccctttaaacagcttgggaaatgggaatatactggtatggaagagaaaggctgaacagtatttagcagactctggtattccatacacaattataagggctggggggttgcaagataaggaaggtggggtccgcgagctgcttattggaaaagacgatgaacttcttgagactgaaaccaaaaccattgcgagaccagatgtggctgaagtttgtattcaggcactgaaatttgaggaggcgaaatttaaggcgtttgatcttgcttcaaaacccgagggaagtggaacgccaacaaaggatttcaaggccttattttcacaagtcactactcggttttaactttaaggcacttgttttggcatttgtaataataatgtgggaatttttattgtaagaattggcatatattgtcaatgattggtaagatgagatgtaataatatcggatgttttttttaatgtagctgaattttatagtgcgatggtattattagcatcgttatatgttgctacccgggg

SEQ ID NO: 1255 - DNA, 1231 bp, Brassica napus
tattgtatcgataagccttgatatcgaatacgtatcggacattacggacggtgggcgagaatctgagaaacgataaggtgtgttcctccgactctctcgtcatcgtctgagcttacctaactccagttaatggcgatgtcgacgactacactcttccatgcacttgttccttccaacacttacaaatccagagctgtctcctcttccttcgtctcagttcctcgctcctcaactccaccttcttcgccgtctctccagttccgctcgcttgtttcagacacgacgtcgatctacggtcggaggaaatttaccggcaatctcagaagagtatccttaaccgtctccgccgccgcagcagctgagcctctcaccgtcctcgtcaccggtgccggtggcagaacagggcaaatcgtgtacaagaagttgaaggagaggtcggatcagttcgtggcgagaggcttggtgaggacgaaagagagcaaggagaagatcggtggagaggacgaagtgttcgtcggtgatattcgagaccctgaatccattgctcctgctgtgcaagggattgatgctttggtcattcttacgagcgctgtaccgaagatgaaacctggttttgatcctagcaaaggagagagacctgagttctactttgaagaaggagcttatcctgaacaggttgattggattggtcagaagaatcagatagatgctgctaaggcagcaggaattaagcagattgttttggtggggtcgatgggaggaacaaacataaacaaccccttgaatagcattggcaatgccaacattctggtttggaagaggaaagctgagcagtacttggctgattccggtattccgtacaccatcatcagggcgggcggtctgcaggacaaagaaggtggcattcgagaattaattgtgggaaaagatgacgagattctagagacagaaatgagaacaattgcaagggctgatgttgctgaagtctgcgttcaggcgttgcagctcgaggaggcaaagtataaagcacttgatctggcctcaaagcctgagggaacaggcaccccaacaaaggatttcaaggcacttttcactcaagttaccgctcggttctgatcttctgttactttgtcttttaagcagagtaataggacaagagactgagagggataataagttcattatgtgagatacacatgtctgaatcggctctttctatatttttcaaggg

SEQ ID NO: 1256 - DNA, 1424 bp, Aquilegia formosa
gtagataaagagggttcgttcaagcagaaaaactttacatgaacaactgaagaagaaagagtagaattgaattgatcacttccttccattaatgcatttcatctaaacaaactgtcttcgttttttttttttttttgtttttttttttttcaatcgcattcctaactactagtctactactagtattaattctttgcaatggcaatagtgccacgtgttacatttccatcaaacctctctgcttataaatgctctagctctcttccagaaatttctactggcttttcttctcaaaacaaattgagaacaagtagagtaatagtagcaatggccaccgattcatcatctcgaagcactgttcttgttactggagctgctggtagaactggtcaaattgtttataagaaattaaaggaaagagtagatcaatatgtagcaaggggattggttagaacggaagaaagcaaggagaaaatcggtggtgctgatgacgtttttcttggggatataagggatgctgagagcattactcctgctatacaaggtattgatgctctcgtaattcttacaagtggtgtgccaaagatgaagcctggatttgatcccagcaaaggtgggaggcctgaattctattttgaagaaggagcttatccggagcaggttgactggattggacagaagaatcaaatagatgcagctaaagaagctggagtgaagcagattgttttggttggatccatgggtgggacggatcttaatcatccactgaacagccttggcaacggcaatatactggtttggaagagaaaggctgagcaatatctagctgattctgggataccatacacaattataagagctggaggtttacaagataaagaagggggcttacgggaattaatcgttggcaaagatgatgaacttcttcagactgaaaccagaactattgcaagggcagatgttgcggaagtttgcattcaggctttgcagtttgaggaggcaaagttcaaggcattcgacctggcctcaaaaccagagggaactggagaaccaaccaaggatttcaaggctctcttctcaaaaattgctgcacgtttttgagagtattggctttcatcatctgtttcaactttcaccgaaaggttcagcacttaagagggtaaaggaattataaaagaaccagtatgtgagcttattttgttatgattatcatttcaataaaatgctgtgaaaaacccaacactcgagcaggtggatgatcacctcgattaaatgctcaaatggagtaccacaaatatagtagattttcctgttaaagtttcaatgaacccaaaacatggagtctaaggttgtttacaactttgatggtcccttccactgaaagggtgttcattgagaatgatgcgcatgtaaaacaccatagt

SEQ ID NO: 1257 - DNA, 1409 bp, Aquilegia formosa
gtagataaggagggttcgttcaagcagaaaaactttacatgaacaactgaagaagaaatagtagaattgaattgatcacttccttccattaatgcatttcatctaaacaaactgtcttcgttttttttttttttttttttttttttcaatcgcattcctaactactagtattaattctttgcaatggcaatagtgccacgtgttacatttccatcaaacctctctgcttataaatgctttagctctcttccagaaatttctactggcttttcttctcaaaacaaattgagaacaagtagagtaataatagcaatggccaccgattcatcatctcgaagcactgttcttgttactggagctgctggtagaactggtcaaattgtttataagaaattaaaggaaagagtagatcaatatgtagcaaggggattggttagaacggaagaaagcaaggagaaaatcggtggtgctgatgacgtttttcttggggatataagggatgctgagagcattactcctgctatacaaggtattgatgctctcgtaattcttacaagtggtgtgccaaagatgaagcctggatttgatcccagcaaaggtgggaggcctgaattctattttgaagaaggagcttatccggagcaggttgactggattggacagaagaatcaaatagatgcagctaaagaagctggagtgaagcagattgttttggttggatccatgggtgggacagatcttaatcatccactgaacagccttggcaacggcaatatactggtttggaagagaaaggctgagcaatatctagctgattctgggataccatacacaattataagagctggaggtttacaagataaagaagggggcttacgggaattaatcgttggcaaagatgatgaacttcttcagactgaaaccagaactattgcaagggcagatgttgcggaagtttgcattcaggctttgcagtttgaggaggcaaagttcaaggcattcgacctggcctcaaaaccagagggaactggagaaccaaccaaggatttcaaggctctcttctcaaaaattgctgcacgtttttgagagtattggctttcatcatctgtttcaactttcaccgaaaggttcagcacttaagagggtaaaggaattataaaagaaccagtatgtgagcttattttgttatgattatcatttcaataaaatgctgtgaaaaacccaacactcgagcaggtggatgaccacctagattaaatgctcaaatggagtactacaaatatagtagattttcctgttaaagtttcaatgaacccaaaacatggagtctaaggttgtctacaactttgatggtcccttccactgaaagggtgttcattgagaatgatgcgcatgtaaaacagcatagt

SEQ ID NO: 1258 - DNA, 1343 bp, Populus trichocarpa
agggtttggtcggcaacaagcacaaacaatttaacggcccaaaataattaattgagctgttctccgatggaaacaaactcaacgtctcaaagccagtacgagtaatataaaatcgttatgacaaccaccgtcaccgtgacacgtgttccattgattttctccggtcattttcttaataataaaaacgggcgtgcttcacaatcggccgtacaccttttaggtagcattagcaatagcaatactagcagtgctagtcgtagctcattttcttcgtcactaacagcaacaacgcgcataaggagagcagggttcgctgtattagcttcaaattcaatggctccaagcattgtccttgtcactggagctggtggcagaactggttccatagtttataagaaactgaaggagaggtctgaacaatatgttgcaaggggtttggtaagaactgaagagagcaaggagaaaattggaggagctgaggatgtttttgttggggatataagggaatccaaaagcattgttcctgcgatccaaggaattgattctctgatcatcctgacaagtgcagtgccaaagatgaaacctgggtctgatccatccaaaggcaggcctgagttctattttgaagatggagcatttcctgagcaggttgactggattggtcagaaaaatcaaatagatgctgctaaggccgcaggagttaagcaaattgtgctggttggatctatgggtggaacaaacctaaatcatcccttgaacagtttgggtaatgggaatatactggtttggaagagaaaggctgagcagtatttggccgactctggtgttccatacacaattctaagggctggaggcctgcaagacaaagaaggaggtgtccgagaattacttgttggaaaagatgacgagcttcttcagacagagacaagaaccattgccagagctgatgttgcagaagtctgcattcaggcactacagtacgaagaggctcaatttaaggcatttgatctggcctcaaaaccagagggaactggcaccccagccaatgattttaaggctctcttttctcaagtcactgctcgtttttgatttgtgaagggcattactacatgagatttatgtgcctagtttccttcaatgttgttcgtcaagtattttgaattatggataagtgtgtttccaaggattttaaactgtagatcttttcctttccctttgcaataacgtatgaaaagaccagttaacgcaggtaaaacataaattgatgtatgaaatacaagatgtataacgttggattataaagtcaagtcttaaattaatacaacttctttgcatgcttgtga

SEQ ID NO: 1259 - DNA, 1352 bp, Citrus sinensis
aacaaccaatcaacctacctgattgattaacggctacgaaggaaaaaggaagggcagttgcgcgtcgctcgtcacagtttcgctcctgtgattgactgacggccggatggacaagtaagctaattcttgatcaatggctacgcttacacgcgtcacattcatttccgcatcgtcaccatcaggcagcattggtcactctcgtaataaatgccgtcaggtggcgtcatcaataccattcctcaacagccttccagaattttcttctcacgctttccgcgctcgctattctccttcttcactaacatcacttccgagaacgagataccgaaggagttgcgtcagtaaaaccgaagcagtcaaagttttatcgatggctaagagtaccgttcttgtcaccggcgctggtggtcgaaccggtcaaatagtttataagaaattaaaggagaggtcagagcaatatgctgctagaggtttggtcagaactgaggagagcaagcagaaaattggcggagctgatgatctttttattggtgacataagggactctaatagcatcattcctgcaatccaaggaatcgatgctctcataattctcacaagtgcagtaccaaagatgaaacctgattttgatcctgccaaaggtggaaggcctgagttctactttgaagagggtgcatatcctgaacaggttgattggattggtcagaaaaatcaaattgatgctgctaaggctgctggagtgaagcaaattgtgttggttggatcgatgggaggaacaaatcttaatcatcccttgaacagtttgggcaatggcaatatattggtttggaaaagaaaggctgagcagtatttggctgactctggtattccatacacaattataagggccggaggccttcaggataaagaaggtggtatccgagaattgcttgtcggtaaggatgatgaacttcttcagacagaaacaaggacaattgccagggccgatgttgccgaagtctgcattcaggcactacagtttgaggaggccaaatttaaggcatttgatctggcctcaaagcctgagggaactggcacacccacaaaggattttaaagctctcttttctcaaattactactcatttctgagtctcagtcgccattctcctcctgagtttttatgttagaaaactgtaatgccttgtattaaaaaggggaatgaataaatgaatgccgaagatttctaaaagctggtgtaaaacaattttatgcgaaagatattcgccgcacttgcattggattgttgtctattggtattggaacttttcacatggatgaatagagtggattcggcgcttttgattttcaagct

SEQ ID NO: 1260 - DNA, 2199 bp, Prunus persica
ccaaccaaccaactaaagccggtgcattaacggctaccagcgaagaacgaagccctctctctctgtcagtctcgctgagctggttgcaaaattgcaattgtgaccgggggggtgtatggaaactggtccgtacaactaagtttttggtctcatcagaaatggcaacggtggcagtggcaccacgtgtccccttggtgatctcaaatattaattcgtccgtcaatgtcataaatgtagttgggtggcacatccagaaagttcgagcctttattttcattattcgacttcattttctgcttcatccgtgtttgtccagagaagggtgagaaagggttttaggagtgtacgagtgatcacaaaggcgatggcggattcgggtccaagcacagtccttgtcactggagctggtggtagaactggtaaaatagtttataagaagttaagggaggcagaccagtatgttgctaggggtctggttaggacagaagagagcaaagagagcattggtggagcagatgatatttttattggagatataagggatgccaacagcattctacctgcaattcaaggcattgatgctctcgttatccttacaagtgctgtgccaaagatgaaacctggatttgatccaaccaaaggtgggaggcctgaattctattttgacgatgggtcatatcctgaacaggttgattggattggacagaaaaaccaaatagatgctgctaaggctgcgggagtgaagcaaattgtgttagttgggtctatgggtggaacagatattaataatcccctcaatagcttgggtaatgggaatatattggtttggaagaggaaggctgagcagtatttggctgactctggtgttccatacacaatcataagggctggaggcttgcaagataaagaaggcggtatccgtgaactactgattggaaaggatgatgagcttctgaagacagaaacaagaaccattgccagagctgatgttgcagaagtctgcattcaggcactacagttcgaggaggccaagtttaaagcatttgatttggcctcaaagcctgagggaactgggacaccaaccaaggatttcaaggctctattttcccagatcactactcggttctgattttctgcagataccttgttggtctgggaacaatattatatcctatcaagttttattttagagcatctactttcagttttggattgtaatgccaaagagaagatatccctttatgggtgtgtttattaaaaataaaaaaaaactgggaaagaacggcagaaaataaactagcatattaagatgtttatcagtgaaacaatgttaaagagtatgcatcccctagttttatatggtcgtctagcattttatttgggttgcctgagcttgtctgataataatttatcgtgaatggagtgtaagatcaagtggcggtgttatggtctcacctgaaaattactcaaaaggtttgtattcaaataaagaaaagaaaaagaacattagaggataaaacccattatattttcctttattattgtttctttttcctctttagtttttcagtaatggattggaagtttactctgcatcggctaggcgctagtaaattgataaattgctttttgggccagttatgtgggttctgggtcgatgcctgacttgagcagctcaaaggttcgaaaaattggcttaggcgccgcctgggcgctaggcgctagtgaatggtgatatgataaagtggtgcaaaaaggaaatgtggtgtaaataataattgagatatttagtcatatatttatttttagcaataaaattataaataatttttacatcatttaatttttataaataaatttaaaaaatgaaacttgattttattaaatttaattttgattattaaattactttgatactttattgagtgttttgggcttttttatgaggttttggagttgagtttgttttaagaaatcaatgatagttttgtaatttaaaagaacttaaaagcctttttgttatgttgtaaatgagctttgagaaattgaatgtatttctaaagtctatttaatataagatatttttataatttggactcttatattaagtataaaagtgaatctcccataataatttaataaacatgccaaatgacgccgtagccgcagctatatagtaaagtggtgcaaatatttcaa

SEQ ID NO: 1261 - DNA, 1339 bp, Ricinus communis
agctaagttaacggctacgacagtgaagcagaagcaaaaacacaagcgtagcatttatctcaccgtcgcaaactctccggcgatacgcatatggaaaccactacagtacttattcaattctaacaaccaaccaactaactaactagaagagtccacatccaatggcaacagcaacacgtgtcccaattcgtttccctaataataaatacgcttgcgtggcaccatcctcacccttgttctacctaccttgtacagcatttacttcgtttccacttccagagtcttctgctctctcttttccttcactctcaaaaacacacaattgcaaagctggttttaggaaattagtagcggtttcagcgtcaatgacggattccacttcaagcactgtccttgtcaccggagctggtggtagaactggttcaatagtttataagaaattaaaggagaggtctggccaatatgttgcaagaggtttggtcaggactcaagagagtaaggataaaattagcggagcagaggatgtttttattggcgatataagggaaaccgaaagcattgttcctgctatccaaggaattgatgctctcattattctcacaagtgcagtgccaaagatgaaacctgggtttgacccaactaaaggcggaaggcctgagttttattttgaagacggagcatatcctgaacaggttgactggactggtcagaaaaatcaaattgatgctgctaaggctgcaggagtaaagcaaattgtgttggttggttctatgggtggaacaaatcttaatcaccccttgaacagtttgggcaatgggaatatattagtctggaagagaaaggctgaacagtatttggctgactctggcattccatacacaattataagggccggaggactacaggacaaagaaggaggtgtgcgagaattactcattgggaaggatgatgagcttcttcagacagagactagaaccattgctagggctgatgttgcagaagtctgcattcaggcattgcagtttgaggaagctaaatttaaggcatttgacctggcctccaagccagaggggaccggcagtccgaccaaagattttaaggctcttttttcccaagtcactacccgattttgattcttactggaccattatcattggtcttggattattgctgtctttctgtgctttaaatcagaatgttgtgtttgctttcaatattgtaatacccttcagttgattaggagaaagagcatgatcagaggatcaagcatatcagctgtctttctataactagcaataaaatgatgcattattttgagcaagctaaattgacagaaaca

SEQ ID NO: 1262 - DNA, 1119 bp, Tragopogon dubius
gtcgggggatcatccattggatagctccatggcttctctcacacgtgtccttctacctacatcttcacaatttcctcgtcaatgtaccacttctaccaccaccaaaactaataccatttctaccaaaaccaccaggagattctcggttttctcaatggcggaatccaaccgcagcaccgtcctcgtcaccggagctggtggcagaactggtcaaattgtttataaaaagttgaaggagaggtcaaccgagtatattgcaagaggtctagttagaaccgaagaaagcaaggagaaaattggtggagcagatgatgttttcattggtgacataagaaatacagaaacttttcttccagccattcaaggcatagatgctcttgtaattctaacaagtgcagtccctaaaatgaaacctggtttcgatccaagtaaaggaggaagacccgaattcttttttgaagaaggatcataccctgaacaagttgactgggaagggcaaaaaggtcaaatagatgctgctaaagctgctggagtgaagcaaattgttcttgttgggtccatgggtggaacaaatattaaccaccctttaaacagcctgggaaacgggaatatattggtgtggaagagaaaggctgaacagtatctagcagactctggaattccatacacaattataagggctgggggtttgcaagacaaggaaggtggagtccgggagcttcttattggaaaagatgatgaacttcttcaaactgaaaccaaaaccgtcgcaagagcggatgtagccgaagtctgtattcaggcgttgcaaattgaggaggcgaaatgtaaggctttcgatcttgcctccaaacccgagggaagtggaacaccgacaaaagactttaaggcattattttcccaaatcaccactcgattttaaggttccaatacacgattgttcattataagaattggcatagtcgatgctggtgaggatgaggtgtaataatttcggatatttagttcgatgttattattgagtattgttgtatttatgttccaaatcatcactcggttttaatttattttggagagatttgcagaaaatggtcaaaagttcgaatctttgcaatcgta

SEQ ID NO: 1263 - DNA, 1468 bp, Citrus sinensis
gcagcgcgtggtaaaaaattggtgagtggaaaaaacttacgacaagagataaggtgacatcagagagaagaggataagaaaatcaatgtaacaaccaaccaaccaaccaacctacctgattgattaacggctacgaaggaaaaaggaagggcagttgcgcgtcgctcgttacagtttcgctcctgtgattgactgacggccggatggacaagtaagctaattcttgatcaatggctacgcttacacgcgtcacattcatttccgcatcgtcaccatcaggcagcattggtcactctcgtaataaatgccgtcaggtggcgtcatcaataccattcctcaacagccttccagaattttcttctcacgctttccacgctcgctcttctccttcttcactaacatcacttccgagaacgagataccgaaggagttgcgtcagtaaaaccgaagcagtcaaagttttatcgatggctaagagtaccgttcttgtcaccggcgctggtggtcgaaccggtcaaatagtttataagaaattaaaggagaggtcagagcaatatgctgctagaggtttggtcagaactgaggagagcaagcagaaaattggcggagctgatgatctttttattggtgacataagggactctaatagcatcattcctgcaatccaaggaatcgatgctctcataattctcacaagtgcagtaccaaagatgaaacctgattttgatcctgccaaaggtggaaggcctgagttctactttgaagagggtgcatatcctgaacaggttgattggattggtcagaaaaatcaaattgatgctgctaaggctgctggagcgaagcaaattgtgttggttggatcgatgggaggaacaaatcttaatcatcccttgaacagtttgggcaatggcaatatattggtttggaaaagaaaggctgagcagtatttggctgactctggtattccatacacaattataagggccggaggccttcaggataaagaaggtggtatccgagaattacttgtcggtaaggatgatgaacttcttcagacagaaacaaggacaattgccagggccgatgttgccgaagtctgcattcaggcactacagtttgaggaggccaaatttaaggcatttgatctggcctcaaagcctgagggaactggcacacccacaaaggattttaaagctctcttttctcaaattactactcatttctgagtctcagtcgccattctcctcctgagtttttatgttagaaaactgtaatgccttgtattaaaaaggggaatgaataaatgaatgccgaagatttctaaaagctggtgtaaaacaattttatgcgaaagatattcgccgcacttgcattggattgttgtctattggtattggaacttttcacatggatgaatagagtggattcggtgcttttgattttcaagcttctcctaaggtaagatcaa

SEQ ID NO: 1264 - DNA, 1329 bp, Glycine max
tgacgaaaccaaacgtatcaataacacaacattgctgaagaagttgaaaggtcgcatccttccttcattcgtttcgttgagttgaaaactctttttccacattcttttatttcttgtctcacccgcaccatgcaagtgtgccaactactgtgattggtatggcgacacgtgtcccttttgttttgtgcgcagccaccacttctcccaaccactgccttaaatactgcgtggtggcaccgtcacttcctctaccggtttcttcctcctcattaagccgccactttctctctctttccttttcgtcttctttttcttcttcgttgggtttgttgccacttagtaagaaagagggtgtgaagagagtggggagaagatttggtgttgtggccatggcggagtctaagagtactgtgcttgttacgggagcgggtggtcgcacaggacaaatagtttacaaaaaattaagagagaggccaaaccaatatgtggctagaggtctggttagaacagatgaaagcaaacagaacattggtgctgcagatgacgttattgttggggatataagagatgctgaaagtattgttcctgcaattcaaggtatagatgccctcataatcctcacaagtgcagttccacagataaagcctggttttgatccaaccaaaggacaaagaccagagttctattttgaggatggggcatatcctgaacaggttgactggattgggcagaaaaatcaaatagatgtcgccaaggctgctggagtgaagcacattgtgttagtagggtctatgggtggaacggaccttaaccatcctttgaacagcttgggtaatgggaatatattggtttggaaaaggaaggctgagcaatatctggctgattccggcatcccatatacaattataagggctggtggcttgcaagacaaagatggaggtcttcgggaactacttgtagggaaggatgatgagcttctccagactgaaaccagaaccataagtagatctgatgttgcagaagtctgcattcaggcactaaattttgaggaggctaaattcaaggcatttgacttggcatcaaaacctgagggagcaggttcagcaacaaaggatttcaaggctttattttcccagatcaccactcgcttttgatttttgaatgttgttgtcatggtcccaaaatccttgtggattgaaccatatgggtattagtgctatctgaaacaaaatttaattttagtaaaggattgttttaaggcaaattatagacttcactagtactgtacctgcacgccttgagaaaaacaaatgtcttctaatcagcaca

SEQ ID NO: 1265 - DNA, 1368 bp, Glycine max
gaaaccaaacgtatcaataacacaacattgctgaagaagttgaaaggtcgcatccttccttcattcgtttcgttgagttgaaaactctttttccacattcttttatttcttgtctcacccgcaccatgcaagtgtgccaactactgtgattggtatggcgacacgtgtcccttttgttttgtgcgcagccaccacttctcccaaccactgccttaaatactgcgtggtggcaccgtcacttcctctaccggtttcttcctcctcattaagccgccactttctctctctttccttttcgtcttctttttcttcttcgttgggtttgttgccacttagtaagaaagagggtgtgaagagagtggggagaagatttggtgttgtggccatggcggagtctaagagtactgtgcttgttacgggagcgggtggtcgcacaggacaaatagtttacaaaaaattaagagagaggccaaaccaatatgtggctagaggtctggttagaacagatgaaagcaaacagaacattggtgctgcagatgacgttattgttggggatataagagatgctgaaagtattgttcctgcaattcaaggtatagatgccctcataatcctcacaagtgcagttccacagataaagcctggttttgatccaaccaaaggacaaagaccagagttctattttgaggatggggcatatcctgaacaggttgactggattgggcagaaaaatcaaatagatgtcgccaaggctgctggagtgaagcacattgtgttagtagggtctatgggtggaacggaccttaaccatcctttgaacagcttgggtaatgggaatatattggtttggaaaaggaaggctgagcaatatctggctgattccggcatcccatatacaattataagggctggtggcttgcaagacaaagatggaggtcttcgggaactacttgtagggaaggatgatgagcttctccagactgaaaccagaaccataagtagatctgatgttgcagaagtctgcattcaggcactaaattttgaggaggccaaattcaaggcatttgacttggcatcaaaacctgagggagcaggttcagcaacaaaggacttcaaggctttattttcccagatcactactcggttttgatttttgaatgttgttgtcatggtcccaaaatccttgtggattgaaccatatgggtattagtgctatctgaaacaaaatttaattttagtaaaggattgttttaaggcaaattatagacttcactagtactgtacctgcacgccttgagaaaaacaaatgtcttctaatcagcacatcatttcatgttatcaagtgtaattgtttgcaattccatccta

SEQ ID NO: 1266 - DNA, 951 bp, Raphanus sativus
aatgggcttcggagtaagtcaatttggttgagtgagagtcttgagaaaattatagagagcatccagagagtttcttcttcaatggcgaaccctcccaccgttctcgttaccggcgctagtggcagaacaggccagattgtgtacaagaagctgaaggagaggtcagacaagtttgtggcgaagggtttagtgagaactcctgaagggaaagacaagatcggaggagaagctgatgttttcattggtgatataagggatgctgatagcattacccctgctgttcaagggatcgatgcgcttgtgattctcactagcgctgtccccaaaatgaaacctggttttgaccccactaaaggtggaagacctgagttcatcttcgatgatggacagtaccctgaacaggttgattggattggccagaagaaccaaatagatgctgccaaggttgctggtgtgaagcatattgtcttggttgggtccatgggtggaacaaatccggatcatcctttgaacaaactgggaaatgggaacatactggtttggaagaggaaagctgaacagtaccttgctgattctggaactccgtacacaataatcagagctgggggacttctagacaaagaaggaggtgcacgagagctcctagttggtaaagatgacgagcttcttcaaacagacactaaaaccgtccccagggctgatgttgctgaagtctgcattcaggcattgctgttcgaggaagcaaagaataaagcttttgatctgggctcaaagccagagggaacgagttctcctactaaagactttaaggctctcttctctcaagtcaccgctcgtttttaaaatcttttatcgctactgaatcatttgggatgtaatgtaccaaaccagttaaaataaaatatccgggtacactatgagtagaatcaataaaaataagggttgttcttc

SEQ ID NO: 1267 - DNA, 1098 bp, Artemisia annua
taacacattatgtttcaaccctttaataaaatctaacaacaacacaaccagaagaacattatcagtagttgttttgtcgatggctgaatccaaccgtaccactgtcctcgtcaccggagccggtggcagaactggtcaattagtttacaagaagctcaaggagaggtcaagcgagtatattgcaagaggtcttgttagaagtgaggagagtaaaacgaaaattggtggagcagatgatgttttcattggagacataacgaaacccgacactcttgctcctgctattggaggcatagacgctcttgtgattctcacaagtgcagttcctaaaatgaaacctggtttcgatccaactaaaggaggaaggcccgaattctattttgaggagggacaataccctgaacaagttgactgggaaggacagaaaagtcaaattgatgctgctaaagctgccggagtgaagcaaattgttctggtcggttccatgggcgggacaaatattaaccatcctttaaacagcttaggaaacgggaatatactggtttggaagagaaaggctgaacagtatctagcagactccggtattccttacacaattatcagggcggggggtttgcaagacaaggaaggtggtatcagggaattgcttattggaaaagatgatgagcttcttcaaactgaaaccaaaactgttgccagcgctgaagtttgtgttcaggcactgcaaattgaggaggcgaaattcaaggcatttgatcttgcctccaaacctgagggaactggaacgccaacaaaagatttcaaggccttattttctcaaatcacaactcggttttgaggtacaacatctttaaaaattgtgttccgttaagggacttatcaatatacactaagcattgcaagatatggatgagctgtaataatttcggatattttctattctagccgaaatacatgttctgtatgaggatgtattcagtatttttgtattagtatatgtccttgcattatctttgtgctttgttatagcactatgtacacggcttgcttgctgtagcatttggtttggcctgcactaataaagatttgaacttatcg

SEQ ID NO: 1268 - DNA, 894 bp, Persea americana
cagagtttgagcagcgatggcggatgctcctctacccactgttctggttactggagccggtggcagaacagggcatattgtttacaagaagttgaaagaaagaacagaccagttcattgcaaggggccttgtcaggactccagagagtaaggaaaaaatcagaggaggtgatgatgtttttgtgggggatataagggatgctgaaagtattgttcctgctgtccaaggtatcgacgcactcataattctcacaagtgccatggtgaaggtgagaccatcttctgatccaagcaaaggtggccgagagttctattttgaagatggggcgtaccccgaacaggtggattggattggacagaaggatcaaatagatgctgctaaaagcgcaggagtgaagcacattgtataggttggatctatgggtgggacaatccctaatcatcctttgaacagctttgggaacgggaatatattggtgtggaaacggaaatctgaacaatatttggcagactctggagtaccatacacaattataaggcccggaggtttactcgacactgaagggggtctgcgagagttacttgttgggaaggatgatgagcttctgaagaccgaaacaaaaaccattcctcgtgctgatgtagcagaggtttgtgttcaggcactgcaatttgaagaggcaaaattcaaggcattcgatctggcatcaaagcctgagggcacgggtacacccacaaaaaattttggggcaatcctctcacaagtatctgctcgtttttgagagctaataactacaatcacagtacagctaacaatacctacttttatttgtaataattgcctagttaagaaaatttgtgtatgaacctctcagttggagaaactcataattat

SEQ ID NO: 1269 - DNA, 1161 bp, Brassica juncea
gatcgtctgagctttaccaaactccagtcaatggcgatgacgacgacgacgacattcttccattcactacttccttccaacagctacaagacaggatctgtgtcctcttcgttcgtctcagttccgtcttcttcttcgtcgtctctccaattccgctcgcttgtttcagacacgaagtcgatctacggtcggatgaagtttaccggaaatatcagaagagtatccgtaactgtctccgccgtcgcatcagctgagcctctcaccgtcctcgtcaccggtgccggtggaagaacagggcaaatcgtgtacaagaagttgaaggagaggtctgatcagttcgtggcgagaggtttggtgaggacgaaagagagcaaggagaagatcggtggagaggacgatgtgttcatcggagacattcgagacactgaagccattgctcctgctatacaagggattgatgctttggtcattcttacaagcgctgtaccgaaaatgaaacctggttttgatcctagcaaaggagagagacctgagttctactttgaagaaggagcttatcctgaacaggttgattggattggtcagaagaatcagatagatgctgctaaggcagcaggagttaagcagattgttttggtcgggtcgatgggaggaacaaacataaacaaccccttgaataaaattggcaatgccaacattctggtttggaagaggaaagctgagcagtacttggctgactccggtattccatacaccatcatcagggcgggcggtctgcaggacaaggaaggtggcattcgagaattacttgtgggaaaagatgacgagattcttgagacagaaatgagaacaatcgcaagggctgatgttgcagaagtctgcgttcaggcgttgcagctagaggaggcaaagtttaaagcacttgatctggcctcaaagccagagggaacaggcaccccaacaaaggatttcaaggcacttttcgctcaagttaccgctaggttctgatctgctgttactttgtccttgtaggcagagtcataggataagagactgagagggataataagttcattatgtgagagatgatacacatatctgaatcggctctttctatatttctcaaagggtcttctctaagtaatatcaaaagccttttgt

SEQ ID NO: 1270 - DNA, 1420 bp, Vigna unguiculata
gtatgacaaatctaacacacattaaagctcaacgaatactgaggcgcgacaaccaccccaacagtgtctggtctccgcagtgaccgtaattgcatcatccattgttctaaagttctaaacttttcaccattcttttcttctctaaccttcgccaccatgcaactgtgtcaactactatgatgggtatggcaacacgtgttccccttttctgcgctgccacctcccctaatcaatgccataaatactgcgcgctgccaccggtttcttcctcttcattaaggcttcgcgctatctctctttcttcttcttctttgggtttcttttctcttgccaagaagaggaacgaggaggctgtgaagagggtgacgagacagtttggtgttgtggccatggcggagagtcccaatagtactgtgcttgtcactggagctggtggtcgcacaggacaaatagtttacaaaaaattgaaagagaggccaaaccagtatgtggctagaggtttggttagaacagaagaaagcaaacagaacattggtgctgcagaggacgtttatgttggggatataagggatgccggaagtcttgttcctgcaattcaaggtatagatgctctcataatcctcacaagtgcagtgccactgataaaacctgggtttgatccaaccacaggacaaagaccagagttctattttgaagatggtgcatatcccgaacaggttgactggatcgggcagaaaaatcaaatagattctgctaaggctgctggagtgaagcatattgtgttggtagggtctatgggtggaacagaccttaacaatcctttgaatagcttgggtaatggaaatatattggtttggaaaaggaaggcagagcaatatctggctgattctggcatcccatatacaataataagggctggtggcttgcaagacaaggatggagggcttagggaactgcttgtagggaaggatgatgagcttctgaagacagaaaccagaaccataagtagagctgatgttgctgaagtctgcattcaggcactaaactatgaggaggccaaattcaaggcatttgacttgtcatcaaaacctgagggggctggttcaccaacaaaggacttcaaggctttattttcccagatcactactaggttttaattttgaatgttgttatcatggtccatagacccttcttgtctgcatttgggattgaaccaaatcatatttactttatttcttggcaatttattaaagaattgttttaatgcaaattatagacttcactgctactgcaggccttgagaaaaacaaatgtctagtaatcagaggatcatgctgtcactttcagcggatcatgtatattgctgaatgtttcaattgcatgatatgataaaattataaaagtagttttcttgggaaca

SEQ ID NO: 1271 - DNA, 1045 bp, Camellia sinensis
gaattactagtaggttccattttttcgcctttttatacccatttctttgacaatcgaagcatcgcaattaaagggttttccacagattcgtactgggtttgatcaacaatggcgaatttcaaaccaagcacagtccttgttaccggtgctggcggtagaacaggacaaattgtttataagaagttgaaggagaggacagaccagtatgatactaaaggtttagttagaagagaggagagcaaggagaaaattggtggcacagatatgtttttgttggggatataagggatgtagagagcataattcctgcaatccaaggtatcgattccctcataattctcacgagtgctgcgccaaaaatgaagcctgggttcgatttaggtaaaggtggaaagcctgagttttactttgaagatggtttatatcctgaacaggttgactggattgggcagaagaatcaaatagatgctgctaaagctgcaggggtgaagcacattgtgcttgttgggtcaatgggaggaacaaatcctaatcaccccttaaacagcttagggaatgggaatattttggtttggaagagaaaggctgaacagtatctggcggactctggagttccatacacaattataagggctggaggcttgcaggacaaagaaggtggtattcgagaattacttgttggaaaggacgatgagctccttaatacagaaacaaagaccgttactagggatgatgttgcggaagtctcgattcaggcactacagtttgaggaggttaaatttaaggcatttgacctggcctcaaagcccgagagagttggcactccgacaaaggatttcaaggctctgttttcccagatcactactcggttttgatatacaacattcatagctctatttatttggaaatatgttatccaatttcagattgtgactctggtttttgatctagaaaaggaataagtggaacgagaatgttaaccagttgcgaatggattttcaggagcttttgtatgtcattaaacaactatcaattgacaaataag

SEQ ID NO: 1272 - DNA, 1239 bp, Malus domestica
agctaccagtgaagaacaattcagcaaagctctctctctggcggagctggtggcagttgagtgacgaagggtgcatggaaactggtctgtacaactaagtcttgggtctcatcagtgacgatggcaacagtggcagtggccccacgtgtcccattggttatctcaaataatagcatccgtcaaagtcataaatgtagttgggtaggagctccacaaaattcgaccctttcttttcaatccacttcattttctgctgcatccttgtttatccagagaagggcgagaaggggttttgggagagcaggagttgtcacaaaggcgatggcggattcgggtgcaagcacagtccttgtcactggagctggtggtagaactggtaaactggtttatgagaagttaaaggagaggtcagaccagtatgtggcgaggggtctggttaggagtgaagagagcaaacagagcattggtggagcagatgatctttatattggagatataagggatgctgacagcattctacctgcaatccaagggatcgatgctctcgttatccttacaagtgctgtgcctaagatgaaacctggattcgatccaactaaaggtgggaggcctgagttctattttgaagacgggtcatatcctgaacaggttgattggattggacagaaaaaccaaatagatgctgctaaggctgcgggagtgaagcagattgtgttggttgggtctatgggtggaacggatcttaacaatcccctgaacaaattgggtgatggcaatatattggtttggaagaggaaggctgagcagtatttggctgactccggaattccatacacaatcataagggccggaggcttgcaagacaaagaaggcggcatccgtgaactacttatagggaaggatgacgagcttcttaagaccgaaacaagaaccattgctagacctgatgttgcagaagtctgcattcaggcactgcagttcgaggaggccaagtttaaggcatttgatttggcctcaaagccggagggaactgggacaccgaccaaggattttaaggctttgttttcccagatcacaacccgattttgatcttcggctaatatctgtaatgccaaagagaacatcttcccttgtgagttttgttttgtttgtactgggaaaaaaacagcagaaaaggagctagcatgtgtatgcagtttgaacaattttaatatgtaataaagggatcaaggaactagc

SEQ ID NO: 1273 - DNA, 969 bp, Coffea canephora
ttcgggaggcgccttcggatactttaatggccgattttaacaaaagcactgcccttgtcaccgggagatggtggtagaaccggacaaattgtttataagaaattgaaggagaggtcagaccagtatatcgccagaggtttagttaggactcaggagagcaaggagaaaattgggggagcggatgatgtttatgttggggatattaggaattttgacgccattgtacctcctatacagggtatcgatgcacttattattttgacgagtgctgtgcccaaaatgaaaccaggttttgatccaaccaaaggtggaagacccgaattctattttgaagatggagcttatcctgaacaggttgactggatcggacaaaagaatcaaattgatgcagctaaagctgccggagtgaagcacattgtactcgttgggtcaatgggaggaacaaatcctaatcacccactgaacagcttagggaatgggaacatactgatatggaagagaacggctgaacaatacctggcagattcggggatcccatacaccattataagagctggtggcttgcaagacaaagaaggtggtgtgagggagctacttattggcaaggatgatgagctacttcagttggaaacaagaacccttcccagggctgacgttgctgaagtcagcattcaggctgtacagtttgaggaggcgaaaaataaggcatttgatctggcctcaaagcccgaggggactgccgcacctacaaaggatttcaaggctttattctcccaagtcactactcgcttttgatgcattagtgtgaaaatctatatgactctggttgtatatttgtgacggattaaagttcagcagttaagcgtgcgagttgctattcaaactacaactgacgctcccaactgggctatcaatataagaaatgcaagctggaatatcgattggcttgtgaaaaaaaaaaaaaaaaaa

SEQ ID NO: 1274 - DNA, 1321 bp, Tropaeolum majus
cggccggggggtagaaacaagtagtaagaaagagctatccctttcagcttcatattattaccttatcctctcctgcactactgtaggatgaacaactagcaatttctactccattttccatccaatgccgatcttaacgttaacacatctcccctctctattttctgttacttcttcatccaaagcgtatagttcccgtccacttcacgattcttgcactttatctcctcactcgccttcttccattactcatacatcctcatttctcgttaatataaagtggagtagtaaggcttttaggagaaaacgactctcagttgcagcttcaatggctgatttgaatcctagcacagttcttgtaaccggtgctggtggtcgaacaggtcaactagtttataggaaattgaaggaaagaccagacaattttgttgcaagaggcctggtcagaaccgaggagagcaaggaaaaacttggtgcagctgatgatgtttttgttggggacataagggatgccagcagcattgtttctgcaatccaaggaatagatgctcttgtaattctgactagtgccgtgcctaaaatgaaacctgggtttgatcccagcaaaggtggaaggcctgagttctattttgaagatggagcatatcctgaacaagtcgactggattggtcagaaaaatcaaatcgatgctgctaaggctgcaggcgttaagcaaattgtcctagttggttccatggggggaacagatcttaataaccccttaaacaaattgggcaatgccaatattctggtttggaagaggaaagctgagcaatatttggctgattccggtattccatacacaatcataagagctggtggcctacaagataaagaaggtggggttagagaattgcttgttgggaaggatgacgaacttgttaagacagaaacaagaactatcgcaagggctgatgttgcagaagtctgcatccaggcactacagcttgaggaggcaaagtttaaggcatttgatttatcgtcaaagcccgagggaagtggtactccaactaaggattttaaggcactgttttcgcaagtcacttctcgtttctgatcctctattctacattggcattggacatcactgtattgtaggtcaacgactggtatctttaggtttattttagtatattacatgttgtattttcatgtttaaccctttcgagggatagtggtgttatgtatccaaggacaatgattcaggtttagtcgtttctacggaccagcatattaacgcaatcgagtattataccatacaactgaacacatcattggtaca

SEQ ID NO: 1275 - DNA, 1325 bp, Prunus persica
  misc_feature (642)..(642): n is a, c, g, or t
  misc_feature (1319)..(1319): n is a, c, g, or t
  misc_feature (1322)..(1322): n is a, c, g, or t
ggcacgagagccaaccagccaaccaacccagtgcattaacggctaccagagaagaacgaagccctctctctctgtcggtctcgctgagctggttgcaaaattgcaattgtgactgagggggtgtatggagactggtccgtacaactaagttttggtctcatcagaaatggcaacggtggcagtggcaccacgtgtccctttggtgatctcaaataataattgtagatttagcaacagtcgcagcgtccgtcaatgtcataaatgtagttgggtggcacatccagaaagttggagcctttcttttcataattcgacctcattttctgcttcatccttgtttgtccagagaagggtgagaaagggttttaggagtgtacgagtgatcacaaaggcgatggcggattcgggtccaagcacagtccttgtcactggagctggtggtagaactggtaaaatagtttataagaagttaagggaggcagaccagtatgttgctaggggtctggttaggacagaagagagcaaagagagcattggtggagcagatgatatttttattggagatataagggatgccaacagcattctacctgcaattcaaggcattgatgctctcgttatccttacaagtgctgtgccaangatgaaacctggatttgatccaaccaaaggtgggaggcctgaattctattttgaagatgggtcaaatcctgaacaggttgattggattggacagaaaaaccaaatagatgctgccaaggctgcgggagtgaagcaaattgtgttagttgggtctatgggtggaacagatattaataatcccctcaatagcttgggtaatgggaatatattggtttggaagaggaaggctgagcagtatttggctgactctggtgttccatacacaatcataagggctggaggcttgcaagataaagaaggcggtatccgtgaactactgattggaaaggatgatgagcttctgaagacagaaacaagaaccattgccagagctgatgttgcagaagtctgcattcaggcactacagttcgaggaggccaagtttaaagcatttgatttggcctcaaagcctgagggaactgggacaccaaccaaggatttcaaggctctattttcccagatcactactcggttctgattttctgcagataccttgttggtctgggaacaatattataccctatcaagttttattttagaacatctactttcagttttggattgtaatgccaaagagatgatatccctttatgggtgttttaaaaaaaatataaaaaaactgggaaagaacggcaganaanaaa

SEQ ID NO: 1276 - DNA, 1576 bp, Triticum aestivum
cccctgccccagtcacaaagctccttccttttcctcgtgcccgccttctcctcccctgcaattctttctctgttccgctgtaaaggcggagcggcctggaacagggttgttggatctgagccagtgaaggagtggccgactgcctctgcgacctctcgccgccagccgcaggcagatgctgcccaccggcaggagcaggcctcagcccaggcctgcgcccagatcttggtccttctcagacatggacctctctgatccgaagcgcaactccagatacctcagcaagatcatcatggtcgcgctcctcacggccatgtgcgtcgtcatgctcacccagccgccctgccataggaaggctcccagcgtgttctccatccatgaactcggagtaacgcatgtgttggtgacgggtggcgctggctacataggatcgcacgcagctcttcgactgctcaaagactccttcagagtcaccattgtggataatctttcaagaggaaatattggggcggtcaaggttcttcagaacttgtttcctgatcctggacgattgcagttcatacatgctgatttaggcgatccaatagctgttaacagaatattcgcagaaaatgcatttgatgccgtcatgcacttcgctgccgtagcgtatgtgggtgagagcacgcttgagcctctgaggtactatcataacatcactgcaaacactttggttgtgctagaagccatggcgacgcacaatgttaaaaccctgatctactctagcacatgtgccacctacggggaacccgagaagatgcctatcactgaagaaactccccagtttcctataaacccatatggcaaggccaagaaaatggcagaggatatcattttggacttctccaagtcgaggaaatcagacatgtcggtgatgatcctgagatacttcaacgtcatcggctctgaccctgaaggaaggctgggtgaggctccaccacccgaactgcgtgagcatggccgtatatccggtgcatgcttcgacgcggcactgggaataatcccgggtttgaaggtcaaaggtaccgactacgaaacggccgatgggacttgcgtgagagattacatcgatgtcaccgacctggtcgatgcccacgtgaaagcgctcaacaaggcggagagaggcaaagttggcatatacaatgttggcaccggaagagggaggtcagtgaaggagtttgtggaggcttgcaagaaggcgaccggagtcgacatcaaggtcgactacttccctcgccgcccgggtgactacgcggaagtgtacagcaaccctgcaaggatcaaccgcgagctgaactggacagcccagcacaccgaactccaggagagcctcagggtggcgtggacatggcagaagaagcaccggagtggctatgcagactcgggtcgatatattttttgactcgttcacagagatagcagttacacataatttatatagcgtgtatggtcatttgttcaattcctgtgattttattatatttatatgtgggaagttcacccagttggttataaatatcgatatgttctttcactg

SEQ ID NO: 1277 - DNA, 1508 bp, Triticum aestivum
ctttctctgttccgctgtaaaggcggagcaacctggaacagggttgttggatctgagccagtgaaggagtggccgactgcctctgcgacctcccgccgccagccgcaggcagatgctgccgaccggcaggggcaggcctcagcccaggcctgcgcccagatcttggtccttctcagacatggacttctctgatccgaagcgcaactccagatacctcagcaagatcatcatggtcgcgctcctcacggccatgtgcgtcgtcatgctcacccagccgccctgccacaggaaggctcccagtgtgttctccatccatgaactcggagtaacacatgtgttggtgacgggtggcgctggctacataggatcgcatgcggctcttcgactgctcaaggactccttcagagtcaccattgtggataatctctcaagaggaaatatcggggcggtcaaggttcttcagaacttgtttcctgatcctgggcgattgcaattcatacatgctgatttaggcgatccaaaagctgttaacagaatattcgcagaaaatgcatttgatgccgtcatgcactttgctgctgtcgcgtatgtgggcgaaagcacgcttgagcctctgaggtactatcataacatcactgcaaacactttggttgtgctagaagccatggcgacgcacaatgttaaaaccctgatctactctagcacatgtgccacctacggggaacccgagaagatgcccatcactgaagaaactccccagtttcctataaacccatatggcaaggccaagaaaatggcagaggatatcattttggacttctccaagttgaggaaatcagacatgtcggtgatgatcctgagatacttcaacgtcatcggttctgaccccgaaggaaggctgggtgaggctccaccacccgaactgcgtgagcatggccgtatatccggtgcatgcttcgacgcggcactaggaataatcccaggtttgaaggtcaaaggtaccgactacgaaacggctgacgggacttgcgtaagagattacattgatgtcaccgacctggtcgatgcccacgtgaaagcgctcaacaaggcagagagaggcaaagttggcatatacaatgttggcaccggaagaggtaggtcagtgatggagtttgtggaggcttgcaagaaggcaaccggagtcgacatcaaggtcgactacttccctcgccgccccggtgactacgcggaagtgtacagcaaccctgcaaggatcaaccgcgagctgaactggacagcccagcacaccgaactgcaggagagcctcagggtcgcctggacatggcagaagaagcaccggagtggctatgcagactcgggtcgatatattttttgattcgctcacagagatagcagttacatataatttatatagcgtgtatggtcatttgttcaattcctgtgattttatatttatatatgtgggaagttcaccagttggttataaatatcgatatgttctttca

SEQ ID NO: 1278 - DNA, 1577 bp, Hordeum vulgare
ttcggcacgaggcctttccgttcccactcccacgattcactctgccccctccttcctccccctgccacggtcacaaagctccttcctttttcccgtgtccgccttcctccactcccgcaattctttccctgttccgctgctgtaaagggcagggcggagcagcctggaacagggttgttggatctgactatctgagccagtgacctctcgccgccagccgcgggcagatgctgccgaccggcaggagcaggccgcagcccaggcctgcgccgagatcttggtccttctcagacatggacttctcggacccgaagcgcaagtccaggtacctcagcaagatcatcatggtggcgctcctcacggccatgtgcgtcgtcatgctcacccagccaccctgccacaggaaggctcccagtgtgttctctatccatgaactcggagtaactcatgtgttggtgacgggtggcgccggctacataggatcgcatgcggctctacgactgctcaatgactctttcagagtcaccattgtggataatctctcaagaggaaatatcggggcggtcaaggttcttcagaacttgttccctgatcctgggcgattgcagttcatacatgctgatctaggcgatgcaaaagctgttaacagaatattcgcagaaaatgcatttgatgctgtcatgcactttgctgccgttgcttatgtgggcgagagcacgcttgagcctctgaggtactatcataacatcactgcaaatactctggtcgtgctagaagccatggcgatgcacaatgttaaaaccctgatctactctagcacatgtgccacctacggggaacccgagaagatgcctatcactgaagaaactccccagtttcccataaacccgtatggcaaggccaagaaaatggcagaggatatcattttggacttctccaagtccaggaaatcagacatgtcagttatgatcctgagatacttcaacgtcatcggttctgacccagaaggaagactgggtgaggctccaccacctgaattgcgcgagcatggccgtatatctggcgcatgcttcgacgcagcactaggaataatcccaggtttgaaggtcaaaggtaccgactacgaaactcccgacgggacttgcgtgagagattacatcgatgtcaccgacctggtagatgcccacgtgaaagcgctcaacaaggcggagagaggcaaagttggcatatacaatgttggcaccggaagaggtaggtcagtgaaggagtttgtggaagcttgcaagaaggcgaccggagtcgacatcaaggtcgactacttcccgcgccgccccggtgactatgcggaagtgtacagcaaccccgcaaggatcaaccgcgaactaaactggacagcccagcacaccgaactccaggagagcctcagggtcgcgtggacatggcaaaagaagcaccggagcggctatgcagactcgggtcgatatattctttgactcactaacagagatagcagttacacataatttatatagcgtgtatggtcatttgttcaaatcctgagattttatatttatata

SEQ ID NO: 1279 - DNA, 1566 bp, Hordeum vulgare
ttccctttcccactcccacgattcactctgccccctccttcctccccctgccacggtcacaaagctccttcctttttcccgtgtccgccttcctccactcccgcaattctttccctgttccgctgctgtaaagggcagggcggagcagcctggaacagggttgttggatctgactatctgagccagtgacctctcgccgccagccgcgggcagatgctgccgaccggcaggagcaggccgcagcccaggcctgcgccgagatcttggtccttctcagacatggacttctcggacccgaagcgcaagtccaggtacctcagcaagatcatcatggtggcgctcctcacggccatgtgcgtcgtcatgctcacccagccaccctgccacaggaaggctcccagtgtgttctctatccatgaactcggagtaactcatgtgttggtgacgggtggcgccggctacataggatcgcatgcggctctacgactgctcaatgactctttcagagtcaccattgtggataatctctcaagaggaaatatcggggcggtcaaggttcttcagaacttgttccctgatcctgggcgattgcagttcatacatgctgatctaggcgatgcaaaagctgttaacagaatattcgcagaaaatgcatttgatgctgtcatgcactttgctgccgttgcttatgtgggcgagagcacgcttgagcctctgaggtactatcataacatcactgcaaatactctggtcgtgctagaagccatggcgatgcacaatgttaaaaccctgatctactctagcacatgtgccacctacggggaacccgagaagatgcctatcactgaagaaactccccagtttcccataaacccgtatggcaaggccaagaaaatggcagaggatatcattttggacttctccaagtccaggaaatcagacatgtcagttatgatcctgagatacttcaacgtcatcggttctgacccagaaggaagactgggtgaggctccaccacctgaattgcgcgagcatggccgtatatctggcgcatgcttcgacgcagcactaggaataatcccaggtttgaaggtcaaaggtaccgactacgaaactcccgacgggacttgcgtgagagattacatcgatgtcaccgacctggtagatgcccacgtgaaagcgctcaacaaggcggagagaggcaaagttggcatatacaatgttggcaccggaagaggtaggtcagtgaaggagtttgtggaagcttgcaagaaggcgaccggagtcgacatcaaggtcgactacttcccgcgccgccccggtgactatgcggaagtgtacagcaaccccgcaaggatcaaccgcgaactaaactggacagcccagcacaccgaactccaggagagcctcagggtcgcgtggacatggcagaagaagcaccggagcggctatgcagactcgggtcgatatattctttgactcactaacagagatagcagttacacataatttatatagcgtgtatggtcatttgttcaaatcctgagattttatatttatatatgg

SEQ ID NO: 1280 - DNA, 1736 bp, Brachypodium distachyon
gtttgttccccacttcacacgatccatccatccattcgctgcctgccgctttcctcgacccagtcgcaaagccgcgacctttccttccagttccactctcccttcctcttcctcagcccgagtgccgcggcgtacgcgtgtccaccttccttctgcaaaaggatcggagattcggagggctggcctcgcactagcactagctgtctgcgcctgtgtctgggagaggaaaagggagagggttgttggatctgactctctctcactcgctgcgcctctctctctttttgcgcggccggcggcggattccagccttttcttcaaattcgcagcagggacagatcgatgctgcccagcagcaggagcaggccgcagcccagacccgccggcagatcttggtccttctcagagatggacttctccgaccccaagcgcaagccgaggtacctcagcaaggtaatcatggccgcgctgctcatcgccatgtgcgtcgtcatgctcacccagccgccctgccataggaggctccccagtgtgttctccatccacgagcctggagtaacacatgtgctggtgacgggtggtgctggctacattggttcgcacgctgctcttcggttgctgaaagactccttcagagtcaccattgtggataatctttcaagaggaaatatcggggcagtcaaggttcttcagagcttgtttcctgagcctgggcgactgcaatttatatatgctgacttaggggatccaaaagctgttaataaaatatttgcagaaaatgcatttgatgctgtcatgcactttgccgccgtcgcttatgtgggcgagagcacgcttgagcctctcaggtactaccataacatcactgcaaatactctagttgtgctagaagccatggcgacacacgatgtgagaactctgatctactctagcacttgtgccacctatggtgaacctgagaagatgcctatcactgaagaaactccccagtttccaatcaacccgtatggtaaggccaagaaaatggcagaggatatcattttggacttctccaagtccaggaaatcagacatgtcagtgatgattctaagatacttcaatgtcattggttctgacccagaaggcaggctgggtgaggctccaccacctgaattgcgtgagcatggccgtatatctggtgcatgcttcgatgcagcactagggataatcccaggtttgaaggtgaaaggtaccgactatgagacgtccgatggcacttgtgtaagagattacattgatgtcactgatctggttgacgcccacgtgaaggcgctgaacaaggcagaaagaggcaaagttggcatatacaacgttggcactggaagaggtaggtcagtgaaggagtttgtggaagcttgcaagaaggcaacaggggttgacatcaaggtcgactacttcaatcgccgccccggtgactacgcagaagtgtacagcgaccctgcaaagatcaaccgtgagctgaattggacagcacagcacacggaactccaagagagcctcagggtcgcatggacttggcagaagaagcaccggagtggctacggaccgcctcaggctatgattttgtgaagaggtttactttaccatgtagcatgatctgttggctgaagatttaggtggatatattcctaggaatgttcctcaagggctgtactggctcaatatatagctcatatggtccattcgttcgattcttg

SEQ ID NO: 1281 - DNA, 1866 bp, Oryza sativa
actcccccctcgaccggacagagcagcagcagcagccagcgccgcctcctcccttcaaagcctcttcttcttctcacttcatcaacaacctcacctcgcctcgcctcttctcgcggccaacgagagagggagagggagagctaggaccaccgccactgcctcgggaagtaggtggctcccctgctttccctcctctcctccgccgtcgccgaggcagccagccaagtcgtcccagcaggtggtaggctactagtccgggtggccggcagtgagcaggaggaatcatctctggcgttcttgtctccgaggaactttgattctttctgggaggggatttggtgtgctgctgctgctccagatgcttcccaccaacaggaacaggccccagcagaggcctgccagatcttggtatttcatctcagacatggacttctccgatccgaagcgcaagccgcggtacctcagtaagatcctcatggtggcgctcctcaccgccatgtgcgtcgtcatgctcacacagccgccctgccataggaggactcccagtgtgttctccatccatgaacccggagtcacgcatgttctagtgacgggcggcgctggatatatcggttcgcacgctgcgcttcggctgctgaaagattccttcagagtcaccatagtggataatctttcaagaggaaatatgggggcaatcaaggttcttcagaacttgttttcagagcctgggcggttgcagttcatctatgctgatttaggcgatccaaaagctgttaatagaatatttgcagaaaatgcttttgatgctgtcatgcactttgctgctgtcgcttatgttggtgagagcacacttgagcctttgaggtactatcataacatcacctcaaacactttagttgtgctagaggctatggcagcacacaatgtgagaaccctgatctactctagcacatgtgccacctatggagaacccgagaagatgcctatcaccgaaggaactccccagtttccgatcaacccatatggtaaagccaagaagatggcagaggacatcatcttggatttttccaaatccaagaaggcagacatggctgtgatgattctaagatacttcaacgtcattggttctgaccctgaaggaaggcttggcgaggctccaaaacctgaattacgggagcatggccgtatatctggtgcatgctttgatgctgcactggggataattcctggtttgaaggttaaaggtactgactatgaaacacctgacggtacttgtgtaagagattacatcgatgtcactgacctcgttgacgcccatgtgaaggcgctcaacaaggcggaaaggggcaaagttggcatatacaatgttggcacaggcaaaggtaggtcagtgaaagaatttgtcgaagcttgcaagaaggcaacaggagttgacatcaaggtcgactacttccctcgtcgacccggtgactatgccgaagtgtacagcgatcccgcaaagatcaacagcgagctgaactggactgctcaacataccgatctcctggagagcctcagggttgcctggacatggcagaagaagcaccggagcggctacggaccccctcaggccatggttttgtgaagagaatttaccctgtagcatctattggctgaaaacttaaaaacttaggtggatatattcttaggaatgttcatcatcaagggctttcaattgctcactcacagaagttatatgtaatatagcgcttatggtcattcgttcaattcttgagattcatattatgggaggattttagaagattgtaatattgttgatgtattcagtatacaataaaaatccaacaagctatcctcagaattgtt

SEQ ID NO: 1282 - DNA, 1885 bp, Cenchrus ciliaris
  misc_feature (232)..(233): n is a, c, g, or t
  misc_feature (304)..(304): n is a, c, g, or t
  misc_feature (306)..(307): n is a, c, g, or t
  misc_feature (353)..(353): n is a, c, g, or t
  misc_feature (528)..(534): n is a, c, g, or t
  misc_feature (571)..(571): n is a, c, g, or t
  misc_feature (573)..(573): n is a, c, g, or t
  misc_feature (576)..(576): n is a, c, g, or t
  misc_feature (660)..(660): n is a, c, g, or t
  misc_feature (945)..(945): n is a, c, g, or t
  misc_feature (1578)..(1578): n is a, c, g, or t
ctcgtcggccgcccttccccacccagcagcagcagcccaccaccgccaccggcggcgggggactcccctccccttcccttggccgcttccgcgtgtccccaatcgaacccgcgccgcgtagctttccactcccgcgcccgcgcaccaacccacacctacctgtaaggctgtaaaggccaccacctcctcctcctcctcgctgccccgccctggatctgccttctccacctcnnccctgcctctcctcaaggaaggaaggaaggaggtgctaattccccagttccccgctccggcaagcggagancnncggagcctcggtgaatccgccgccgccgccgcttcccgaccggccngatgctgcctaccaacacccgcggcaggccgcagcagaggccgcccagatcttggtccttctcagagatggtggacttctccgaccccaagcgcaggccgcgctacctcagcaaggtcgtcatggtcgcgctcctcaccgccatgtgcgtcgtcatgctcacccagccgccctgnnnnnnnaggacacccagcgtcttctccgtccatcaacctgggntnacncacgtgctcgtcaccggcggcgccggctacatcggctcccacgccgctctccgcctgctcaaggactccttcagagtcaccatngtcgataatctttccagagggaatatcggggcgatcaaggttctccagagcttgttcccggagcctgggcgattgcagttcatacaggccgatctaggagatcccaaagcagttaacaggatatttgcagagaatgcatttgatgctgtcatgcactttgctgctgtcgcatatgttggcgagagcacacttgagcctctgaggtactaccacaacatcactgcaaacactctagttgtgctggaagctatggcaacacacagtgtgaaaactctgatctactcnagcacgtgtgctacctatggagagccggagaagatgccgatcactgaagaaactccccagtttccgatcaacccatatggcaaagccaagaagatggcggaggacatcattttggatttctcaaagtccaagaaagcagatatggctgtcatgattctaagatacttcaatgtcattggctctgacccagaaggcaggctgggtgaggctcctagacctgagttgcgtgagcatggtcgtatatcaggtgcatgcttcgatgcagcgctgggtataatcccaggtttgaaggttaagggtagcgactacgaaacacctgatggtacttgtgtaagggattacattgatgtcactgacctggttgatgcccatgttaaggcgctcaacaaggcagaaagaggcagagttggcatatacaatgttggcacaggaaaaggtcgatcagtgaaggagtttgttgaagcctgcaagaaggccaccggagtcgacatcaaggtcgactacttcccccgcagaccaggtgactacgccgaggtgtacagtgaccctgctaagatcaaccgggagctcaactggacggcgcaacacaccgacctccatgagagcctcagggtggcatggacatggcagaangcgcaccggagtgggtacgaaccaccacaggctatgattttgtgaagagtttgggtgcctcatagcaagcaaccagctggattgaagcataggtgaacataaaattattagagacttatcctcaagggctcttagtcgctcactcacatatggtggtttatatatacgtagtgttcatggtcatttgttcaattctcgaggattcatatttattgcaggccttagctgatcactgtaatatcataatacagatatattcatcatataagttatatataataaaaattcaataagctcctttttgaga

SEQ ID NO: 1283 - DNA, 1699 bp, Panicum virgatum
cacactaccacaggaaggaaggcgagagctttccgtcccctcccctcccgcagaggctgtaaagggcagctccctcgtggcctgtcgctgcccgcctccactccactcctctccggactcgccggcctggatctgccgcggggctctcatcgctcctgccctgaggggagaccgccgccgcagatgctgcccaccaaccgcggcaggccgcagcagaggccgccgccgcccagatcttggtccttcctctcagagatggtggacttctccgatcccaagcgcaggccgcgctacctcaccaagctcgtcatggccgcgctcctcaccgccatgtgcgtcctcatgctcacccagccgccatgccacaggagggccagccccagcgtgttctccatccgtcaacctggggtcacgcacgtgctggtcaccgggggcgccggctacattggctcgcacgccgctcttcggctgctcaaggactccttcagagtcaccatagtggataatctttcgagaggaaatattggcgcgatcaaggttcttcagaacttgttcccagagcctgggcggctgcagttcatacaagctgatttaggagatccaaaagcagttaacagaatatttgcagagaatgcatttgatgctgtcatgcactttgctgctgtcgcttatgttggagagagcacacttgaacctctgaggtactatcataacatcactgcaaacactttagtggtgctggaagctatggcaacacacaatgtgaaaactctgatctactctagcacatgtgctacttacggagaacctgacaagatgcctatcactgaagaaactccccagtttccgatcaacccatatggtaaggccaagaagatggcagaggatatcattttggatttctcaaagtccaagaaagcagatatggctgtcatgattctaagatacttcaatgtcattggctctgacccggaaggaaggctgggtgaggctcctagacctgaattgcgtgagcatggtcgcatatcaggtgcatgcttcgacgcagcactgggtataatcccaggtttgaaggttaagggtaccgactacgaaactcctgatggcacttgtgtaagggattacattgatgtcactgacctggtcgacgcccatgttaaggcactcaacaaggcagaaaaaggcagagttggcatatacaatgttggcacgggaaaaggtcggtcagtaaaggagttcgttgaggcctgcaagaaggcgaccggagtcgatatcaaggttgactacttcccccgcagaccaggtgactatgccgaggtgtacagcgaccccgccaagatcaaccgggagctgaactggacggcgcaacacaccgacctccacgagagcctcagggtggcgtggacatggcagaaggcgcaccggagtgggtacgagccaccccaggccatgattttgtgaagatggtgatgggcctcgtagcaagcaaccagctggctggagcataggtgaacataaaagtattattagagacttctccttgaggacccatagtcgctcgctcacatatggtgaattatatacacatagtgttcatggtcattcgttcgattcttgagggttcatatttattgaaggctttagctgatcattgtaatagcataatactccatattcattgtaagttatagaataaaat

SEQ ID NO: 1284 - DNA, 1575 bp, Pennisetum glaucum
gtccaccaacaccgcccgcggcaggctgccgcagcagaggccgcccagatcttggtccttctcagatatggtggacttctccgaccccaagcgccggccgcggtacctgagcaaggtggtcatggtggcgctcctcaccgccatgtgcgtcgtcatgctcacccagccgccctgccacaggcggacccccagcgtcttctccgtccgtcaacctggggtcacgcacgtgctcgtcaccggcggcgccggctacatcggctcccacgccgcgctccgcctgctcaaggactccttcagggtcaccatagtggataatctctcgagggggaacatcggggccatcaaggttctccggaacttgtacccggagcctgggcggttgcagttcatacaggccgatctaggagatccgagagccgttaacaggatatttgcagagaatgcatttgacgctgtcatgcactttgctgccgtcgcgtacgttggtgagagcacacttgaacctctgaggtactaccacaacatcactgcaaacactctagtggtgctggaagctatggcaacacacagtgtgaaaactctgatctactccagcacgtgcgctacctacggagagccggagaagatgcccatcactgaagaaactccccagtttccgatcaacccatatggcaaggccaagaagatggcggaggacatcatcttggatttctcaaagtccaagaaagcagatatggctgtcatgattctaagatacttcaatgtcattggttctgatccagaagggaggttgggtgaggcacctagacctgaattgcgtgagcatggtcgcatatcaggtgcatgctttgatgcagcactgggtataatcccaggtttgaaggttaagggtagcgactatgaaacacctgatggtacttgtgtaagggattacattgatgtcactgacctggttgatgcccatgttaaagcactcaacaaggcagaaagaggcagagttggcatatacaatgttggcacaggaaaaggtcggtcagtaaaagagtttgttgaagcctgcaagaaggcaactggagtcgacatcaaggtcgactacttcccccgcagaccaggcgactatgctgaggtgtacagtgaccctgctaagatcaaccgggagcttaactggacggcacaacacaccgacctccatgagagcctcagggtggcttggacatggcagaaggcgcatcggagtgggtatgagccaccccaggccatgattttgtgaagagtttggatgccatgtagcaagcaaccagctggattgaagcttaggtgaacataaaattattagagacttctcctcaagggctcttagtcgctcactcacatatggtggtttatactccctccatccttatttgtttgacgtccagtagttcacatttgaactagccggcgtcaaataaacaaaaacagaggtagtatgtacgtagtgttcatggtcattcgttcaattcttgagggagatatttattgcaggccttagctgatcactgtaatatcataatacagatatattcattatacaag

SEQ ID NO: 1285 - DNA, 1821 bp, Saccharum officinarum
aggtagccgctgccctctccgactccgagggcacctcctttcctttgtccgctcccgcgtgtccccgtcccgattccacttccactccctgcgggggccgcccggctccgctgctcctctccactctgctgggcctggatctgtctcagtccaaacttcgagcagagtagcggcgccgccttctattctacctgacccggccggccgccgtgcaggtgcaggtgcaccaatccaatcctcggagtcggcagagtctcctgtcccccggcgccgatgctgcccgccagccgcggcagcaggccgccgcagaggcccgccgccagatcctgctccgcctccttatcagaaatcatggacctgtcgtcggacccgaagcgcaagccgcggtgcctgagcaaggtcgtaatgctcgcgctcctcgccgccatgtgcgtcgtcatgctcacccagccaccctgccgcaggaggacgccgcccacacccaccctgttctccatccatgaacctggggtcacgcacgtgctggtcaccggcggcgctggctacatcggctcgcacgccgctcttcgcctgctcaaggactccttcagagtcaccatagtggacaatctttctagaggaaatattggggcgatcagggttctccaaaacttgtttccaaagcctgggcggctgcagttcatacaggctgatttaggagatccagaagctgttaatagaatatttgcagagaatgcatttgatgctgttatgcacttcgctgctgtggcctatgttggtgagagcacacttgaacctctgaggtactatcataacatcaccgcaaacactctagtggtgctggaagccatggctacacacaatgtgaagactctcatctactctagcacgtgtgcgacctatggagagcctgagaagatgcccatcactgaagggactccccagtttccgatcaacccatatggtaaggccaagaaaatggcagaggatatcatcttagacttctcagagtcgaagaaatcagacatggctgtgatgattctaagatacttcaatgtcattggttctgacccagaaggcagactgggtgaagctcctagacctgaattgcgtgagcatggccgtatatcaggagcatgctttgatgcagcactgggaataattccaggtttaaaggttaaaggtaccgactatgaaacacctgatggcacttgtgtaagagattacattgatgtcaccgaccttgttgatgcccatgtgaaggcgctcaacaaggcgcaaagaggcagagttggtatatacaatgttggcactggaaaaggtcggtcagtgaaggagttcgttgatgcctgcaagaaggcaaccggagtcgacatcaaggttgactacttccctcgcagaccaggcgactacgcggaggtttacagcgaccctgccaagatcaacagagagctgaactggacggcacagcgcaccaacctccatgagagcctcagggtggcgtggacatggcagaaggcgcaccggagtggatacgagccgccacaggccatgatcttgtgaagaggttagctgcgtctaagcaaacaatctggatggatgaagcttacgtgaacatagtattattactagactagagacctctcctcgagggctcttggtcactcaccagcgtcagttcatatattgcatatatagtgttcatggtcattcattcgattcttcacgattcctttatcgcaggctttagctgatcaatgtaatattgatatatggacatattccgtataatgtttttataataaaaaaaagtacaagatg

SEQ ID NO: 1286 - DNA, 1893 bp, Sorghum bicolor
tttagttctaatttttgggctggttcgatgatcctatggatcgacccgctccacccccatcgtgaggatcatcccctagtgtggagaaacaatcgtcaacgaactccacctccgcagtcagcctccacctccacctggggcaccacctccccccttttgcttgtccgctcccgcgtgtccccgattccactcccggctgctgctccgctttcctctccactctgctgccgctgggcctgctggatctgcaccgagcccggcagactagcggcgccgccttcgactctacctgacccagccgccagccggctgccgtgcaggtgcaggtgcaccaatccaggcgccgatgctgccctccacccgcggcagcaggccgccgcagaggcccgccgccagatcctgctcctccgccttatcagagatcatggacctgtcgtcgtcggacccgaagcgcaagccgcggtgcctcagcaaggtggtcatgctcgcgctcctcgccgccatgtgcgtcgtcatgctcacccagccaccatgccacaggacaaggcctcccacacccaccctgttctccatccatgagcctggggtcacgcacgtgctagtcaccggtggcgctggctacatcggctcgcacgccgctcttcgcctgctcaaggactccttcagagtcaccatagtggacaatctttcgagagggaatatcggggcgatcaaagttctccagaacctgtttccagagcctgggcggttgcagttcatacaggctgatttaggagatccagaagctgttaatagaatatttgcagagaacgcatttgatgctgttatgcactttgctgctgtggcctatgttggtgagagcacgcttgaacctcttagatactatcataacatcaccgcaaacactctagtggtgctggaagctatggctacacacaacgtgaagactctcatctactctagcacgtgtgcgacctacggagagcctgagaagatgcccatcactgaaggaactccccagtttccgatcaacccatatggtaaggccaagaaaatggcggaggatatcatcttagacttctcaaagtcaaagagatcagacatggctgtcatgattctaagatacttcaatgtcattggttctgacccagaaggcagattgggtgaagctcctagacctgaattgcgtgagcatggccgtatatcgggggcatgctttgacgcagcactgggaatcattccaggtttaaaggttaaaggtaccgactatgaaacacctgacggcacttgtgtaagagattacattgatgtcaccgaccttgttgatgcccatgtgaaggcgctcaacaaggcacaaagaggcagagttggtatatacaatgttggcactggaaaaggtcggtcagtgaaggagttcgttgatgcctgcaagaaggcaactggagtcgacatcaaggttgactacttccctcgcagaccaggcgactacgcggaggtatacagcgaccctgccaagatcaacaaggagctgaactggacggcgcagcgcaccgacctccatgagagcctcagggtggcgtggacatggcagaaggcgcacaggagtggctatgagccgccacaggctatgattttgtgaagaggttctggatgggtgaagtttaggtgaacatagttttactagagacctctcctcgagggctcttagtcactcacaggcgtcagttcatatattatatatagccattcgttcgattcttcaggattcatatttatcgcgggcattagctgatgaatgtaataagattcatatttataacaggcattattaactgataaatgtaatatcatcataatatagacatattcgttatatgaggttatataattatt

SEQ ID NO: 1287 - DNA, 1835 bp, Festuca arundinacea
  misc_feature (748)..(748): n is a, c, g, or t
  misc_feature (750)..(750): n is a, c, g, or t
  misc_feature (755)..(755): n is a, c, g, or t
  misc_feature (815)..(815): n is a, c, g, or t
  misc_feature (818)..(818): n is a, c, g, or t
  misc_feature (827)..(827): n is a, c, g, or t
  misc_feature (1097)..(1097): n is a, c, g, or t
  misc_feature (1100)..(1100): n is a, c, g, or t
  misc_feature (1163)..(1163): n is a, c, g, or t
  misc_feature (1191)..(1191): n is a, c, g, or t
  misc_feature (1410)..(1410): n is a, c, g, or t
ggcacgagggagtcaccgaccggctgtaacctgctctcctctcgccctcccagggagggctctctcctctgagaccactctcctgactgatttccagctgggaattcgagctttccttggatttggtcggtcgaggagactcgccaccagccatagatgctgccgaccagcaggagcaggcctcagccgaggcctgcggctagatcctggtccttctcagagatggacttctccgatcccaagcgcaggtcgaggtacctcagcaagataatcatgctcgtgctcctcacggcaatgtgcgtcgtcatgctcaccctgccataggagggctcccagtgtggtaaacctacctcttatctcctcaagcatgcacatctctggagatacccatttgcacgtcattggattccaagccttccactcccactaagcaatgcagtagaaatggatgggaacagctgggtatatcttgtcgttccttcaactctggctcatgtttaaatcttcactctctgtcatgttctcagttctccattcacgaactcggagtaacacatgtgttggtgaccggcggtgctggctacataggatcgcacgccgcccttcgcctgctgaaagactcctttagagtcaccattgtggataatctttcgagaggaaatatcggggcagtcaaggttcttcagaacttgtttcctgagcctgggagattgcaattcctatatgctgatttaggcgatccaaaagntnttaanagaatattcgcagaaaacgcattcgatgctgtcatgcactttgctgctgtcgcgtatgtnggngagagcacncttgagcctctgaggtactatcataacatcactgcaaataccttagttgtgctggaagccatggcgacacaccatgttaaaaccctgatctactctagcacatgcgccacctacggggagcctgagaagatgcctatcactgaagaaacaccccagtttcctatcaacccatacggtaaggcaaagaaaatggcagaggatatcattttggacttctcaaagtccaggaaatcagacatgtcagtgatgattctgagatacttcaatgtnatnggttctgacccagaaggaaggctgggtgaggctccaccacctgaactgcgtgagcacggacgnatatctggtgcatgcttcgacgcagcantgggaataatcccagggttgaaggtcaaaggtaccgactacgaaacgcctgatgggacttgtgtaagagattacattgatgtcactgacctggttgacgcccatgttaaagcgctcaacaaggcggaaagagggaaagttggaatatacaacgttggcaccggaagaggtaggtcagtgaaggagtttgtggaagcttgcaagaaggcaaccggagtcnacatcaaggtcgactacttctctcgccgccctggtgactatgcagaagtgttcagcaaccccgcaaagatcaaccgtgagctgaactggacagcccagcataccgaactacaggagagcctcaggatcgcatggatgtggcagatgaggcaccggagcggctatggaggacctcaggctatgattttgtgaagaagtttaccctacacataccggtgggcacgtaatttatatagcatgaggtgtgttagttgaagatttaggtcgatgtattctttggctcactcacagatggcagttacacataatttatatagcgtatatggtcattcattggactcttgagattttctatttattggaggtttagcagttctttgtaatattgatgtattcagtatataataaaaaatcatactctccctg

SEQ ID NO: 1288 - DNA, 1970 bp, Brachypodium distachyon
ctctcgaaagtccaaaccctgtccccgttccttcgctttctccctccgctcccgcttttaacgcgcgcgtggctaccgcctgggtcatgcccctgccgccgcgatggctcgtagcggcgtggaggtgatcgccagcagagggtgctcgaagctgctccttcccgggatgcagccctcctctgcctccgccgcttcctcctttgcatctgcctcgcgcgcctccgccgccgctcagagacagcctgaaggcgccttcgccggcctggtcatctgcgtcacggggctgtccaaagaggctagaattcaggtgaaggaggcggccgagaggctgggaggcgagtacagcgggagcttgcaccccaaatgcactcatcttgtggtgcagatatccttacacatcatgggccgttatgtgattttcagaaatttcattgttatgtatgttcctcggaattcagggtacgatgcttccttaacatacaccacagctttgccggccgcaagttcgagcacgcgctcaagcatggccccaggaatgggctctttgttgtgacactgggctggtttgtagattgcgttcgaaggaacatgaggctggatgaatccttgtacagtatcaagaacatgggggagaacggcctgccactcggggagttcaacaggcttgttggagttcctgttagcgagcagtcatgccttccaccaatgatatttcaagacaaagcatgctcaggcgcaactcagaagcatcagcttcagggtcctagagagaaacctgaacatgacttgttcgtttttgcgaatgacacgatctacattgatcctgggatatctggtgagatgaagaagaagatatctgatgctgctactagagaaggtgcaaaattgttggaccattggtttattggttgccatgccacatatgttgtgtgtgaggatgcttctgtcaagagatatgttggtcactcagacaacatcgtaacaccactttggatcttgaaaacagtgaaagaaaagaacttgcagcgtcttgtccacttgtcttcagacctagctagacaggttgctgtggttttagaaaatttccagacatctcaagagaatagaaaacttgggagtgttccttctctggactcaaagggcactggattgccaccaaccggaatggaggtaaacgagattcaccaggagaggcaaaattttgttgaagtagcaaaaaaagatattcgagaacgccgtgtccgccgtatgcagtcatgtgaagtaccaatccatccgctcacaccagtcacacttctggattcaatctgctggacaatatctgagtcagcttcatctgcgtgtatttatacggattcatcatggtctgatgatgccaatgagcagcaaagcactacttattttgatgcaaatggggatggaaaggatcgggaccagtcagccgataatttctcccgtccgctaagagaaagtgagagaagtgaggtaatttttaagaaccatttctttaccatactcttccctctggatcgttttggagagcttggaccttcgtcgaggacattcttcagccatggtggctttacatgtgcacaagtgttggatcacatctacaatttctaccaggaaaacatgtcaacggacgagataaatgttgccttgcacacggattcacggcatgcggatcggcttcgttccctgtacgcaagtgctgaatctgtagaaagaggctttgtagcagtcagaagaatcgattttttgggaagccggagaagtttcgaggcactaaagcgccttaacagagagaacaacagcaatgtatacgagcttgtgattagggcatgaacggcaaccatactcagtgccattcaatcaaatttatttgttgcttacaggttgaaaatgatgtagaatgtccacgtgtgcataagaataatttgtagaaaataacacacagcttaatgaaaagg

SEQ ID NO: 1289 - DNA, 2100 bp, Oryza sativa
ttcccaacggtcacctcgtcgtcgttgccaaatctgccatgtcgccgccatggatcccctaatcgaggacccccccaacctagcggagacgaagaagaacgagaagggaagcccaccgcgtcgccatcattaactcctcctctcctctcgtctccctcgaaagcaccaccggatccgacgaccccctcctcccctttctcccctcctcacgaaaccgcctcgccttcctcttcttttctttttcgctcgcttcgcatcgctcacatgcccctgcctgccgccgcagacggggcgccatgtcgcgtagcggggtggaggtggtcgtgagcaggggttgctccaggctcgtcctccccgggatgcagccttcctccgcctccgccgcttcctcctcctccttctcgcgcggcggacatggcggcggcggcgaccggaggccgctgcccgatggccccttcgccggattggtcatctgcgtcaccgggctatccaaagaggcgaggactcaggtgaaggaggcgactgagaggatgggaggcgagtacagcgggagcctgcatcccaagtgcacccacctagtggttcagagcttcgccggccgcaagtttgagcacgcggtcaagcatggcgcgaagaatggcctctttgttgtaacacttggttggcttgtggattgcgtgcggaggagcatgaggttggatgaatcgttatatagcatcaagaacattggggagaatggaatgccactcggggagttcaaccggcttgtcggcgctcctgttagtgggaattcttgccttccaccgatgatgtttcaggaaaaaacattttcagacacgaccgaaaagcatcggcttcagacatctagaaaagaacatgaccatgatgaatttctctttacaaacgactcgatctacattgaccctgggatatctggtgaaatgaggaagaaggtatctgatgctgctactagagaaggtgcaaaattgttggaccactggtttattggctgtcatgcgacatatgttgtgtgtgaggacgcttctgtcaagagatatgttggtcattcagacaacattgtaactccactttggatattgaaaaccgcaaaggaaaaaggtttgcagcgtcttgtccatttgtcttcggacctggctaggcaggttgccacgattcttgaaaatgcccagacatttcaagagaatagaaaaattggggatgttccttctgtcaattcaaactccagtggagtaccatcaacccaaggggagatagatgaaattcatcaagagaggcaaaaatttgttgaagtagcaaagaaaaatgtccgagatcgccgtgctcgccgtatgcagtcatgtgaagtaccaatccatccaatcacgcctgtgaaacttatggaatcaatctgttggaccgtatctgagccaactacgtccgcatgcatttatacggagttttcatggtcagacgatgcctttgagcaacaaagcactactttcttcgatgcgaatggggatggcaaggatgatcagtcaagcgatagtttcacccgcccactaagagaaagtgagaagagtgaagtgatctttaagaaccacttccttaccgtactcttccccattgatcgttttggtgagcttggaccttcctcaaggacattcttcagcaatggtggtttcacacgcatacaagtgcttgatcacatctacaacttctaccaggaaaatatgtcttccgatgagataaatgtagccctgcaaacggattcacgacatgctgatcgacttcgctcgctgtacgcaagtactgaatcagcagaaagaggttttgtaacattcaaaagaattgattttttgggaagccgaagaagttttgaggggctaaaacgcctcagcagagagaacaatagcaatgtatatgagcttgtgattagggcataaactgcaccatactcggtgttatttagtcaaatttgtttgttgtttacaggttgatagtgatgtactaccatgtatgcacgccgaataaaattgtaggagataatgatatatttatagatcaatgaaaaagatcatgttgggcagttcagccgcaata

SEQ ID NO: 1290 - DNA, 663 bp, Hordeum vulgare
attccattagcggggtcgcggccgaggtacgcggggactcaccagtggcaccaccacttcacagctgagctgaaagcaaaagcagtagtaagcaggtcaagcagagcaaagcagtaagcagctagcattgttcgattcgctaaactaagcaggttgaaatttaccagcaccagctcccatggccagcttcgcctcccagctcctggacgtgttctacgacctcgtcgagcgcgtcaccggctacagcgcccgcgccgaagatgacaaggatctagagaagcacagcaagttggcaactacggaggctttccggacagaggaagttgtcgagatcaggtccagaaatcacccggaagtaccaggaggatcaggcgcccaggtcaattaacatggatggtatgtagagctcgctagcctctacgtacggcagagacatacataacggccgtgtggtttctcatggactcaagatcagtgtgatcaagatagtctacttgctgctgtgtttcgaaactttggataataagctcatgtgtgtcccagtaatgtttcactttgttgattccttactataccgtgtattgctacttaacttcctgatcgaggtttatgcttgtcgttcttttatgtactttgaactagtaaggccaataaagcagtaac

SEQ ID NO: 1291 - DNA, 605 bp, Hordeum vulgare
tcacagctgagctgaaagcaaaagcagtagtaagcaggtcaagcagagcaaagcagtaagcagctagcattgttcgattcgctaaactaagcaggttgaaatttaccagcaccagctcccatggccagcttcgcctcccagctcctggacgtgttctacgacctcgtcgagcgcgtcaccggctacagcgcccgcgccgaagatgacaaggatctagagaagcacagcaagttggcaactacggaggctttccggacagaggaagttgtcgagatcaggtccagaaatcacccggaagtaccaggaggatcaggcgcccaggtcaattaacatggatggtatgtagagctcgctagcctctacgtacggcagagacatacataacggccgtgtggtttctcatggactcaagatcagtgtgatcaagatagtctacttgctgctgtgtttcgaaactttggataataagctcatgtgtgtcccagtaatgtttcactttgttgattccttactataccgtgtattgctacttaacttcctgatcgaggtttatgcttgtcgttcttttatgtactttgaactagtaaggccaataaagcagtaac

SEQ ID NO: 1292 - DNA, 670 bp, Triticum aestivum
actcaccagtgtcaccactcacagctgagctgaaagcaaaagcaggccaagcagagcaaagcagtaagcagccagcactgttcgagtagctaagctagtggtggtagcacagcggcttgaattgcccagcaccagctccgatcccatggccagcttcgcctcccagctcctggacgtgttctacgacctcgtcgagcgcgtcaccggctacagcgcccgcgcccaagacgacaaagatctacagaagcacagcatgttggcaactagggaggctttccggacagaggaagttgtcgagatcaggtccagaaatcacccggaagtaccaggagggtcaggcgcccaggtcaattaacatgcatggtatgtagggctagctaggctctacgtacctcagagacatacataacggccgtgtggcttctcatagactcgagatcagtgtgctcaagatagtgtacttgctggtgtgcttcgaaacttcagataataagctcgtgtatgtcccagtaatgtttcagtttgttgattccttattaccgtgtcttgctatcttaacttcctgatcgagttttatgggtgctgttctgttgtgcgctcgtaacttgtaaggacattaaagcgggaacttgatcggaaatacaaaaaaaaaaaaagggcggccggtgtg

SEQ ID NO: 1293 - DNA, 643 bp, Triticum aestivum
gtatttccgatcaagttcccgctttaatgtccttacaagttacgagcgcacaacagaacagcacccataaaactcgatcaggaagttaagatagcaagacacggtaataaggaatcaacaaactgaaacattactgggacatacacgagcttattatctgaagtttcgaagcacaccagcaagtacactatcttgagcacactgatctcgagtctatgagaagccacacggccgttatgtatgtctctgaggtacgtagagcctagctagccctacataccatgcatgttaattgacctgggcgcctgaccctcctggtacttccgggtgatttctggacctgatctcgacaacttcctctgtccggaaagcctccctagttgccaacatgctgtgcttctgtagatctttgtcgtcttgggcgcgggcgctgtagccggtgacgcgctcgacgaggtcgtagaacacgtccaggagctgggaggcgaagctggccatgggatcggagctggtgctgggcaattcaagccgctgtgctaccaccactagcttagctactcgaacagtgctggctgcttactgctttgctctgcttggcctgcttttgctttcagctcagctgtgagtggtgacactggtgagt

SEQ ID NO: 1294 - DNA, 589 bp, Triticum aestivum
  misc_feature (24)..(24): n is a, c, g, or t
  misc_feature (30)..(30): n is a, c, g, or t
gggtaccgggccccccctccgagncacagncaaagcaagcagtcagcagctggccaagaagagcaaggcagcaagcagctagactgttcgattagctaagctagtggcggtaacacagcagcttgtattacccagcacggcagcaccagctccgatcccatggccagcttcgcgtcccagctcctggacgtgttctacgacctcgtccagcgcgtcaccggttacagcgcccgcgccgaggacgacaaggacctacagaagcacagcaagttggcaactacggaggtttttcggacggaggaagttgtcgagatcaggtccagaaatcacccggttgtatcaggagggtcaggcgggcaggtcaacatggatggtatgtagtagaggttgctagcctctacgtacggtaaagccatacataacggccgtgtggtgtcacatggcctcaagatgttgtgcggcctgctgatgtttcagtttgttacaatgttcttgctatcgtgtcttgctatgttaattaactctacctgatagagttttatgggtgttgtctcgtgcgcttgtaagttgtaaggctaataaagcagta

SEQ ID NO: 1295 - DNA, 518 bp, Triticum aestivum
agtgtcaccaatcacagctgagctgaaagcaatagcaccaagcagctagctcggcagcttggatttaacagcaccaactcccatggccagctacgccgcccagctcctggacgtgttctacgacctcgtcgagcgcgtcaccggctacagcgcccgcgcccaagacgacaaggatctacagaagcatagcaagttggcaactacggaggctttccggacggaggaagttgtcgagatcaggtccaggaatctcccggttgtatcaggaggctcagagggccaggtcaattaacctggatggtatgtagagccagcctctacgtacggcagagacatccgtgtggtttctgatagatcatagcctcgaaatggggtgcggaatgtttcagtttgttacaatgttctatcgtgtcttgctatgttaattaacttcctgatcggggtttatgtgtgttgttctcgtgtgcttgtaacttgatgaacttgcttgttaatttctaccgatcaagtgtttgttt

SEQ ID NO: 1296 - DNA, 544 bp, Triticum aestivum
ggccaagcagagcaaagcagtaagcagctagactgttcgattagctaagctagtggcggtagcacagtagcttgaatcacccagcaccagctccgatcccatggccagcttcgcctcccagctcctggacgtattctacgacctcgtcgagcgcgtcaccggctacagcgcccgcgccgaggacgacaaggacctacagaagcacagcaagttggcaacaacggaggttttccggacggaggaagttgtcgagatcaggtccaggaatctcccggttgtatcaggagggtcaggcgcgcaggtcaacatggatggcatgtagaggtagctagcctctacgtacggcagagacatacataacggccgtgtggtgtcacatagcctcaagatggtgtgcggcctgctggtgtgtgcgtgtccgagtaatgtttcagtttcttagaatgttgtatcgggtcttgtacgtttattaacttgttgatcgagttttatgtgtgttgttctcgtgtgcttgtaacttgatgaacttgcttgttaatttcta

SEQ ID NO: 1297 - DNA, 576 bp, Triticum aestivum
gcgtgtccccggcccgagtggctcaaagcaagcagtaagcagctagactgttcgattagctaagctagtggcggtagcacagtagcttgaatcacccagcaccagctccgatcccatggccagcttcgcctcccagctcctggacgtattctacgacctcgtcgagcgcgtcaccggctacagcgcccgcgccgaggacgacaaggacctacagaagcacagcaagttggcaacaacggaggttttccggacggaggaagttgtcgagatcaggtccaggaatctcccggttgtatcaggagggtcaggcgcgcaggtcaacatggatggcatgtagagctacctagcctctacgtacggcagagacatacataacggccgtgtggtttctcgtagcctcaagatggtgtgcggcctgctggtgtgtgcgtgtccgagtaatatttcagtttcttagaatgttgtatcgggtcttgtacgtttattaacttgttgatcgagttttatgtgttttgttctcgtgtgcttgtaacttgatgaacttgcttgttaatttctaccgatcaagtgtttgtt

SEQ ID NO: 1298 - DNA, 562 bp, Triticum aestivum
  misc_feature (227)..(227): n is a, c, g, or t
  misc_feature (300)..(300): n is a, c, g, or t
  misc_feature (360)..(360): n is a, c, g, or t
ctcacagttgagctgaaagcaatagcctcactcacgccagtgtcaccaatcacagctgagctgaaagcaatagcatcaagcagctagctcggcagcttggatttaacagcaccaactcccatggccagctacgccgcccagctcctggacgtgttctacgacctcgtcgagcgcgtcaccggctacagcgcccgcgcccaagacgacaaggatctacagaagcatancaagttggcaactacggaggctttccggacggaggaagttgtcgagatcaggtccaggaatctcccggttgtntcaggaggctcagagggccaggtcaattaacctggatggcatgtagagccagcctctacntacggcagagacatccgtgtggtttctgatagatcatagcctcgaaatgggttgcggaatgtttcagtttgttacaatgttctatcgtgtcttgctatgttaattaacttcctgatcggggtttatgtgtgttgttctcgtgtgcttgtaacttgatgaacttgcttgttaatttctaccgatcaagtgtttgttttctctc

SEQ ID NO: 1299 - DNA, 675 bp, Hordeum vulgare
gtaagcaggcgaagcggagcaaagcagtaagcagctagcactgttcgattcgctaagctaagcaggttgaaatttaccagcacgagctcccatggccagcttcgccgcccagctcctggacgtgttctacgacctcgtcgagcgagtcgccggctacagcgcccgcgccgaggacgacaaggcgcatgcagatctacagaagcgcaccatgttggcaactacggaggctttccggacagaggaagttgtcgagatccggtccagaaatcacccggatgtatcaggagggtcaggcgcacaggtcaacatggatggtatgtagagctagcctctacgtacggtagagatatacataacggccgtgtgatttggcagagcctccagatgctgcggcgcctgctggtgtgttcagaacttcaaataacataagctggtgtgtgtgtgtgccccagtaatgtttcagtttgttacaatgtccttaattactatcgtatcttgctaattgcaatgttaacttcctgatcgagttttgtgtgtattgttttcgcgcgcttgtagttgtaaggctaacaaagcagtacttgtgagcaggtttgttaattttctgctcatcaagtgtttgctttctcgaagcctactttctgctaaatgttctttctatttaaaaaaaaaaaa

SEQ ID NO: 1300 - DNA, 692 bp, Hordeum vulgare
ctgaaagcaaaatcgtcgtaagcaggcgaagcggagcaaagcagtaagcagctagcattgttcgattcgctaagctaagcaggttgaaatttaccagcacgagctcccatggccagcttcgccgcccagctcctggacgtgttctacgacctcgtcgagcgagtcgccggctacagcgcccgcgccgaggacgacaaggcgcatgcagatctacagaagcgcaccatgttggcaactacggaggctttccggacagaggaagttgtcgagatccggtccagaaatcacccggatgtatcaggagggtcaggcgcacaggtcaacatggatggtatgtagagctagcctctacgtacggtagagatatacataacggccgtgtgatttggcagagcctccagatgctgcggcgcctgctggtgtgttcagaacttcaaataacataagctggtgtgtgtgtgtgccccagtaatgtttcagtttgttacaatgtccttaattactatcgtatcttgctaattgcaatgttaacttcctgatcgagttttgtgtgtattgttttcgcgcgcttgtagttgtaaggctaacaaagcagtacttgtgagcaggtttgttaattttctgctcatcaagtgtttgctttctcgaagcctactttctgctaaatgttctttctatttaaaaaaaaaaaa

SEQ ID NO: 1301 - DNA, 1293 bp, Triticum aestivum
gcactcggtcgccttctctcgtctccgcgcagcttccactcgattaccacttgcaagtgcaaacatagcgcacgctagctaggtacgagcggtaaggcatggccagccacttcgtcctcagcaccggcgccaagatcccgtcggtcgggctcggcacctggcagtccgagcccggcgtcgtcggcgacgccgtctacgccgccgtcaaggctgggtatcggcacatcgactgtgctcaagtctacggcaacgagaaagagatcggattcgccctcaagaaggtgttcgacgagggcataaccagccggcaagatctgttcatcacctccaagctatggtgcactaaccacgcgccggaggacgtcccggtggcgctggacggcacgctccaggacctgcagacggactacgtggatctctacctcgtacactggccgatccggatgaagaagggcgccggcttcagcccggagaacgtcatcccggccgacataccggcgacgtgggcagcgatggagggcctctacgactccggcaaggcccgcgccatcggcgtcagcaacttctcgtgcaagaagctggaggagctgctcgccgccgcgcgcgtgccgcctgcggccaaccaggtggagtgccaccccgtctggcagcaggccaagctccgggacctctgcgcgtccaaagggatacacttctccgcctactcgccgctgggctcgccggggacgttcaaagcgttcagcgtgctggagcacccggtggtggtgtcggcggcggagaagctggggaagacgccggcgcaggtggcgctgcggtgggggatccaggcggggcacagcgtgctccccaagagcacccacgaggagaggatcagggccaacttcgacgtcttcgactggtccattccgagcgacctgttcgccagcttctctgaaatcgaacaaacgaggctgatccgcgggaaattctggactcacccggaaggcgtgttcaagtccgaagaagagatctgggatggtgaaatatagtctgaagtctgaacagttgctgctcctaacgcggaggctgccatggcatgatggcaacggaataacgtggtagtgataatcagcagtcgaatgagctcgagcttggctgctgttggtgtgtaatttgcatgagtgatttgagtccagaatcgtccctggaagttgcaaagaaaaatagatttgtcgtcctccgtcatttatgttttgatccattagtcaatccaaggtcattgtgaaaaaaaagcagatatgacagtccagtgaa

SEQ ID NO: 1302 - DNA, 1256 bp, Triticum aestivum
actcggtcgccttccctcgtctccgcgcgcagcttccactcgattaccacttgcaagtgcagcaggtacgggcggtaacaaggcatggccagccacttcgtcctcagcaccggcgccaagatcccgtcggtcgggctcggcacctggcagtccgagcccggcgtcgtcggcgacgccgtctacgccgccgtcaaggctggttatcggcacatcgactgtgctcaggtctacggcaacgagaaagagatcgggttcgctctcaagaaggtgttcgacgagggcataaccagccggaaagatcttttcatcacctccaagctatggtgcactaaccacgcgccggaggacgtcccggtggcgctggatggcacgctccaggacctgcagaccggctacgtggatctttacctcgtgcactggccgatccggatgaagaagggcgccggcttcagcccggagaacgtcatcccggccgacataccggcgacgtgggcggcgatggagggcctctacgactccggcaaggcccgtgccatcggcgtcagcaacttctcgtgcaagaagctggaggagctgctcgccgtcgcgcgcgtgccgccggcggccaaccaggtggagtgccaccccgtctggcagcaggccaagctccgggacctctgcgcgtccaaagggatacacttctccgcctactcgccgctgggatcgccggggacgttcaaatcatacagcgtgctggagcacccggtggtggtgtcgacggcggagaagctggggaagacgccggcgcaggtggcgctgcggtgggggatccaggcggggcacagcgtgctccccaagagcacccacgaggagaggatcagggccaacttcgacgtcttcgactggtccattccgagcgacctgttcgccggcttctctgaaatcgaacaaacgaggctgatccgcgggaaattctggacgcacccggaaggcgtgttcaagtccgaagaagagatctgggatggagaaatctagtctgagcagttgcggagggagggcaggcagcttactttcgtatgtcggaggaggctgccatggcaacggaataacgtggtagtgataatcagcagtcgaatgagctcgagcttggctgctgttggcatgtatttgcatgagtgatttgagtccagaatagctttgttctcctctgtaatttttatgtttttattcatcagtcaatccaaagtcattgtaaaaaagaagcagatataacagtc

SEQ ID NO: 1303 - DNA, 1584 bp, Pseudoroegneria spicata
gtgatcgagcactcggtcaccttctctcgtctccgcgcgcagcttccactcgatttccacttgcaagttcaaacatactctgcgcacgctagctacgagcggtaaggcatggccagccacttcgttctcagcaccggcgccaagatcccgtcggtcgggctcggcacctggcagtccgagcccggcgtcgtcggcgacgccgtctacgccgccgtcaaggctggttatcggcacatcgattgtgcacaagtatacggcaatgaaaaggagatcggattcgctctcaagaaggtgttcgacgagggcataaccgcccggaaagatcttttcatcacctccaagctatggtgcactaaccacgcgccggaggacgtcccggtggcgctggacggcacgctccaggacctgcagaccgactacgtggatctttacctcgtacactggccgatccggatgaagaaggccgccggcttcagcccggagaacgtcatcccggctgacataccggcgacgtgggcggcgatggagggcctctacgactccggcaaggcccgcgccatcggcgtcagcaacttctcgtgcaagaagctggaggagctgctcgccgtggcgcgcgtgccgccggcggccaaccaggtggagtgccaccccgtctggcagcaggccaagctccgggacctctgcgcgtccaaagggatacacttctccgcctactcgccgctgggctcgccggggacgttcaaagcattcaacgtgctggagcacccggtggtggtgtcggcggcggagaagctgggcaagacgccggcgcaggtggcgctgcggtgggggatccagtcggggcacagcgtgctccccaagagcacccacgaggagaggatcagggccaacttcgacgtcttcgactggtccattcccggcgacctcttcgccggcttctctgaaatcgaacaggcgaagctgatccgtgggaaattttggactcacccggaaggcgtgttcaaatccgaagaagagatctgggatggagaaatatagtctgaacagtttctgttccttgcgcagacggcagctttgttttcgtgcatgtcgactgcagctcacaaagctcgagcgagcgatggtgttcctgctgtcttcgttttggcgtctggtggcttcgtccggcgacggtggagcttggcctgacgtcttggaagttgggctttgggcgtccaggggcttcggtggtgttcatcgttgttcgggacgtctctttcgtcagctttccagtctgtttgttcgttgatgtactcgtatttgttctcttctttgtactgctttgatctgtatacgagtatatgttctcaaaaaaaaaaagaagaacgctgccatggcagaagaataacgcggtaaaataatcagcagtcgaatgagctcgagcttggctactgttggtatgtagtaatttacatgagtgatttgagtccagaatcttccctggaagttgtaaaatacaaatagctttgtcttcctctgtcacttatgttttgattcatcagtcaatccaaagtcattgtgaaaaaaaagcagaataacagtcta

SEQ ID NO: 1304 - DNA, 1302 bp, Leymus cinereus x Leymus triticoides
  misc_feature (26)..(26): n is a, c, g, or t
ccgttgctgtcggcgcgcagcttccnctcgattaccacttgcaagtgcagcaggtacgagcggtaaggcatggctagccacttcgtcctcaacaccggcgccaagatcccgtcggtcgggctcggcacctggcagtccgagcccggcgtcgtcggcgacgccgtctacgccgccgtcaaggctggttatcggcacatcgactgtgctcaggtctacggcaatgagaaagagatcggatttgctctcaagaaggtgttcgacgaaggcataaccagccggaaagatctgttcatcacctccaaactatggtgcactaaccacgcgccggaggacgtcccggttgcgcttgacggcacgctccaggacctgcagacggactacgtggatctttacctcgtacactggccgatccggatgaagaaagccgccagcttcagcccggagaacgtcatcccggccgacataccggcgacgtgggcggcgatggagggcctctacgactccggcaaggcccgcgccatcggcgtcagcaacttctcgtgcaagaagctggaggagctgctcgccgtggcgcgcgtgccgccggcggccaaccaggtggagtgccaccccgtctggcagcaggccaagctccgggagctctgcgcgtccaaagggatacacttctccgcctactcgccgctgggctcgccagggacgttcaaagcattcaacgtgctggagcacccggtggtggtgtcgacggcggagaagctggggaagacgccggcgcaggtggcgctgcgatggggaatccaggcggggcacagcgtgctccccaagagcaccaacgaggagaggatcagggccaacttcgacgtcttcgactggtccattcccggcgacctgttcgcgggcttctctgaaatcgaacaggcgaagctgatccgagggaaattctggacgcacccggaaggcgtgttcaaatccgaagaagagatctgggatggagaaatatagtctgagcagttgctgttccttgcgcggagggcagcttgttttcgtatgtcggagagaggaggctgccatggcaacggaataacgcggtagtaataatcagcagtcgaatgagctcgagcttggctgatgttgcctgttggtatgtaatttgcatgagtgatttgagtcgagaatcctccccggacgttgtaaaatacaaatagctttgtcctcctctgtcatttatgttttgattcattagtcaatccaaagtcattggaaaaataaagcagatataacagtccattgatgacatgttgaaaa

SEQ ID NO: 1305 - DNA, 1180 bp, Hordeum vulgare
ggtcgccttctcccgtctgcgcgcgcacttgcaagtgtaggcgagcgacaaggcatggctctccacttcgtcctcaacaccggcgccaagatcccgtccgtcgggctcggcacctggcagtccgagcccggcgtcgtcggcgacgccgtctacgccgccgtcaaggccggttatcggcacatcgactgtgctcaagtctacggcaacgagaaagagatcggattcgctctcaagaaggtgttcgacgagggcgtaaccactcggaaagatcttttcatcacctccaaactatggtgcactaaccacgcgccggaggacgtcccggtggcgctggacggcacgctccaggacctgcagaccgactacgtggatctatacctcgtgcactggccgatccggatgaagaaaggcgccggcttcaacccggagaacgtcatcccggcagacataccggcgacgtgggcggcgatggagagcctctacgactccggcaaggcccgcgccatcggcgtcagcaacttctcgtgcaagaaggtggaggagctgctcgccgtcgcgcgcgtgacgccggcggccaaccaggtggagtgccaccccgtctggcagcaggccaagctccgggacctctgtgcgtccaaagggatacacttctccgcctactcgccgctgggctcgccggggacgttcaaagcgttcagcgtgctggagcacccggtggtggtgtcgacggcggagaagctgggcaagacgccggcgcaggtggcgctgcggtggggggtccaggcggggcacagcgtgctccccaagagcaccaacgaggagaggatcagggccaacatcgacgtctacgactggtccattcccggcgacctcttcgccggcttctctgagatcgagcaggcgaagctgatccgagggaagttctggactcacccggaaggcgtgttcaaatccgaagaggagatctgggatggtgaaatatagtctcaacagccactgttccttgcgcggagggcggcttgttttcgtatgccggaggaggctgccaactcaactgccatggcaacggaataacgcggtagtaaactactctgttgctatggacgttgtaaaatacaaatagctttgtcctcctctgttgtttatgcttttattcattatattagtcaaaaattcaaag

SEQ ID NO: 1306 - DNA, 1173 bp, Hordeum vulgare
ggtcgccttctcccgtctgcgcgcgcacttgcaagtgtaggcgagcgacaaggcatggctctccacttcgtcctcaacaccggcgccaagatcccgtccgtcgggctcggcacctggcagtccgagcccggcgtcgtcggcgacgccgtctacgccgccgtcaaggccggttatcggcacatcgactgtgctcaagtctacggcaacgagaaagagatcggattcgctctcaagaaggtgttcgacgagggcgtaaccactcggaaagatcttttcatcacctccaaactatggtgcactaaccacgcgccggaggacgtcccggtggcgctggacggcacgctccaggacctgcagaccgactacgtggatctatacctcgtgcactggccgatccggatgaagaaaggcgccggcttcaacccggagaacgtcatcccggcagacataccggcgacgtgggcggcgatggagagcctctacgactccggcaaggcccgcgccatcggcgtcagcaacttctcgtgcaagaaggtggaggagctgctcgccgtcgcgcgcgtgacgccggcggccaaccaggtggagtgccaccccgtctggcagcaggccaagctccgggacctctgtgcgtccaaagggatacacttctccgcctactcgccgctgggctcgccggggacgttcaaagcgttcagcgtgctggagcacccggtggtggtgtcgacggcggagaagctgggcaagacgccggcgcaggtggcgctgcggtggggggtccaggcggggcacagcgtgctccccaagagcaccaacgaggagaggatcagggccaacatcgacgtctacgactggtccattcccggcgacctcttcgccggcttctctgagatcgagcaggcgaagctgatccgagggaagttctggactcacccggaaggcgtgttcaaatccgaagaggagatctgggatggtgaaatatagtctcaacagccactgttccttgcgcggagggcggcttgttttcgtatgccggaggaggctgccaactcaactgccatggcaacggaataacgcggtagtaaactactctgttgctatggacgttgtaaaatacaaatagctttgtcctcctctgttgtttatgcttttattcattatattagtcaaaaa

SEQ ID NO: 1307 - DNA, 1516 bp, Oryza sativa
gtcggattcatatccgcgacgaaatccccatccctaagtgtcactactactggtacggtgatgtgtacatctcgcccaccggcacgagctcgccgcgctttccattattagccgctcttgcaagtgtgaagtgtccaggtagccattttgcatgcattttccggcttgtgtacagtgcttgcagcagaataccatggcccgctgcttcgtcctcaacaccggcgccaagatcccgtcggtcgggctcggcacatggcaggccgagccgggcgtcgtcggcaatgccgtctacgccgccgtcaaggctggttatcggcacatcgattgtgctcaagcctacttcaacgaaaaggagattggggtcgctctcaagaaagtgttcgacgagggcatagtcaagcgcgaagatatattcatcacctccaaactctggtgcactaaccatgctccggaggatgtcccggttgcactggacagcacgcttcaggatttgcagaccgactatgtggatctttaccttatccactggccagtgaggatgaagaagggcgccggctttggcgggcaaaacgtcctcccgaccgatatcccggcgacgtgggcggcgatggagaagctccacgactccggcaaggctcgcgccatcggcgtcagcaacttctcgagcaagaagctggaggacctgctcgccgtcgcacgcgtgccgccggccgtcgaccaggtggagtgccacccggtgtggcagcagaccaagctccgcaagttctgcacctccaaaggaatccacctctcagcgtactcgccgttgggctcgccggggacagcgtcggtgaaagcggtgggcaatgtgctcgcgcacccggtggtcgtctccacggcggagaagctggggaagacgccggcgcaggtggctctacggtgggggattcagatggggcacagcgtgctcccgaagagcacccacgaggagaggatcaaggagaacattgacgtctatgactggtccatcccggaggacctgttcatcaagctctctgaaatcgagcagatgaagctgatccgtggagaattctggactcacccggaaggcgtctacaaatcaatcgaagagctttgggatggcgaaatctaatgatcgacttggctggactgaagtttgctttcttcgtgtgggtgaaaaactggaaactgccattgctgcaaataaagtggggaaatgttaatcaatgaatgaataaaaggagtttaagtctacagctaccattttgctggtactggcgtgtatttttacaagaaccggaatccagaatctttaccggcaaaattatcagtaatttggacatttgtttaaaagaaggctttatcacagattttggatgtagtttgacgtctgctttcttctgctcactcgctcagttccttagtaacctgcgatacgtttttcctaggtgtaaatgtaacttttgtgtggctaactaaagcatgccaattcaataaagtattttaaaacatatac

SEQ ID NO: 1308 - DNA, 1451 bp, Cynodon dactylon
gccggggagccctgcagcaggagaactggagaagcagctagcagaagagatggctcgccacttcgtcctcaaaccggcgccaccatcccgtccgtcgggctcgggacatggcaggccgacccgggagtcgtcggcgacgccgtctacaccgccgtaaaggcaggctacaggcatatcgactgcgctcaagcataccgcaacgagaaggaggttggatttgctctcaagaaagtgttcgacgagggcatagccaagcgtgaggatattttcatcacctccaagctctggtgcacgaaccatgcgccggaggacgtaccggtcgcactggagggcacgctgaaggacttgcagactgactacgtggatctctacctcatccactggccactgaggatgaagaaaggcgccggcttcagcgccgagaacgtcatcccgtccgacatcccggcgacgtgggcggcgatggagaagctgttcgacgccggcaaggcgcgcgccatcggcgtcagcaacttctcgagcaagaagctggcggacctgctcgccgtcgcgcgcgtgccgccggccgtcgaccaggtggagtgccaccccgtgtggcagcagggtaagctccgcgcgttctgcgagtccaatgggatacacctctcggcgtactctccgttaggctcgccggggacggcgatggtgaagtcaggagcggtgctcgagcacccggtcgtggtcgccgcggcggagaagctggggaagacgccggcgcaggtggcgctgcgatgggggatccagaaggggcacagcgtgttgccgaagagcacaagtgaggagaggatcaaggcgaacatcgacgtcttcgactggtccatcccggacgacctgtttgccaagttttcagaaatcaaggaggagaagctgattcgggccgatttctttgttcacccggatggcgtcttcaaatccgtcgaagagctctgggacggcgagatatgaatgatccaattaacgtctgggaggttgtttggcgggcgaaaaaaaaatgctcatctgaatttgtgacacaaaagtgttcactttgttgacactggcacccatattattgcaaaaacctgtaatttggaatctccatgatgaactcgcaaatatcatagtggtagtgtgtaccatggatgcagcagcaatacatccacgtttgcaatgcagagtcttcctactctggtgtgggacaatggaatggaaggttattgtaccctgaatcatgctagaaaatgcttgaaaactcacaatttccattttcatctaaactatttgctatatactaggcttgctggtgaaccacaattcaatgctccgtgtactaggtttccattagattgtgagattctctctctctctctttttcagaccatacaagttgttttatatgattattatggaattcctactttgtgaatgaggac

SEQ ID NO: 1309 - DNA, 1337 bp, Sorghum bicolor
atggagagctggttgcggggcccggcctataactgctccgggccgtgtccgacgcgactgcattccatctgccactgtcggggtgtcgaggccgcagatatttcggctccaacctttggaggcaggcaaaaccgcacagggcaccagagtgttggtacgcagcgcgcggtacggcgtatggccacccacttcgtcctcaacaccggcgcgaagatcccgtcggtcgggctcggcacctggcagtccgacaatggactcgtcggcgacgccgtctatgccgccgtgaaggcaggttacaggcacatcgactgtgctcaagcatacaacaacgagaaagaggtcgggtttggtctcaagaaagtgctggacgagggcatagtcaagcgtgaagatctcttcatcacctccaaactctggaacaccaaccatgcgccggaggacgtcccggttgcgctggacggcacactcaagaacctgcaaactgactacgtggatctttacctcatacattggccggtgagaatgaagaaagacgccgggttcggcccgcagagcgtggtcccgtcagatatccccgcgacgtgggcggcgatggagaagctgtacgacgccggcaaggcgcgcgccatcggcgtcagcaacttctcgagcaagaagctagcggacctgctcgccgtggcgcgcgtgcccccggccgtcgaccaggtggagtgccaccccgtgtggcagcagggcaagctccgcgccttctgcgtggccaacgggatccactctccgcctactcgccgttggggtcgccgggaacgatgatggtgaaggcgggcgcggtgctggagcacccggtcgtcgtgtcggcggcggagaagctcgggaagacgccggcgcaggtggcgctgcgctggggcatccagatggggcacagcgtgctcccgaagagcaccgacgaggagaggatcagggcgaacttcgacgtctacgactggtccatcccggacgaattgttcgccaagttctcggagattgagcaggagaagctgattcgcgcgggcttttttgttgatcccgaaggcgtgttcaaatccatcgaagagttttgggatggcgagatctgaatgggaggagctggagtgaggaacttggccagacgtacggggaagaataaatttatgcgtatgaaactgtcaaagacagcgtagttttcgggtacttggtatttggtactacttggtacttggcatactttgtactccaataattttcggtcgtctttaaataatactaatactaatattcaatttgacatcattggcaatttggcattcgttttttacgaactt

SEQ ID NO: 1310 - DNA, 1758 bp, Solanum phureja
aatgcatatcaacttctccctttgagcctcatttattatcacaatccatttaaccatttttttgttgaagaaaattattatcaatggcaaatttgatttcaaaatcaacaaaatttaaccattttcttctaaacacaagggttcgtttcttctcaccatttacaacttcttccggcaacggaggtggtggttttattaagccgacggggagtttttccggcgagtctgccaccatttttcggccggaacgttaccagtccggtaaagctggagagcagctagatacaattgactatgaagaagttgaaaatcaggtgatggattttcctggtggaaaagttccaattacttctcaaatgaagtttatttcggagttgtctgaaaagagattaccttgttatagagttcttgatgatgatggttatccacttccagggacaatctttgaggaggtgagcaaagaattggcaataaagatgtatagttcaatggtgacacttcaaactatggataccattttttatgaagcacaaagacaggggaggttgtctttttatctcacaactgctggagaagaagctatcaacatagcatctgctgctgctctctccttagacgacttcgtgttacctcagtacagggaagtaggggttatattatggcgcggttaccccttggaacaggttgccaatcaattgttcggaaacaagtttgattatggaaaaggaaggcaaatgccatgccaccatggttctaatgagctcaattacttaactgtttcttcgccaatcgcaacacagattcctcaggccgtgggcgttgcttattccctcaagatggaaaaaaaggaggcttgcgcggtcacttactttggagatggcagcaccagtgagggagatttccatgctgcattaaactttgcagcggtactggatgctcctgttgtctttatatgccgcaacaatggatgggccattagcactcctataaaccaacaatttcgaagtgatggaatcgcctctaaaggacaagcgtatggtattagaagcattcgtgtagatggcaacgatgccttggcaacttatagtgctattcgtgcagctcgcaaaatggcaattaaggaacaaaggccaatattagtagaggccatgacatacagagtagctcaccattcaacatctgatgattcaaccaagtatcgacccgtggaggaaatcgaacactggaaaacagcaaaaagtccaatagcaaaattcagaaaatacattcaaagaaatggctggtggagtgatgaaaatgaatccaaacttcgcggagacatcagaaaacaggtgttggaagctattcaagcagcagagaaggtggagaaaccttcattgacaaatttgtttacagatgtttatgacaaaatgccattaaatcttcaagaccaagagaaatctgttaaggatgctgttagaagattcccaaaagaatatccttctgatgttcctatataagcttatagtgttttatgattaggggcagagctacagcttcacaattacttcatttgtgtttaaatattcgcgttatatgtataattaattagtaaactcttatcttctagaattcaaaactcataaactcaaaatcccaactccgtttctgaatagctagctagaatgcaactctgaaattgccaaagttctataaagttatatatatatatataaaaatatctacattaaaaacaaaagttctgaaacaaatgcttga

SEQ ID NO: 1311 - DNA, 1799 bp, Capsicum annuum
ctcattaattatcatcacaatcaaatatttaaccttttgtttttcttcaagaaaattaacaagaaagctctcaaatgacaaatttgatatcaagatcaagaaaatttaaccatttttttctaagtaaaaaagtttgtttcttaacacatctaaatcaaagaaattcaaaaacttcatcatatacaagtgctgccgccggtggtattattaagccggcggcgactttttccggtgagtttcccgccatttttcgactggaacgttaccagtccaataaagctggagaggcacagttcgatacaatatactatgaagaagatggtcatcaccaaattaataatgaaaatcaggtgatggatttccctggaggaaaagttccaataactactcaaatgaaatttattgcagagtcatctgaaaagaggttgccttgttatagagttcttgatgatgatggatatccaattccaggcgcaatctttgaggaggcgagcaaagaattggcagtaaagatgtatagttcaatggtgacacttcaaactatggataccattttttatgaagcacaaaggcaggggaggttgtccttttatctcacaactgctggagaagaagctatcaatatagcatctgctgctgctctcaccctagacgacttcgtgttgcctcagtacagagaagtaggggttatattatggcgcggctaccccctgcaacaggttgccaatcaattgtttggaaacaaatttgattttggaaaaggaaggcaaatgccatgccatcacggttcaaatgagctcaattacttaactgtttcttcaccgatagcaacacagatacctcaggctgcgggcattgcttattctctgaaaatggatggaaaggaggcttgcgccatcacttattttggagatggtagcaccagtgagggagacttccatgctgctttaaactttgcagcagtattggatgctcctgttgtctttatatgccgcaacaatggatgggccattagcactcctataaaccaacaatttcgaagtgatgggatcgcatctaaaggacaatcatatggtattagaagcatccgtgtagatggcaatgatgccttggcaacttatagtgctattcgtgcagctcgtgaaatggcaattaaggaacaaaagccaattttagtagaggccatgacttatagagtagctcaccattcaacttctgatgattcaaccaagtatcgacccgtggaggaaatagaacactggaaaacagcaaaaagcccaatatcaagattcagaaaataccttcaaataaatggctggtggagtgatgaaaatgaatccgaacttcgtggagacatcagaaaacaggtgttgcaagcaattcaagcagccgaaaaagtgcagaaaccttcattgacagatttgtttacagatgtttatgacaaaatgccatcaaatcttcaagagcaagtgaaatttgttaaggatgctgtaaaaagatccccaaaagaatatccttctgatgttcctatatagcctataggcttagtctgttaccactaggctaaatattcgcgtaatatgtataattaattcatctagaaccgagtaaactgcattttccaaattccaggtgtcataaactcaaaatcctaactccatttctggatagctagctagtatgcaactctgaaactgccagggttcattgaagttacatatatagctgcattataaacagaagttctcgaacaatttctcgacttcatctcctgtcttatatgttaatggtgtttattc

SEQ ID NO: 1312 - DNA, 1077 bp, Solanum phureja
acccaccttattttgattcttcttcatttctccattacaaaaaaatcctcttctgctgagcaaaaaaaatcacacaaaaatgggcgatcagatagccagaggtgaagaattcatgaagaaagctgagaaaaaactcagcgggtggggactgttcggctccaaatacgacgatgctgcagatttgttcgataaagctgcgaattgcttcaaactcgctaaatcatgggatcgagctggagcagtatatgtcaaattagcgagttgtcatttgaaattggatagcaaacacgaggctgctggtgcttatgctaatgctgctcattgctacaagaagacaaatataagagaggcaatatcatgtctagagcaggcagtacacatgtttctggacattggaaggctaaatatgtctgcaagatattacaaggaaattgctgagttatatgaacaagagcaaaatttggggcaggctatcacttattatgagaaagcagctgatcttttccagagtgaggatgtaacaacaactgcaaatcagtgcaagcagaaaattgcagaattctctgctaaattagaaaaatatcaaagagcaattgagatctttgaggagatagcacaacactccatcaagaacaacttgttgaagtatggagttagaggtcatcttctgaatgctggtatttgccaactttgtagaggtgatgttgttgcaattaacaatgcattggagcgatatcaggaactggatccaacattttcagggacacgcgagtgcaagttgctagtggatttggaagctgctattgacgaggaagatgttgcaaagtttactggttgtctcaaggaatatgatagcatgacaaagctggatgaatggaggacaacacttcttttgagagtgaaggaagcgttgaaggcgaaggagctagaggaagatgatcttacttaaattattcttatatgaaactggtttgtaaattgcattatttgtgattccaaatatttctacttggtgattgttttcttatctcatgctacttaatttttaacatttcattttgtactgattgagtttga

SEQ ID NO: 1313 - DNA, 1040 bp, Solanum tuberosum
gcttcatttctccattacaaaaaaatcctcttctgctgagcaaaaaaaatcacacaaaaatgggcgatcagatagccagaggtgaagaattcatgaagaaagctgagaaaaaactcagcggttggggactgttcggctccaaatacgacgatgctgcagatttgttcgataaagctgcgaattgcttcaaactcgctaaatcatgggatcgagctggagcagtatatgtcaaattagcgagttgtcatttgaaattggatagcaaacatgaggctgctggtgcttatgctaatgctgctcattgctacaagaagacaaatataagagaggcaatatcatgtctagagcaggcagtacacatgtttctggacattggaaggctaaatatgtctgcaagatattacaaggaaattgctgagttatatgaacaagagcaaaatttggagcaggctatcacttattatgagaaagcagctgatcttttccagagtgaggatgtaacaacaactgcaaatcagtgcaagcagaaaattgcagaattctctgctaaattagaaaaatatcaaagagcaattgagatctttgaggagatagcacaacactccatcaagaacaacttgttgaagtatggagttagaggtcatcttctgaatgctggtatttgccaactttgtagaggtgatgttgttgcaattaacaatgcattggagcgatatcaggaactggatccaacattttcagggacacgcgagtgcaagttgctagtggatttggaagctgctattgacgaggaagatgttgcaaagtttactggttgtctcaaggaatatgatagcatgacaaagctggatgaatggaggacaacacttcttttgagagtgaaggaagcgttgaaagcgaaagagctaaaggaagatgatcttaactaaattattcttatatgaaactggtttgtaaattgcattatttgtgattccaattatttctacttggtgattgttttcttatctcatgctacttaatttttaaacaaaaaaaaa

SEQ ID NO: 1314 - DNA, 1053 bp, Capsicum annuum
ggctgcaggcaaaatcctcttctgccaacccaaaaaacccacaaaacaaaatgggagatcagacagctagaggtgaagaattcttgaagaaagcagagaaaaaacttagcggctggggactattcggttctaaatacgatgacgctgctgaattattcgataaagctgctaattgtttcaaactctctaaaacatgggatcgagctggagcagtatatgtcaaattagcgagttgtcatttgaagatggatagcaaacatgaggctgctagtgcttacgcaaatgctgctcattgctacaagaagacaaatacgagagaggcagtatcatgtctagagcaggcagtacacatgtttctggacaatgggaagctaagtatgtctgcaagatattataaggaaattgctgaattatatgaacaggagcaaaatttggagcaggctctcagttactatgagaaagcagctgatcttttccagagtgaggatataacatcatctgcaaatcagtgcaagcagaaaattgcagaattctctgctaaagtagaaaaatatcaaagagcaattgagatatttgaggagatagcacgatactccatcagtaacaacttgttgaagtatggagttagagggcatcttctgaatgctggtatttgccaactttgtaaaggtgatgttgttgcaattaacaatgctttggagcgttatcaggatctggatccaacattttcagggacacgcgagtgcaagttgctagtggatttggcagcagctattgatgaggaagatgttgcaaagtttactggttgtcttaaggaatatgatagcatgacaaagctggatgaatggaagacgactcttcttctaagagtgaaggaagcattgaaggcgaaggagctagaggaggatgatcttacttaaattgttcgtatctgaaacttgttgtaaattgcattgttaatgatgccaattattctacttggtgattgttttcacatgatgctatttcagtgttgcatatcattctgtacctcggccgcgaccacgcatctgc

SEQ ID NO: 1315 - DNA, 1122 bp, Solanum melongena
attcttcttcattttccatttacaaaaatcctgttctgctaagcaaaaaattcacaacaaaaatgggggatcaaacagctagaggccaagaattcatgaagaaagctgagaagaaactcaacggttggggaatttttggttctaaatacgatgacgctgcagatttgttcgataaagctgctaattgcttcaaactcgctaaatcatgggatcaagctggagcggtatatgtcaaattagcgagttgtcatttgaaattggatagcaaacatgaggctggtagtgcttacgctaatgctgctcattgctacaagaagacaaatataagagaggcaatatcatgtctagagcaggcagtgcagatgtttctggacattggaaggctaaacatgtctgcaagatattacaaggaaattgctgaattatatgaacaagagcaaaatttgaagcaggctatcatttactatgagaaagctgctgatcttttccagagtgaggatgtaacatcatctgcaaatcagtgcaagctgaaaattgctcaattttctgctcaagtagaacaatatcaaagagcaattgagatctttgaggagatagcccggcattccctcagcaacaacttattgaaatatggagttagagggcatcttctgaatgctggtatttgccaactttgtaaaggtgatgttgttgcaatcaacaacgcattggagcaatatcaggaactggacccaacattttcagggactcgtgagtgcaagttgctagtggatttggtagctgctattgacgaggaagatgttgcaacgtttactggttgtctcaaggaatacgatagcatgacaaagctggatgaatggaggacaacacttcttttgagagtgaaggaagcgttgaaggcgaaggagctagaggaagatgatcttacttaaaattgctctatgtgaaattggttgtaaattgcactattcatgatgccaattatttttacttggtgattattttcttatcatgctacttaaatgttatacttgtactgaaagtttgacttccaaattgattgtttgcctggtagttaattttaatgatttcacacaatagagtttttattaaattcctcag

SEQ ID NO: 1316 - DNA, 1119 bp, Nicotiana tabacum
  misc_feature (38)..(38): n is a, c, g, or t
ccgcattattttctttcccttttccttcattttcagantacttcaaacgacagctatcgatcgcccttttgtgctgaccaaaaaacaatgggggatcaaatcgcaagaggtgaagatttcgagaagaaggcagagaagaagctgagcggatggggcctttttggctccaaacacgaagacgccgctgatctcttcgataaagctggcaattgcttcaaactcgccaaatcatgggatcaagccggagcagtatatgttaaattggctaattgtcatcttaagttggatagcaaacatgaggctgctaatgcttatgctgatgctgctcattgctacaagaagtcaaacactaaagaggcaatatcgtgtttagagcaggcagtgaacatgtttctggacattgggaggctaagtatgtctgcaagatattacaaggaaattgctgaattatatgagcaagagcaaaacttggagcaggccatcagttactacgagaaggcagctgatctttaccagagtgaagatgtgacaacaactgcaaatcagtgcaagcagaaagttgcacaattctctgctcaaatagaaaaatatccgagagcaatcgagatctttgaggagattgcacgtcactcagtcaataacaacttgttgaagtatggagttagagggcatcttcttaatgctggcatttgccaactttgtaaaggtgatgttgttgcaatcaacaatgcattggagcgatatcaggagctggatccaacattttcagggacgcgcgaatgcaaattgctagtggatttggcagctgcaattgatgaggaagatgttgcaaagttcactgatgctgtgaaagagtatgatagcatgacacaactggatgcttggaggacaacacttcttctaagagtgaaggaaacattgaaggctaaggagctcgaggaagatgatcttacttaatttgttcccctttgacctattgtaaactactagtacatcctttatgtgattttatttgtactgggtgattgattattatcgtgcttgcgtgaatgcattttttttgaactaattgagtttgaaggttttaatctaatggtcaaagttgaagtcttgaggctg

SEQ ID NO: 1317 - DNA, 1339 bp, Solanum tuberosum
gtacttgtctacgctggtcccaaagcccaacagaaaaggtgcaggccgagaaaaattaaagcccatcaggcgacatacccaccccacccaccccactccaccgaattctcttcttcctttctttgtttttcagattacttcaaacgaaagatatcgctctttgtgctgaccaaaaatgggggatcacatagcaagaggtgaagatttcgagaacaaggctgagaagaaactcggcggatgggcccttttcggttccaaatacgaagacgcagctgatctgttcgataaagctggcaattgctttaaactcgccaaatcatgggataaagctggagcagtatatgttaaattggctaattgtcatcttaaattggatagcaaacatgaggctgcaaatgcttatgcagatgctgctcattgctacaagaagtcaaatattaaagaggcagtatcatgtttagagcaggcagtgaacttttttctggacattgggaggctaaatatgtctgcaagatattacaaggaaattgctgaattatatgagcaagagcaaaatttggatcaggctattaattactatgagaaggcagctgatcttttccagagtgaagatgtaacaacaactgcaaatcaatgcaaacagaaagttgcacaattctctgctcaaatcgagaaatatccgagagcgatcgagatctttgaggagattgcacgtcactcagtcaataacaacttgttgaagtatggagttagagggcatcttcttaacgctggtatttgccaactttgtaaaggtgatgttgttgcaatcaacaatgcgttggagcgatatcaggagctggatccaacattttcagggacacgcgaatgcaaactgctagtggatttggcagctgcaattgatgaggaagatgttgcaaagttcactgatgctgtcaaagagtacgatagcatgacacaactggatgcttggaggacaacacttcttctaagagtcaaggaaacattgaaggcgaaggagctcgaggaagatgatcttacttaatttgttcctctcatctattgtaaactactagctttcatgtgattttatttgtactgggtgattgattgttatcatggttgttaaatccattgtgtttgtactaaatacgagtttgactggtgataaaggtttttgtctaatggtcgaagttaaagccttgaggctgaggttaaaagtccaatttttgtacaattctgtattggtgtgggtatttgtactaccaattatgtgtaaataaatgttcttctcatttggacttagaagaacaataaaaatttgttggttgccaggcgt

SEQ ID NO: 1318 - DNA, 1346 bp, Solanum phureja
  misc_feature (84)..(100): n is a, c, g, or t
tacttttctacgctggtcccaaagcccaacagaaaaggtgcaggccgagaaaaattaaagcccatcaggcgacatccccacccnnnnnnnnnnnnnnnnnactccaccgaattctcttcttcctttctttgtttttcagattacttcaaaagaaagatatcgctctttgtgctgaccaaaaatgggggatcacattgcaagaggggaagatttcgagaacaaggctgagaagaaactcggcggatgggcccttttcggttccaaatacgaagacgcagctgatctgttcgataaagctggcaattgctttaaactcgccaaatcatgggataaagctggagcagtatatgttaaattggctaattgtcatcttaaattggatagcaaacatgaggctgcaaatgcttatgcagatgctgctcattgctacaagaagtcaaatattaaagaggcagtatcatgtttagagcaggcagtgaacttttttctggacattgggaggctaaatatgtctgcaagatattacaaggaaattgctgaattatatgagcaagagcaaaatttggatcaggctattaattactatgagaaggcagctgatcttttccagagtgaagatgtaacaacaactgcaaatcaatgcaaacagaaagttgcacaattctctgctcaaatcgagaaatatccgagagcgatcgagatctttgaggagattgcacgtcactcagtcaataacaacttgttgaagtatggagttagagggcatcttcttaacgctggtatttgccaactttgtaaaggtgatgttgttgcaatcaacaatgcgttggagcgatatcaggagctggatccaacattttcagggacacgcgaatgcaaactgctagtggatttggcagctgcaattgatgaggaagatgttgcaaagttcactgatgctgtcaaagagtacgatagcatgacacaactggatgcttggaggacaacacttcttctaagagtcaaggaaacattgaaggcgaaggagctcgaggaagatgatcttacttaatttgttcctctcatctattgtaaactactagctttcatgtgattttatttgtactgggtgattgattgttatcatggttgtttaaatccattgtgtttgtactaaatacgagtttgactggtgataaaggtttttgtctaatggtcgaagttaaagccttgaggctgaggttaaaagtccaatttttgtacaattctgtattggtgtgggtatttgtactaccaattatgtgtaaataaatgttcttctcatttggacttagaagaacaataaaaatttgttggttgccaggcgt

SEQ ID NO: 1319 - DNA, 1316 bp, Solanum lycopersicum
aagcccaacaaaaaagctgcaggccgagaaaaattaaagcccatcaggcgacatcctcaccccacccacccaccccactcgaccgaattctcttcttccttcctttgttttttcagattacttcaaaggaaagatatcgctctttgtgctgaccaaaaatgggggatcaaatagcaagaggtgaggatttcgagagcaaggctgagaagaaactcggcggatgggccattttcggttccaaatacgaagacgcagctgatctgttcgataaagctggcaattgctttaaactcgccaaatcatgggataaagctggagcagtatatgttaaattggctaattgtcatcttaagttggatagcaaacatgaggctgcaaatgcttatgcagatgctgctcattgctacaagaagtcaaatattaaagaggcagtatcatgtttagagcaggcagtgaacttatttctggacattgggaggctaaatatgtctgcaagatattacaaggaaattgctgaattatatgagcaagagcaaaatttggatcaggctattaattactatgagaaggcagctgatcttttccagagtgaagatgtaactacaactgcaaatcaatgcaaacagaaagttgcacaattctctgctcaaatcgagaaatatccgagagcgatcgagatctttgaggagattgcacgtcactcagtcaataacaacttgttgaagtatggagttagaggacatcttcttaatgctggtatttgccaactttgtaaaggtgatgttgttgcaatcaacaatgcgttggagcgatatcaggagctggatccaacattttcagggacacgtgaatgcaaattgctagtggatttggcagctgcaattgatgaggaagatgttgcaaagttcactgatgctgtcaaagagtacgatagcatgacacaactggatgcttggaggacaacactacttctaagagtcaaggaaacattgaaggcgaaggagcttgaggaagatgatcttacttaatttgttcctctcatgtattgtaaactactagccttcatgtgattttatttgtactggctgattgattgttatcatggttgtttgaatgcattgtgtttgtactagtttaactggttataaaggtttttgtcttaacggtcgaagttgatgccttgaggctgagattaaaagtcgaagttttgtacaattctgtattggtgtgggtatttgtacttccaattatgtgtaaataaatgttcttctcgtttggactagaagaacaataaaaatgtgccttatattttggtc

SEQ ID NO: 1320 - DNA, 1255 bp, Petunia hybrida
gcgggggcacttttctcctttatacattttcaattccttgaaacaacagcaaacaacaagcatcaatttgccttgtgaaaaaatgggagatcacataggaagagctgaagatttcgagaaaaaggctgagaaaaagctaactggatggggccttttcggttctaaatatgaagacgctgctgatctctttgataaagctggcaattcttataaactcgccaaatcatgggatcaagctggagcagtgtatgttaaattggctaattgtcatcttaagttggacagcaaacatgaggctgctaatgcttatgctgatgctgctcattgctacaagaaatcaaataccaaagaggcaatatcgtgtctagagcaggccgtgaacttgtttctggacattgggaggctgaatatgtctgcaagatattacaaggaaattgctgaattatatgagcaagatgcaaatttggagctagctatcagttactacgagaaggcagctgatcttttccagagcgaagatgtaacaacaactgcaaatcagtgcaagcagaaagttgctcaattctctgctcaaatagagaaatatcagagagcaattgagatatttgaggagattgcacgtcactcaatcagtaacaacttgttgaagtatggagttagaggtcatcttcttaatgctggtatttgccaactttgtaaaggtgatgttgttgcaatcaacaatgcattggagcgatatcaggatctggacccaacattttcagggacacgtgaatgcaaattgctagtggatttggcagctgcgattgatgaggaagatgttgcaaagttcacagatgctgtcaaagagtatgatagcatgacacaactggatgcttggaggacaacacttcttctaagagttaaggaaacattgaaggctaaggagctcgaggaagatgatcttacttaatttgttcctatctgacctattgtaaactactagtacatcatttatgtgattttatttctactgggtgattgtttgttatcatgcttgcttgaaaacattttatttgtactaatcgagtttgactggttacaaggttttatcttgatggtcaaagttgaagattgaggctgagagctctcaggtcaatccgaatctaagtccaagtttcgtacaattctgtgtaggttgctattccactctatgtgagtatttgtactactgtcgactatgtgtacataaatgttactcctattatcatttgga

SEQ ID NO: 1321 - DNA, 1138 bp, Nicotiana tabacum
  misc_feature (38)..(38): n is a, c, g, or t
  misc_feature (109)..(109): n is a, c, g, or t
  misc_feature (116)..(116): n is a, c, g, or t
  misc_feature (186)..(186): n is a, c, g, or t
  misc_feature (259)..(259): n is a, c, g, or t
  misc_feature (480)..(480): n is a, c, g, or t
  misc_feature (483)..(483): n is a, c, g, or t
  misc_feature (492)..(492): n is a, c, g, or t
  misc_feature (933)..(933): n is a, c, g, or t
  misc_feature (935)..(935): n is a, c, g, or t
  misc_feature (940)..(940): n is a, c, g, or t
  misc_feature (959)..(959): n is a, c, g, or t
  misc_feature (989)..(989): n is a, c, g, or t
  misc_feature (996)..(997): n is a, c, g, or t
tccaaacacgatgacgctgctgatttgttcgataaagntgctaattgtttcaaactcgctaaatcatgggatcaagctggagcagtatatgtcaaagtagcgaattgtnatctgangttggatagcaaacatgaggctgctggtgcttatgctaatgctgctcattgctacaagaagacaaatacnagagaggcaatatcatgtctagagcaggcagtacacatgtttctggacattggaaggctaaatatgtctgcangatattacaaggaaattgctgaattatatgaacaagagcaaaatttggagcaggctatcatttactatgagaaagctgctgatcttttccaaagtgaggatgtaacaacatctgcaaatcagtgcaagcagaaaattgcacaattctctgctgaactagaaaaatatcaaagagcaattgagatctttgaggagatagcacggcactctgtcaacaacaanttnttgaagtanggagttagagggcatcttctaaatgctggtatttgccaactttgtaaaggtgatgttgttgcaataaacaatgcattggagcgatatcaggaactggatccaacattttcagggacacgcgagtgcaagttgctagtggatttggccgctgctattgacgaggaagatgttgctaagttcactggttctgtcaaggaatatgatagcatgacaaagctggatgctttgcggacaacacttcttctcagagtgaaggaagcattgaaggcgaaggagctagaggaagatgatcttacttaaattgatcttctctgaaactggttgtaaattgcattgcttatgatgccaatttatttctactgattgattgtttcttatcatgttacttatacatctcatattgtattggttgagtatgactatcaaattgagttcgactancnacaangttttagcctggtagtcgntattgatggattgcatagagttctttgttnaatttcnnataaaaatgcatagttttgtctatgttggttgagtttgactaccaaatttagaggcaaaacagctttcagatggtaatattgttactgggagatgggatagaggaagtgattggagtattaagaacttctatagagtacta

SEQ ID NO: 1322 - DNA, 1235 bp, Triphysaria pusilla
atagcaaaaacaatcatcattttttatattgtcactcctatttcctttcctctttcgtctattacttcaaaatccagcgacacagaccaccattgttgccgtgaagaagaaaaaagagagataaagaatgggtgatcaagtcgcgaggggcgaagagtttgtgaagaaagccgagaagaagctgagcggctggggactcttcggctctaaatacgaagatgccgccgagttgttcgataaagccgctaactccttcaagcttgccaaatcatgggatcaggctggagcagtgtatgttaagttggcaaactgtcacttgaaattggatagcaagcatgaagctgctaatgcatatgctgacgctgctcattgctacaaaaagaccaatataaaagagtcaatatcatgcttggagcaagctgtgactatgtttctggatattggaaggcatagtatgtctgccagatactacaaggaaatagcggagttgtatgagcaagaacagaacttagagcaagctattgtttactatgagagagctgctgatctcttctcaagtgaagacgtaacaacatctgcgaatcagtgcaagcagaaaattgcgcaatttgctgctcaaattgaacaatatcaaaagtctatcgagatttatgaagagatagcacgacactctctcagtaataacttgttgaagtatggagttaaagggcatcttcttaatgctggtatttgccagctctgcaagggtgatgttgttgcaattaccaatgcattagagaaataccaggaattggatcctacattttctggaacacgcgagtacaaaatgttatcggatttggctgctgcaattgatgaggaagatatcggtcaatttactgctgctgtcaaggaatatgatagcatgacccagctggatgcttggaagacgacacttttgttgagagttaaggaggccttgaaagccaaggagctagaagatgatgatcttacctaagcctaagcagccttatatattctcgattgctcggtgtttctattgattactttgtgatggttgttgtcttctttgtgcctttatgacgcgaggtttcatgtgtgtattatgataactgggtttttcttatttggagtgaatatgagtgcttttgtaaccatgctttttgtcacttaactagtatgccatatacacgcttgatatttcatactataataatgccatgatcgaacttatg

SEQ ID NO: 1323 - DNA, 1194 bp, Triphysaria pusilla
tcaaattttgctggtattatcgctcccatttcctttcctctttcgacttttccttcaaaattcatcaacagagaccaccattgttggcgtgaagaagaagaaaaaggagagataaacaatgggcgatcaaatcgcaagaggcgaagaattcgagaagaaagccgagaagaagctgagcggctggggactattcggctctaaatacgaagacgccgccgagttgttcgataaagccgccaacgccttcaagcttgccaaatcatgggatcaggctggagcagtgtatgttaagttggcaaactgccatttgaaattggatagcaaacatgaagctgctaatgcatatgctgacgctgctcattgctacaaaaagaccaacataaaagagtcaatatcatgcttggagcaatctgtgaacatgtttctggatattggaaggcataatatgtctgccagatactacaaggaaatagccgagttgtatgagcaagaacataacttagagcaggctattgcttactatgagagagctgctgatctcttctcaagcgaagacgtaacaacatctgcgaatcagtgcaagcagaaaattgcgcaatttgctgctcaaattgaacaatatcaaaagtctgtcgagatttatgaagagatagcacggcactctctcagtaataacttgttgaagtatggggttaaagggcatcttcttaatgctggtatttgccagctctgtaagggtgatgttgttgcaataaccaacgcattagagaaatatcaggaattggatcctacattttctggaacacgcgagtacaagttgttagcggatttggctgctgcagttgatgaggaagatattggtaaattcactgctgctgtcaaggaatacgatagcatgacccagctggatgcctggaagacgacacttttattgagagttaaggaagccctcaaagccaaagagcttgaagatgatgatcttacctaaagccgcctactatatttctccaattgctctgtgtttctactttctattaattgttttgtgaaggttgttgtcttcattgtgcctttatgactctaggtttcttgtgtgttttattataattttgggcttttcttatttggagtgaatatgattgattctataaccatgatttctgtaacttaactagtttgtcatatacatgcttg

SEQ ID NO: 1324 - DNA, 1093 bp, Ipomoea nil
gtaacgtttccatctctcatttttgctccctcacagaccacaatgggtgatcaggttgccagaggagaagaattcgagaagaaagccgagaagaagctcagcggatgggcgctcttcagctccaaatatgaagacgccgctgatttcttcgagaaagccgccaattgcttcaagctcgctaagtcatgggatcaagctggagcgacatatgtcaagttggccaattgtcatttgaagctggacagtaaacatgaggctgctggtgcatttgctgatgctggtcacaactacaagaagataaatactagagaggctgtatcttgtctagaacatgcagtaaacttatttctggaaattgggaggctgaatatgtcggcaagatattacaaggaaattgctgaaatatatgagcaagagcaaaaccttgaacaggccattgcgtactatgaaaaagcagctgatcttttccaagcagaggatgtatccacaactgcaaatcagtgcaagcagaaaattgcacaattttctgctcagttagaaaaatatccaagagcaattgaaatatttgaggatatagcacggcaatctgttagtaacaacctgttgaaatatggagttagagggcatcttcttaatgctggtatttgccaactatgtaaaggtgatgttgttgcaattaacaatgctttagagaaataccaggatctggatccatcattctcagggacaagggagttcaaactactaagtgatctggctgctgcattggatgaagaagatgttgcaaagttcactgatgctgtcaaggaatttgacagcatgagccaactggatgcttggaggaccacccttctgcttagggtgaaggaatcgatcaaggcaaaagaactagaggaggatgatcttacttaaactcggttcttttgacagtggatgttatgtggtttgtgggttatatgatgatgatttattctagcagggtggtgtatggtttttattgttctcacttatcttccaagtatttctgcatgctttaacttttggttctttggagtggaatatttgcgatgtatgttgaccattgagttgagat

SEQ ID NO: 1325 - DNA, 1258 bp, Orobanche aegyptiaca
aaaaaggtgctcgcaacgataggaaaagtgaccctatcttttttgatcttgcgagacccagtttctttcctctttcgtttttccttcaccagccagcaagacagaacgccatttttgtgtgaagaaaagacagaagagatactatgggcgatcaagtagcgagagccgaagatttcgagagaaaagccgagaaaaagctaagcagctgggttcacttcggctctaaatacgaagacgccgccgatttgtttgataaagccgctaacgccttcaagcttgcgaaatcatgggatcaggctggggcggtgtatgttaagttggcgaactgtcacttgaaattggatagcaagcatgaagctgctaatgcatatgctgacgctgctcattgctacaaaaaaaccaacataagagagtcagtatcatgccttgagcaatctgtaaatttgtttctggatattggaaggcttaatatgtctgcaagatattacaaggaaatagccgagttatatgagcaagaacaaaacttagagcaggctattgtatactatgagagagctgctgatctcttccaaagtgaagaagtaacaacatctgcaaatcagtgcaaacaaaaaattgcgcaatttgctgctcaacttgaacaatatcaaaaggctgtcgagatttatgaagagatagcgagacactcccttaataataacttgttgaagtatggagttaaagggcaccttcttaatgctggtatttgccagctctgcaagggtgatgttgttgcaataaccaatgcattggagaaataccaggagttggatcctacattttctggaacacgcgagtacaaattgctagcggatttagctgcggcggttgatgaggaagatgtccctaagttcactgctgctgtcaaggaatttgatagcatgactcaactggatgcttggaagacaacacttttgttgagagtgaaggaggccttgaaagccaaagagttggaagaagatgatcttacctaaacctaattctctggattggacggtgtttctaatggtttactttgtgatggttgttgtctcgttgtgtgtctttactactcgaggcttgtgtgtattataactgggatttctgatttggagtgaatatgtttgcgtttttaactgtcttctgccatataaatgtttgccaattcattctattttcattatggagaaataaatgttgcactacgaattgaatgaacttttattggttgccagaacgg

SEQ ID NO: 1326 - DNA, 1208 bp, Mimulus guttatus
caagtgcttttgtttgacaatagcaaaaatgattaatcatttttgatatctccactcccatcccccattttctctgttctgattcattttcctttactctttcgttttccttcaaaatccagcaacacagaccaccatttttaaggaattaacaatgggcgatcatgtggccagaggcgaagatttcgagaagaaagctgagaagaagctcagcggctggggcatcttcggctctaaacacgaagacgccgcagatttgttcgataaagccgccaatgccttcaagctcgccaaatcatgggatcaagctggagccgtgtatgttaagttggctaactgccacttgaagttggacagtaaacatgaagctgctaactcgtatgctgatgctgctcactgctacaaaaaaggcaacgcaaaagaggcaataccttgcctagagcaatcagtaaacttatttctggatattggaaggcttaatatgtctgccagatattataaggaaattgcagagttgtatgagcaagaacagaacctggagcaggctattgtttactatgagagagctgctgatctcttccaaagtgaagatgtaacaacatccgcaaaccagtgcaaacagaaaattgctcaatatgctgctcaactggaacaatatcagaaatccatcgatatttatgaagatatagcacggcagtctctcaataataacttgctgaagtatggagttaaagggcaccttcttaatgctggtatttgccagctctgcaagggtgacgttgttgcaattaccaatgcattagagagataccaggacttggatcccacgttttctggaacacgtgaatacaaattgttatcggagttagctgctgcagttgatgaagaagatattgctaagttcactgatgctgtcaaggaatttgacagcatgacccagctggatgcttggaagacaacccttctattgagagtgaaggaggccgtgaaagcgaaagagctagaggaggacgacctcacttgatcctattattttttttcttgattgtacgttttttaatgatttggacgttgtttcgcgatgattgtctcgtttatggcttgttacatttggtggcttttgtgtgtattattacgggatctgttatttggagtgaatattagtgtttcctcaaccatggttttatgtaactaaatgagtttaccac

SEQ ID NO: 1327 - DNA, 3385 bp, Sorghum bicolor
atgcactggacatgccactcaatgcatgcagagctgctcacagctgccactgctcactccccgccattactcgtattcactactaccacagcagcagcacctctctctctctaggcatctcctcctcactgtcttgcatttcatagttcacacagttcacgctgcagggcagtggccatagagagtagagctgtacaaaggggtgagctcgtgagggagtgaggaaaaaaccaacggagcacaacggaaatgctgtcattttctcgctcggccatcctctcctacctactgtggtgccttttatttctcaccttggcaagcagcaatggcgtggtcgccacagcaaagccgaaggttgggtacgggtacaagctggtctcccttgttcagctgcccaacggcggaggccttgtgggctacctgcaggtgaagcagtgcacctccacttacggtcctgacatccctcgcctcaggctctttgttaagcacgagaccagggacagggtgcgcgtgcagatcaccgctgcagataagcagaggtgggaggtcccctacaacctgctcccaagggagccagcgccacccgtgaccggcagcaaggtcacgggcgcgcccttcacgggcgccgagtaccccggcgaggagctggtgttcacctatggccgcgacccgttctggttcgcggtgcaccgccggtccacgaggcagccgctgttcaacaccagcgccggcgtgctggtcttcaaggaccagtacctggaggtgtccacggcgctgcccaaggacgccgccctgtacgggctcggcgagaacacgcagcccgggggtatcaggctgcggcccaacgacccttacaccatctacaccacggacatctccgccatcaacctcaacaccgacctctacggctcgcacccggtgtacatggacctccggagcctcggcggccgcggcgtcgcgcacgccgtgctgctgctcaacagcaatggcatggacgtgttctacagggggacgtcgctgacatacaaggtcatcggaggtcttctcgacttctacttcttcgccgggccgacgccgttggccatcgtggatcagtacacttcgatgatcggccgtcccgcgcccatgccatactgggcatttgggttccaccaatgtaggtgggggtacaagaacctttcagtggtagagggcgttgtggagggttatcggaatgcccagataccgctggacgtgatctggaatgatgatgaccacatggatgccgctaaggacttcacacttgatccggtcaactacccacgccccaaactgctggcattccttgacaagatccatgcgcaagggatgaagtacattgtcctcatcgaccctggcattgctgtgaacagctcctatggcgtctaccagcgtggcatggaacgtgacatcttcatcaaactggatggggagccatacctcgcccaggtgtggcctggtcctgtctacttcccagactttctcaacccgaacggcgcgtcatggtggatcgacgaggtgcggaggtttcatgatttggtcccggtggatgggctctggattgacatgaacgaggcctccaacttctgcacgggcaagtgcacaatcccaaagacacaccagtgccctattcctgactccaagacaccatgggtctgctgtttggattgcaagaaccttacaaacacaaggtgggatgagccgccatacaagatcaatgcctctgggcagactgctcgtctcggcttcaacaccattgcaaccagtgctacacactacaatggcatcctggagtacaacgcacacagtctgtatggcttctcgcaggccattgccacgcataaggcgctgcaagggctgcaggggaagaggccgttcattctgacccgctccacgttcgtcggctcgggggcatacgccgcgcactggaccggcgacaacaagggcacttgggaaaatctccgctattccatctcaacgatgctcaactttggcatcttcggcatgccaatggttggctctgacatctgtggcttctacccggcgccgactgaggagctctgcaacaggtggattgagctcggggccttctacccgttctccagggaccatgccaacttcgcgtcaccgaggcaggagctctacgtctgggagtccgtggcgaagtcggcacggaacgcgctcggcatgcggtacaagctgctcccctacctgtacacgctcagctaccaggcgcacctgaccggggcacccgtggcgcgcccggtgttcttctccttccccgacttcacgccgtgctacgggctgagcacacagttcctgctcggcgccagcgtcatggtgtccccagtcctcgagcagggcgccacttcggtgagcgccatgttcccaccgggcacctggtacaacctgttcgacatgaggaaggtggtggtgtccaagagcagcgcccccgtgacgctggaggcgccgctgaacgagatcaacgtgcacgtgttccagaacacgatcctgccgatgcagcgcggcgggttcgtctccaaggacgcccgggcgacgccgttcacgctcgtggtcgcgttcccgttcggggcgacgcaggcggacgcggagggcgcggtgtacgtggacgacgacgagcggccggagatggtgctcgcggaagggcaggcgacgtacgcgcgcttccacgcgagcgtgcgcggcaaggccgtgacggtgcggtcggaggtgctgatgggaagctacagcctgcacaaggggctggtcatcgagaagctgtcggtgctgggtctggagggcaccggcaaggacctcgccatccaggtggacggcacggacgccaccaccgccgtcgcgacgtcgagcccttacttcgcggcaggtggcaacgcgaagctgcatggggaagaaggcgtcgaggatagcaacaagagcgtcatggtggaggtcggcgggctggcattgccgctggggaagagcttcaccatgacctggaacatgcggatcgaagcataggtcaagtggtgatgtgcttccatctccatgaattcgcttaagacgtgttctatttgtgtcatccgggagtgctctgtgcaaggagcagagtacacagagaatcttcctaagcattgttgcaataaaagattgagtctttagcgttggagttgggcctttttaggtggactaaactaaaatttagttcatgttttggatgccaattagagggtttaaacatgaactcattatggtctaatagaaactaatactccctccatcccaaattgtaagtcattctaagaatcttggaaagtcaaacttttctaagtttgaccaaatttataggataaaataataattattatta

SEQ ID NO: 1328 - DNA, 3136 bp, Pennisetum glaucum
accgcattttctgttctcactccactgttttttcccctccctgcctcacgagctccctttctacagctacgctgtgggcactggaacgcagtgtgaggaacgctgtgggcactagagggaagaggagaggagagaggaaggctgcagctgtctgcggtggtgaatacgagtaatggcgcggtcgccgcagcgaacccaaaggttgggttcgggtacaagctggtgtcactggttcagctgcccaatgggggaggccttgtgggctgcctgcaggtgaagcaacggacctccacctatggccctgacatccctcgcctcaggctcttcgtcaagcacgagacgagggaaagggtgcgcgtgcagatcaccgatgcagataagcagaggtgggaggtcccctacaacctgctcccgagggagccagccccacccgtggccggcggcaagttcacgggcgcccccttcaccgccgccgagtaccccggcgaggagctcgtgttcacctacggtcgggacccgttctggttcgccgtccaccgccggtccacccggcagccgctgttcaacaccagcgccggcgcgctggtgttcaaggaccagtacctggaggtgtccacggcgctgcccaaggacgcggcgctgtacgggctcggcgagaacacgcagccgggtggcatccggctgcggcccaacgacccctacaccctctacaccacggacatctccgccatcaacctcaacaccgacctctacggctcgcacccggtgtacatggacctccggaacctgggcggccgcggcgtcgcgcacgccgtgctgctgctcaacagcaacggcatggatgtgttctacagggggacctcgctgacgtacaaggtcatcggaggccttctcgacttctacttcttcgccgggccgacgccgttggccatcgtggatcagtacacgtccatgatcggccgccccgcgcccatgccgtactgggcatttggattccaccaatgcaggtgggggtacaagaacctttcggtggttgagggtgttgtggagggctaccggaatgcccagataccccttgacgtgatatggaatgatgatgatcacatggatgctgccaaggacttcacactcgaccctgtcaactacccgcggccgaagctgctagcattcctcgacaagatccatgcacaagggatgaagtacattgtcctcattgaccctggcatcgctgtgaacaactcctatggcgtctaccagcgtggcatggcgcgtgacatcttcatcaagctggatgggcagccataccttgctcaggtctggcctggccctgtctacttccccgacttccttaacccgaacggtgtgtcatggtggatcgatgaggtgcggaggtttcatgaccttgtcccagtggatggtctctggatcgacatgaacgaagcatccaacttctgcactggcaagtgcacaatcccaaagacgcaccagtgccctattcctgactccaagacaccatgggtgtgctgcctggattgcaagaacctcacaaacaccagatgggacgagccgccttacaagatcaatgcctcgggacagactgctcggctcggcttcaacaccattgcaacaagtgccactcactacaatggcatcctggagtacaatgcacacagcttgtacggcttctcgcaggccattgccacgcacaaggcgctgcaagggctgcaggggaagaggcccttcatcctgacacgctccactttcgtcgggtcaggggcatatgccgcacactggaccggcgacaacaagggcacatgggaaaatctccggtactccatctcgacaatgctcaactttggcatcttcggcatgcccatggttggcgcggacatctgcggtttctacccgtcaccaacagaggagctctgcaaccggtggattgagctcggggccttctacccgttctccagggaccatgccaacttcgcctcgccgagacaggagctctacgtgtgggagtccgtggcgaagtcggcgcggaacgcgctcggcatgcggtacaagctgctcccgtacctgtacacgctcaactaccaggcgcacctgaccggcgcccccgtggcgcggcctgtgttcttctccttcccggacttcacaccgtgctacgggctgagcacgcagttcctgctcggctcgagcgtcatggtgtccccggtgctcgaggaaggcgccacctcggtgagcgccatgttcccgccgggcacctggtacaatctgttcgacacgtcgaaggtggtggtgtccaagagcggcgcccccgtgaggcttgaggcgccgctgaacgaagtcaacgtgcacatgtaccagggcacggtcctgccgatgcagcgcggcggggtgatctccaaggaggcccggttgacgccgttcacgctggtggtcgcgttcccctacggcgccacgcaggcggacgctgagggcgcggtgtacgtggacgacgacgagcggccggagatggtgctcgcggaggggcaggcgacgtacgtgcgcttccacgccagcgtgcgcggcaaggccgtgacggtgcggtcggaggtgcagatggggagcttcagcctgcacgagggcctggtcatcgagaaggtgtcggtgctggggctggagggcaccggcagggacctcgccatccaggtcgacggcgcagacgccaccgccgtcgcgacgtcgagcccttacttcgctgccggtggcaacatgaagctgcaaggggaagatggcttcgaggacaacaagaagagcgtctcggtggaggtcggcgggctggcactgccgctggggaagagcttcaccatgacctggaacatgcggatcgaagcataggtcttcatcggtgcttccgtctgcaatgagcttgcttaagccttgctccatgtctgatttagatggtagatcttgccattgctggtggaatatagatcctgaacactcgtcatctgggggtgctctgcgcaaagagcagcgcactcggacagtgacacaggatctctgatttttcatcaggatttgagcctcgctggaataagattgaatatttaacgtttgcataatatgatgattgatgaatgaagacatgacg

SEQ ID NO: 1329 - DNA, 3200 bp, Oryza sativa
caatgaacatgcatgccactcaatgcatgcagtgcagtagaggaggagtactgacactgctcagcgtccctctccctgcacatttactcgtatgcacagcacaacacacactcctctcctctcctatctccaggctcacagatgagctgtgagctgtgtgtgtgacacagtctactgctctctctgtacaaagggagagggtgagaggaaattaacagaggaaggagggagaagaaatgcgagaaatgctggcgtctctctcttcttcgtcccgtgcggccatctcctgcatcccgttgtgtctcctcttcctgaccttggcgagcagcaatggcgtgtttgccgcagcaccacccaaggttgggtccgggtacaagcttgtgtccctggtcgagcaccccgagggaggagctctcgttggatacctgcaggtgaagcagcgcacctccacctacggcccggacatccctctcctcaggctctatgtcaagcacgagaccaaggacaggatacgagtccagatcacggacgcagacaagccgaggtgggaggtcccctacaaccttctccagagggagccagccccgcccgtcaccggcgggaggatcaccggcgtgcccttcgccgccggcgagtacccgggtgaggagctcgtgttcacctacggccgcgacccgttctggttcgcggtgcaccggaagtccagccgcgaggcgctcttcaacaccagctgcggcgcgctggtgttcaaggaccagtacatcgaggcgtcgacgtcgctgcccagggacgcggcgctgtacggcctcggcgagaacacgcagccgggcggcatccggctgcgccccaacgacccgtacaccatctacaccacggacatctcggcgatcaacctcaacaccgacctctacggctcgcacccggtgtacgtggacctcaggagccgtggcggccatggcgtcgcgcacgccgtgctgctgctgaacagcaacggcatggacgtgttctacagggggacgtcgctgacgtacaaggtcatcggtggcctcctcgatttctacctcttctccgggccgacgccgttggccgtggtggatcagtacacgtccatgatcggacgaccagccccaatgccgtactgggcatttgggttccaccaatgcagatggggatacaagaacttgtcagtggtcgagggcgtcgtggagggctaccggaacgcgcaaatccccctcgacgtgatctggaacgacgacgatcacatggacgccgcgaaggatttcacccttgatcccgtgaactacccgcgtcccaagctgctggaattccttgacaagatccatgcacagggcatgaagtacattgtcctcatcgaccccggcatcgccgtgaacaacacctatggcgtgtaccagcgcggcatgcagggcgacgtcttcatcaagctggacgggaagccatacctggcgcaggtgtggcccggccccgtctacttcccggacttcctcaaccccaatggcgtctcgtggtggatcgacgaggtgaggaggtttcatgaccttgtgcccgtggatggcctctggatcgacatgaacgaggcatccaacttctgcaccgggaaatgcgagatcccgacgacgcacctgtgccctctgcccaacacgacgacgccatgggtgtgctgcttggactgcaagaacctgacgaacaccaggtgggacgagccgccgtacaagatcaacgcctccggccagacggcgcggctcggcttcaacaccatcgccaccagcgcgacgcactacaatggcatcctggagtacaatgcgcacagcctgtatggattctcgcaggccatcgcgacgcaccaggcgctgcaggggctccagggcaagcggccgttcatcctgacgcgctctacgttcgtcgggtcgggcgcctacgccgcgcactggaccggcgacaacaagggcacctgggagaatctccgctactccatctccaccatgctcaacttcggcatcttcggcatgccgatggtcggcgccgacatctgcgggttctacccgcagccgacggaggagctctgcaaccggtggatcgagctcggcgcgttctacccgttctccagggaccatgccaacttcgcgtcgccgaggcaggagctgtatgtgtgggagtccgtggccaagtcggctcggaacgcgctcggcatgcggtacaggctgctcccttacctgtacacgctcaactaccaggcgcatctcaccggcgctccggtggcgcggccggtgttcttctcgttcccggacttcacgccgtgctacgggctgagcacgcagtacctgctcggcgcgagcgtcatggtgtcgccggtgctcgagcagggcgccacctcggtgagcgccatgttcccgccggggagctggtacaacctgttcgacacgaccaaggtggtggtgtccaggggcgagggcgccgtgaagctggacgcgccgctcaacgagatcaacgtgcacgtgttccagaacacgatcctcccgatgcagcgcggcgggacgatctccaaggaggcccgcgcgacgccgttcacgctggtggtcgcgttcccgttcggcgccaccgaggcggaggccgagggcgccgtgtacgtcgacgacgacgagcggccggagatggtgctcgcggaggggcaggcgacgtacgtccgcttctacgcgacggtgcgcggcaaggcggtgacggtgaggtcggaggtggagctaggcagctacagcttgcagaaggggctcctcatcgagaagctgtccgtgctcggactggagggaacaggcagggacctcgccgtccatgtcgatggcgcgaacgccaccgccattgcaacgtcgaggccgtactttgcaggtgccgaggcggagctgcacgggcaccgcgacgtggagggacacaagaagagcgtgatggtggaggtgggagggctggcattgccgctgggcaagagcttcaccatgacttggaacatgcagatcgaagcatagatcgaagctttcttatgctttcatctgcatttctccattctgtctctctgattattttaggttctagatcagcaaggttatgtcaacgtgttcaacgacacaccaccatctctgattctcttctgcatttgaatccttgtggaaataaaacatgattctaaacat

SEQ ID NO: 1330 - DNA, 3306 bp, Triticum aestivum
ggccactcatcactcgacgcatgcagtgtaccgccgcacactgacatcgctcgctcgctctctctcccctcattactcgcatcattacagctccctctgtctcactccctatccgtctctgctccatctgactctcccacaatccacacctgcgacacgtctctgtgcgagcgcagtgtgctccgccagtgagcggggagtggaaggagaatccggccggcgggacaagcacggacggccagcaatgctccctcgctcgcctccccacctcctgccatggcggtcccttgtgctcctcttcctggccttggcggtcagcagcaatggcgtttctgcgaccgccaaggcaaaggccaaggcaccggcggcgccgcccaagccggccgggttcgggtacaagctggtgtccctggtccagcgccccaacggcggcggcctcgtcggctgcctccaggtgaagcgccgctcctccacctacggccctgacatcccccgcctcaggctcttcgtcaagcacgagaccaaggacagggtgcgggtgcagataacggacgcggagaagcagaggtgggaggtcccctacgacctgctcccgcgggagccatccccgcccctcgggcccgccaccgccggcggcgcccccttcaccgccggcgagtacccggggcaggacctcgtcttcacctacggccgcgacccgttctggttcgccgtgcaccgcaaatccacccgtcaaaccctcttcaacaccagccgcgccccgctggtgttcaaggaccagtacctggaggtgtccacgcggctgcccggcgacgccgcgctctacggcctcggcgagaacacgcagcccggcggcatcaagctccggcccaacgacccctacacgctctacaccaccgacgcctccgccatcaacctcaacaccgacctctacggctcccacccggtgtacgtcgacctccggaacatcggcggccgcggcgtcgcgcacgccgtgctgctcctcaacagcaacggaatggacgtgttctacaccggcacctcgctgacttacaaggtcatcggcggcctcctcgacttctacttcttcgccgggccgacgccgctggccgtggtggaccagtacaccgccatgatcggccgccccgcgcccatgccgtattgggcatttgggttccaccaatgcaggtggggataccataacctttcggtggtcgaggatgtcgtggagaactaccggagcgcgcagatccccctcgacgtgatctggaacgacgacgaccatatggacgccaggaaggacttcacgctcagccccgtcaactacccgcgccccaagctgctggcgttcctcgacaagatccacgcgcgcgggatgaagtacattgtcctcatcgaccccggcatcaacgtgaacagcacctacggcgtgtaccagcgcggcatggaccgcgacatcttcatcaagctcgacgggcagccatacctcgcccaggtctggcccggccccgtctacttcccggacttcatcaacccgaacggcgcctcgtggtggatcgacgaggtgcgccggttccacgagcttgtcccggtggacggcctctggatcgacatgaacgaggcctccaacttctgcaccggcaaatgcaccatcccgaccacgcaccggtgcccggacccgacgtcgaaggagccgtggctgtgctgcctggactgcaagaacatcaccaacaccaggtgggacgagccgccgtacaagatcaacgcctccgggaagtcggcccgtctcggctacaacaccatcgccaccagcgccgtgcactacaatggcatcctggagtacaatgcccacagcttgtatggcttctcgcaggccatcgccacgcacaaggggctgcagagcatccagggcaagaggccgttcatcctgacgcggtccacgttcgtcggctccggcgcctacgccgcgcactggaccggcgacaacaagggcacctgggaggacctccgctactccatctcgacaatgctcaacttcggcatcttcggcatgcccatggtcggctccgacatctgcggcttctacccggccagcccgccgccgctggaggagctctgcagccggtggatcgagctcggcgccttctaccccttctccagggaccacgccaacttcgcctccccgaggcaggagctgtaccagtggcagtccgtggcgaggtcggcccggaacgcgctcggcatgcgctacaggatgctcccgtacctctacacgctcaactaccaggcgcacctcaccggcgctcccgtggcgcgcccgctcttcttctccttcccggacttcgcgccgtgctacggcgtgagcaggcagttcctcctcggcgccggcgtcatggtgtcccccgtcctcgagcagggcgccagctccgtggacgcggtgttcccgccgggcacgtggtacaacctgttcgacaccagcaaggcggtcgtgtccacgggctccggcgccgccgtcaggctcccggccccgctgaacgaggtgaacgtgcacgtgcaccagggcacggtcctgccgctgcagcgcggcggcaccatctcccgggacgcgcgcgcgacgccgttcacgctggtggtggcgttccctctcggcgcggcggacgcggacgcggagggcgccgtgtacgtggacgacgacgagcggcccgccatggtgctcgcggaggggcaggcgacgtacgcgcggttccacgcggccgtgcgcgggggcaaggaggtgacggtgcggtcggacgtggccatggggagctacagcatgcacaagggcctcgtcatcgagaagatcaccgtgctggggctgcacggcgccggcacggacctcgccatccaggtcgacggcgcggacgacgccaccgcggtcgccacgtcgagcccctacttcgcggccgcggacgccgcgcaggtgctgcgccaaggagaagaagaggacgccgtggagggtgagaagaggggcgtgacgatggaggtgggcgggctggcgttgccgctggggaagagcttcaccatgacgtggaacatgcacatcgaagcataggttaatcgagctacatttgcctgtgcttccatctgcatgcccgttcttcgtttgattactcgcgtatctaatctagagtctagtggttccgtaacttgtgtgggggttggttacttaccctcgaacaccattttctgaactctgattcgccattgaagctcactcttgcagggaacaataaaactgcatttcggccaaaaaaaaaaaaaaaacga

SEQ ID NO: 1331 - DNA, 3273 bp, Brachypodium distachyon
actgcatgctgtacaatggcactcaatgcatgcaggaccgagtactgacactgttcacaccccctcattactctcatcactcatcataattcataacgtctctctctcactctcatcttccacactcgctcgtgacactgctgcgagcagagcctctgctaaacgagtgagccagccagtgaagtcaaaaaaaaaaggcagtgaagtgtgagtgagagaaaccagaagaagaaaaatgctcgtcactcgtttctctccccatctcttcccatggcgcctccttctcctgttcttgaccttggtgggcagcagcaatggcgccgtcgctgctcctgcaaaggcacatccgccacgacccaaggctgctgccgggttcgggtacaagctggtgtccctggtcgagctccccaatggcggaggcctcgtcggctccctgcagcttaagcaacccagctccacctatggccctgacatcgctcgcctcaggctcttcgtcaagcacgagacccaggacagagtaagggtgcagataacggacgcagagaagcagaggtgggaggtcccctacgaccttctcccacgcgagccagcgccgcccctaacgaagctccccggcggcgcccccttcaccaccggcgagtactccggacagtctctgtccttcacctacggccgcgacccgttccacttcgcggtgcacaggaaatccacgggccagactctcttcaacaccagccatggcggcccgctggtcttcaaggaccagtacctggagctcaccacgcggctgcccaaggacgccgccctgtacgggctgggcgagaacacgcagccgggcggcatcaagctccgccccaacgacccttacacgatcttcaccacggacgcctccgccattaatctcaacactgatctctatggctcccacccggtgtacgtcgacctcaggaacatcggcggccatggcgtcgcccatgccgtgctgctgctgaacagcaatgccatggatgtcttctatagaggggattcgctgacgtataaggtcattgggggtctccttgatttctacttcttcgccgggccgacgccgctcgctgtagttgatcagtacacggccatgatcggccgccctgcgcccatgccgtattgggcatttggtttccatcaatgcaggtggggataccagaatctttcggtagtcgaggcggtcgtggagggctaccggaatgcgcagataccccttgacgtgatctggaacgatgatgaccatatggatgccgcgaaggacttcacactggaccctgtcaattatcctcgcccgaagctgctagcgttcctcgacaagatccatgcacagggaatgaagtacatcgtcctcatagaccccggcatcgccgtgaacagctcatacggcgtgtaccagcgtggcatggaacgcgacatcttcatcaagctagacggtcagccataccttgcccaggtctggccaggccccgtctacttcccggacttcctcaacccgaacggcgcgtcatggtggatcgacgaggtccggaggttccatgagcttgtcccagtggacgggctctggatcgacatgaacgaagtctccaacttctgcaccggcaagtgcaccatcccgacgacgcacaagtgcccggtgccgaactccaaggagccatggctgtgctgcctggactgcaagaacctcaccaacaccagatgggacgatccaccgtacaagatcaatgcctccgggaagtcggcccccctcggctacaacaccatcgccaccagcgccacgcactacaacggcatcctggagtacaacgcgcacagcctgtacggcttctcgcaggccattgccacccacaaggggcttcaaggtctccagggcaagaggcccttcatcctgacacgctccaccttcgtcgggtccggcgcctacgccgcgcactggaccggtgacaacaagggcacctgggagaacctccggtactccatctccaccatcctcaacttcggcatcttcggcatgccgatggtcggcgcggacatctgcgggttctaccctgcggatcccaaccttctggaggagctctgcagccggtggatcgagctcggggccttctacccgttctccagggaccatgccaacttcgcgtcgccgaggcaggagctctacatttggggctcagtggccaagtcggcccggaacgcgctcggcatgcgctacaggatgctgccgtacctctacacgctcaactaccacgcgcaccagagcggcgctcccgtggctcggccgctcttctttgcattcccggacttcgtgccaggctacggcgtcagcacgcagttcttgcttggggacagcgttatggtgtcccctgtcctggagcagggcgcgacctccgtgagcgccgtgttcccgcctgggacatggtacaacctgttcgacacgaggaaagtaatcgtgtccggcaacaatggcgacgccgtgaagctggacgcgccgttgaacgaaatcaacgtgcacgtgcacgagggcacggtcctgccgctgcagcgcggcggcagcatctccagggacgccagggcgacgccgttcacgctggtgatcgcgttcccgttcggcgccgcggatgccgacgccgagggcgccgtgtacgtggacgacgacgagcggccggccatggtgctcgcggaaggagaagcgacctacgtgcggttccacgcgagcgtgaggggcggcaaggaggtgactgtgcggtctgaggtttcgatggggagttatagcttgaagaaggggctcgttgttgagaagctctcggtgctcgggctcgagggctccgggagagatcttgctgtccgggttgatggcactgaggaagccgatgctaccgccattgccgtggcgagtgctcacttcgttggcgcggacgagaagctgcaggaggtggggaagaagaggagcgtgatggtggaggtgggcgggctggcattgccgctgggcaagagtttcaccatgacctggaacatgcacatccaagcgtaggatcggaggccaatcggccaaagctttctccctgtgctttcgttcttcggtatctaatttagagtcttagctagttcgtgccatgatgctgctgattggcatttggttgggtcgtttctgtaacacgtactaccaatctctgaactctgattcgattcgatcattgaggaagcattgcagggaataaaactgcatttttatggtgtgctgaactttac

SEQ ID NO: 1332 - DNA, 3299 bp, Hordeum vulgare
atgccactcactcactcaatacatgcagcgtactaccgcacactgacatcgccctctctctctctctcccccctcattactcgcatcattacagccccctcagtctcactctctatccgcccctgctctctctcccggagtagaagtcgagcctgcgacattgctgctgcacagagcacacggactgtacgaagcacccagcgatgctccctcgccccccttcccacctcctgccatggcggtgcctcctcctcctcctcctcaccctcaccatggcctgcaccagcaatggcgtctccgcaaccgcgaaggccaatcacaaggccaaggcgccggcagcggcacccaagccggccgggttcgggtaccggctggtgtccctcgtccagcgacccaacggcggcggcctcgtaggcctcctccaggtgaagcgccgctcctccaccttcggccctgacatcccccgcctcaggctcttcgtcaagcacgagaccaaggacagggtacgggtgcaggtaacggacgcggagaagcagaggtgggaggtcccctacgacctgctcccgcgggagccatccccgccgctcggcgtcgccactgacggccatggcgcacccttcaccgtcggcgagtaccccgggcaggacctcgtgttcacctacggccgcgacccgttctggttcgccgtgcaccggaggtccacccggcagccgctcttcaacaccagcggcgccccgctggtgttcaaggaccagtacctggaggtgtccacgcggctgcccggcgacgccgcgctctacgggctcggcgagaacacgcagcccggcggcatcaagctccggcccaacgacccctacacgctctacaccaccgacgcctccgccatcaacctcaacaccgacctctacggctcccacccggtgtacgtggacctccgcaacctcgccggccgcggcgtcgcgcacgccgtgctgctgctcaacagcaacggcatggacgtcttctacaccggcacctcgctcacctacaaggtcatcggcggcctcctcgacttctacttcttcgccgggccgacgccgctcgccgtcgttgaccagtacaccgccatgatcggccgccccgcgcccatgccgtattgggcatttgggttccaccaatgcaggtggggataccacaacctttcagtggttgaggatgtcgtggagaactaccggagcgcgcagatacccctggacgtgatctggaacgacgacgaccatatggacgccaggaaggacttcacgctcagcccggtgaactacccgcgccccaagctgctggcgttcctcgacaagatccacaagcgcgggatgaagtacattgtgctcatcgaccccggcatcaacgtgaacgacacctatggcgtgtaccagcgcggcatgcagcgcgacatcttcatcaagcttgacgggcagccataccttgcccaggtgtggcctggccctgtctacttcccggacttcatcaacccgaacggcgcgtcgtggtggatcgacgaggtgcggcggttccacgagctcgtcccggtggacgggctctggatcgacatgaacgaggcctccaacttctgcaccggcaagtgcaccatcccgacgacgcacaggtgcccggacccgacctccaaggagccgtggctgtgctgcctggactgcaagaacatcaccaacaccaggtgggacgaaccgccgtacaagatcaacgcctccgggaagacggcccgtctcggcttcaacaccatcgccaccagcgccgtgcactacaatggcatcctggagtacaatgcccacagcttgtatggcttctcccaggccatcgccactcacaaggggctgcaaagcatccaggggaagaggccgttcatcctgacgcgatccacgttcgtcggctccggcgcctacgccgcgcactggaccggcgacaacaagggcacctgggaggacctccggtactccatctccaccatgctcaacttcggcatcttcggcatgccgatggtcggcgccgacatctgcgggttctacccggccaagccaccgccgctggaggagctgtgcagtcggtggatcgagctcggtgcattctacccgttctcaagggaccacgccaacttcgcctcggcgaggcaggagctgtaccagtgggagtccgtggcgaggtcggcgcggaacgcgctcggcatgcggtacaggatgctcccgtacctgtacacgctcaactaccaggcgcacctcaccggcgctcccgtggcgcggccgctcttcttctcgttcccggacttcgcgccgtgctacggcgtgagcaaccagttcctactcggcgccggcgtcatggtgtccccggtcctcgagcagggcgccagctccgtggacgcggtgttcccgccgggcacgtggtacaacctgttcgacacaagcaaggcggtggtgtccacgggctccggcgccgccgtcaggctcccggcgccgctgaacgaggtgaacgtgcacgtgcaccagggcacggtcctgccgctgcagcgcggcggcaccatctcccgcgacgcgcgcgcgacgccgttcacgctggtggtggcgttcccgctgggcgcggcggacgcggacgcggagggcgccgtgtacgtggacgacgacgagcggccggccatggtgctggcggaggggcaggcgacgtacgcgcggttccacgcggccgtgcgcggcggcaaggaggtgactgtgcggtcggacgtggccatggggagctacgtcatgcacaaggggctcgtcatcgagaggatcacggtgctggggctgcacggcaccggcagggacctggccatccgggtcgacggcgcggacgacgacgccaccgccgtcgccacgtcgagcccctacttcttggccgcggacgcgcaggtgatgcaccaaggagaagaggacgccgtggagggcgagaagaggggcgtgacgatggaggttggcgggctggagttgccgctggggaagagcttcaccatgacatggaacatgcacatcgaagcataggagaatcgagctgcatttgcctctgcttccgtctgcatgcgccttcttcgttcgactcgtcgtcgtcgtgtctaatttaaatttatagagcttaaaaagtagttcatcgtgcttgagtcggttatgtaacttgtgtgggggttggttaccctcgaacaccatttgtgaactctgattcacccattgaagctcagtcttgcaggggaatgaaactgcatttcggccgtttcgcttctt

SEQ ID NO: 1333 - DNA, 3295 bp, Hordeum vulgare
gccactcactcactcaatacatgcagcgtactaccgcacactgacatcgccctctctctctctctcccccctcattactcgcatcattacagccccctcagtctcactctctatccgcccctgctctctctcccggagtagaagtcgagcctgcgacattgctgctgcacagagcacacggactgtacgaagcacccagcgatgctccctcgccccccttcccacctcctgccatggcggtgcctcctcctcctcctcctcaccctcaccatggcctgcaccagcaatggcgtctccgcaaccgcgaaggccaatcacaaggccaaggcgccggcagcggcacccaagccggccgggttcgggtaccggctggtgtccctcgtccagcgacccaacggcggcggcctcgtaggcctcctccaggtgaagcgccgctcctccaccttcggccctgacatccccgcctcaggctcttcgtcaagcacgagaccaaggacagggtacgggtgcaggtaacggacgcggagaagcagaggtgggaggtcccctacgacctgctcccgcgggagccatccccgccgctcggcgtcgccactgacggccatggcgcacccttcaccgtcggcgagtaccccgggcaggacctcgtgttcacctacggccgcgacccgttctggttcgccgtgcaccggaggtccacccggcagccgctcttcaacaccagcggcgccccgctggtgttcaaggaccagtacctggaggtgtccacgcggctgcccggcgacgccgcgctctacgggctcggcgagaacacgcagcccggcggcatcaagctccggcccaacgacccctacacgctctacaccaccgacgcctccgccatcaacctcaacaccgacctctacggctcccacccggtgtacgtggacctccgcaacctcgccggccgcggcgtcgcgcacgccgtgctgctgctcaacagcaacggcatggacgtcttctacaccggcacctcgctcacctacaaggtcatcggcggcctcctcgacttctacttcttcgccgggccgacgccgctcgccgtcgttgaccagtacaccgccatgatcggccgccccgcgcccatgccgtattgggcatttgggttccaccaatgcaggtggggataccacaacctttcagtggttgaggatgtcgtggagaactaccggagcgcgcagatacccctggacgtgatctggaacgacgacgaccatatggacgccaggaaggacttcacgctcagcccggtgaactacccgcgccccaagctgctggcgttcctcgacaagatccacaagcgcgggatgaagtacattgtgctcatcgaccccggcatcaacgtgaacgacacctatggcgtgtaccagcgcggcatgcagcgcgacatcttcatcaagcttgacgggcagccataccttgcccaggtgtggcctggccctgtctacttcccggacttcatcaacccgaacggcgcgtcgtggtggatcgacgaggtgcggcggttccacgagctcgtcccggtggacgggctctggatcgacatgaacgaggcctccaacttctgcaccggcaagtgcaccatcccgacgacgcacaggtgcccggacccgacctccaaggagccgtggctgtgctgcctggactgcaagaacatcaccaacaccaggtgggacgaaccgccgtacaagatcaacgcctccgggaagacggcccgtctcggcttcaacaccatcgccaccagcgccgtgcactacaatggcatcctggagtacaatgcccacagcttgtatggcttctcccaggccatcgccactcacaaggggctgcaaagcatccaggggaagaggccgttcatcctgacgcgatccacgttcgtcggctccggcgcctacgccgcgcactggaccggcgacaacaagggcacctgggaggacctccggtactccatctccaccatgctcaacttcggcatcttcggcatgccgatggtcggcgccgacatctgcgggttctacccggccaagccaccgccgctggaggagctgtgcagccggtggatcgagctcggtgcattctacccgttctcaagggaccacgccaacttcgcctcggcgaggcaggagctgtaccagtgggagtccgtggcgaggtcggcgcggaacgcgctcggcatgcggtacaggatgctcccgtacctgtacacgctcaactaccaggcgcacctcaccggcgctcccgtggcgcggccgctcttcttctcgttcccggacttcgcgccgtgctacggcgtgagcaaccagttcctactcggcgccggcgtcatggtgtccccggtcctcgagcagggcgccagctccgtggacgcggtgttcccgccgggcacgtggtacaacctgttcgacacaagcaaggcggtggtgtccacgggctccggcgccgccgtcaggctcccggcgccgctgaacgaggtgaacgtgcacgtgcaccagggcacggtcctgccgctgcagcgcggcggcaccatctcccgcgacgcgcgcgcgacgccgttcacgctggtggtggcgttcccgctgggcgcggcggacgcggacgcggagggcgccgtgtacgtggacgacgacgagcggccggccatggtgctggcggaggggcaggcgacgtacgcgcggttccacgcggccgtgcgcggcggcaaggaggtgactgtgcggtcggacgtggccatggggagctacgtcatgcacaaggggctcgtcatcgagaggatcacggtgctggggctgcacggcaccggcagggacctcgccatccgggtcgacggcgcggacgacgacgccaccgccgtcgccacgtcgagcccctacttcttggccgcggacgcgcaggtgatgcaccaaggagaagaggacgccgtggagggcgagaagaggggcgtgacgatggaggttggcgggctggagttgccgctggggaagagcttcaccatgacatggaacatgcacatcgaagcataggagaatcgagctgcatttgcctctgcttccgtctgcatgcgccttcttcgttcgactcgtcgtcgtcgtgtctaatttaaatttatagagcttaaaaagtagttcatcgtgcttgagtcggttatgtaacttgtgtgggggttggttaccctcgaacaccatttgtgaactctgattcacccattgaagctcagtcttgcaggggaatgaaactgcattcggccgtttcgcttctt

SEQ ID NO: 1334 - DNA, 1168 bp, Saccharum officinarum
ttgttggatgtttgctgatgggttagaaggaggggttggatgccatgggacaagccacaaggtcaggacaagcgaaaacttcacgagcagcagcaagtccagcagcaaagggcagcaagcggcagcacgagaaagagagaagccaatagggccatagctagagagcagccgcagcagcagaggcctcacctgaagctccatccgccatggcattcacgcccgctacggcctgctgcaagccttccctggtgctggcgccgcgggcgtcgtcccgcggctcggcggcccgcgcgcaggcggcgctcctctgcacgccctccacctccgcgttccgcggcctccgggcgcccgcatccgccgcgccggccccgccgcgctggcgccgctcggcggcgtccacgggcatcgtctgcggcaaggtgagcaagggcaacgtgcccccgaacttcactctcaaggaccagaacggcaagcccgtgtcgctgaacaagttcaagggcaagcccgtcgtcgtctacttctaccccgccgacgagacgcccggatgcacaaagcaggcgtgcgcgttcagggactcgtacgagaagttcaagaaggccggggcggaggtgatcggcatcagcggcgacgacgcggcgtcgcacaaggcgttcgcgcagaagtaccggctgccgttcacgctgctgagcgacgaggggaaccgcgtgcgcaaggagtggggcgtccccgccgacctgttcggcacgctccccgggcggcagacgtacgtgctggacaagcagggcgtcgtgcagtacatctacaacaaccagttccagcccgagaagcacatcggcgagacgctcaagatcctgcagagcctatgagctatcctgccgccctccgccatgcgcgttccgtcaaggcgtcaatccgtgtctgtaaaaggaccggactatgtatgtagtgtaatcaagagctgacgatttgttcgatccttcagtctaatatcatatcagacgaccctggctcgtttgatcgaccagcctcttcctgtttgtcatggtcagtttcagttgtactgcttgtgtgatcggcagtctcagatgttgaagcccattgaacccaaatggggtattttacatgtgcaattttctcccttgtaaaaatagacaaggcagttcgtgcg

SEQ ID NO: 1335 - DNA, 1229 bp, Sorghum bicolor
tgatgggttagaagaagggggttcgatgccatggcacaagccacaagctgaggacaaccaaaacctttcacgagcagcagcaactccagccagcagtaaagggcagcaagcggtggtagcacgagaaaggagaagccaatagggccaccatagctcccagagcagcggcagaggcctcacctgaagctccgtccgccatggcattcacgcccgctacggcctgctgcaagccttccctggcgctggcgccgcgggcggcgtcgtcccgcgcgcaggcggcggcgctcctctgcacgccctccacctccgcgttccgcggcctccgggccgcgccggccccgccgcgctggcgccgctcggcggcgtccacgggcatcgtctgcggcaaggtcagcaagggcagcgtgccaccaaacttcaccctcaaggaccagaacgggaagcccgtgtcgctgaacaagttcaagggcaagcccgtcgtcgtctacttctaccccgccgacgagacgcccggatgcacaaagcaggcgtgcgcgttcagggactcgtacgagaagttcaagaaggccggggcggaggtgatcggcatcagcggcgacgacgcggcgtcgcacaaggcgttcgcgcagaagtaccggctgccgttcacgctgctgagcgacgaagggaaccgcgtgcgcaaggagtggggcgtccccgccgacctgttcgggacgctcccggggcggcagacgtacgtgctggacaagcagggcgtcgtgcagtacatctacaacaaccagttccagcccgagaagcacatcggcgagacgctcaagatcctgcagagcctctgatgagtgggattctgggtgggccatgctgctgctgctccgggactaggtatgtagtgtaatcaagagctgataatttgatcgatcctgctttcagtctatcatatcagagtttcagtctatcgtatcgtattcatatcagaggaccctgtttcgtttgatcgaccgaccaccctcttcctgtttgtcacggtcagtttcagttgtaacgtttgtgtgtgtgtgtgtgtgtgtgtgtgtgtgtgtgtgtgtgtgtgtgtgatcggcagtctcagatgtttgtagcttgttgaacccaaatgggtatttatttctgtatatgcacgtggcagactacaaggtgcaattttctcccttgtaagtaaaaatagacaacgtgaaacctgtatgcgcggc

SEQ ID NO: 1336 - DNA, 1054 bp, Setaria italica
cagaggccattggtagcgtcgcgagcggcagcagaggcctcacctgacgcccccatccgccatggcattcacgcccgccacggcctgctgcaatccctccctgctgctggcgccccggcgggcatcgtcgtcgcgcggctcgccggcccgcgcgcaggcgctcctctgcacgccctccacctccgcgttccgcggcctccggggggccacgtccgccgcgccggccccgcggtggcgccgcgcggcgtcgtccacggccatcgtatgcggcaaggtgaccaagggcagcgtgccgcccaacttcaccctcaaggaccagaacggcaagcccgtgtcgctgaacaagttcaagggcaagccggtcgtcgtctacttctaccccgccgacgagacgcccggatgcaccaagcaggcgtgcgcgttccgtgactcgtacgagaagtacaagaaggcgggggcggaggtgatcggcatcagcggcgacgacccggcgtcgcacaaggcgttcgcgcagaagtaccggctgccgttcacgctgctggccgacgaggggaaccgcgtgcgcaaggagtggggcgtaccgggggacctcttcgggacgctgcccgggcggcagacctacgtgctcgacaagaacggcgtcgtccagtacatctacaacaaccagttccagcccgagaagcacattggcgagaccctcaagatcctgcagagcctctgaaagtcttagcttcgcggccggccggccggccggcggcggcggcacggttcttgggcattgctctctctgcatccatcattgttgtaaacgtagcgagaccatatctatatgaagagctggcttcttcagtctatcaggctcggcccgtttgacaggccagtctgttcgtgtttgctctgtgcagtctcagacgttcgttgtagtagttcatctcagtgaattcaaatattctgtatgtgcatgcatcacatgtgcaatttcacctttttcagtagaaactgcacttctgaagcagacctctctctcgacggaaccaggagatttctgttctcg

SEQ ID NO: 1337 - DNA, 810 bp, Cynodon dactylon
gacgatggcattcgcgccctctacggcctgctgcaagccttccgcgctgctggcgcaccaggcgtcgtcgcgcggctcgccggcccgagcgcaggcgctcctctgcgcgccctccacctccgcgttccacggcctccgggcgccgctggccgccgcgccggcaccgcgccggcgcgcggcgttctctactggcatcgtctgcggcaaggtgagcaagggcagcgcgcctccgaacttcacactcaaagaccagaacggcaagccggtgtcgctgtccaagttcaagggcaagcccgtggtcgtctacttctaccccgccgacgagacgcccggatgcaccaaacaggcttgcgcgttccgtgactcgtacgagaagttcaagaaggccggggcggaggtgatcggcatcagcggcgacgacacggcgtcgcacaaggcgttcgcgcagaagtaccgcctgccgtacacgctgctggccgacgaggggaacaaggtgcgcaaggactggggcgtgccctccgacctgttcgggacgctgcccggtagacagacctacgtgctcgacaagaacggcgtcgtgcagtacatctacaacaaccagttccagcccgagaagcacatcgccgagacgctcaagatcctgcagggcctctgagtctcaagacgagccttgacattgtagcttcgtggccggcagcacggcgcgtcggccatgctctgcatcagtcattgtaataaacgtgctgagggcgcgttgtatggaggagagctgattgtttgttcagtcaacggaatctgatgactcgcttg

SEQ ID NO: 1338 - DNA, 1006 bp, Leymus cinereus x Leymus triticoides
  misc_feature (66)..(66): n is a, c, g, or t
  misc_feature (73)..(73): n is a, c, g, or t
  misc_feature (84)..(86): n is a, c, g, or t
  misc_feature (94)..(94): n is a, c, g, or t
  misc_feature (96)..(96): n is a, c, g, or t
  misc_feature (101)..(101): n is a, c, g, or t
  misc_feature (170)..(170): n is a, c, g, or t
  misc_feature (188)..(188): n is a, c, g, or t
  misc_feature (278)..(278): n is a, c, g, or t
  misc_feature (862)..(862): n is a, c, g, or t
  misc_feature (914)..(914): n is a, c, g, or t
  misc_feature (938)..(938): n is a, c, g, or t
cgcgttcccatctcatcctgatatcccctcgccacgaactaaccatccatcagaggcggctcccanttcctcnagagaaaccannnaacagagnanccgcngaggcgagtccttcacctcgattcaagatggcattcgccgcctccacggcctgctgcaagccctccgcnctgctgacccctcgtgcntcgtcgtcgtcagccccccgcgcgcaggcgctcctctgcaggccctccacctcggccgcgttccacggcctcagggcgccggcgtcggcnttcgccctcgcgcctgcgccacgccgccgcgcggcgtccacgggcatcgtctgcggcaaggtgagcaagggcagcgtgccgcccaacttcaccctcaaggaccaggacggcaagacggtgtcgctctccaagttcaagggcaagcccgtcgtcctctacttctaccccgccgatgagacgcccggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctgccggggcgccagacctacgtgctcgacaagaagggcgtggtgcagtacatctacaacaaccagttccagcccgagaagcacatcggcgagacgctcaagatcatccagaacctctgaacctctcaacttctcagcttctctgaaaatcatacatacgtactactttcttggattcttttcccattgatcgatcnatctctcccgctgtaatcgtatgatatgctcctgaacatgatccctgtgtanagctgttttgatgtgtaatgcaangtactacgtgtaccgtgtatgttcaatggtctggccagtgcaaaaaagtgatgccgttgttcagttca

SEQ ID NO: 1339 - DNA, 942 bp, Avena sativa
cagaggaggttcctcgctccaccgagaaacagagcagcggcggaggcgagtccttcagctcgatccaagatggcattcgccgcctccacagcctgctgcaagccttccgcgctgctcgcccctcgcgcgtcgtcgtcgcccctccgcgcgcaggcgctcctctgcagcccctccacctcggccaagttccacggcctcagggcgccggcgtcggcattcgccgtcgcgccggtgcctcgccgccgcgcggcatccaccggcatcgtatgcggcaaggtgagcaagggcagcgtgccgcccaacttcaccctcaaggaccaggacggcaagacggtgtcgctctccaagttcaagggcaagcccgtcgtcctctacttctaccccgccgatgagacgccagggtgcacgaaacaggcgtgcgcgttccgtgactcgtacgagaagtacaagaaggctggggcggaggtgatcgggatcagcggggacgacgcggcgtcgcacaaggcgttcgcgaagaagtaccggctgccgttcacgctgctgagcgacgaggggaacaaggtgcgcaaggagtggggggtgccgtcggacctgttcgggacgctccccggaaggcagacctacgtgctcgacaagaagggcgtcgtgcagtacatctacaacaaccagttccagccagagaagcacatcggggagacgctcaagatcatcgagaacctctgagcgaggcaggatcgtcatctattgtatacttcgtatctattcccatcttttctctgcctcttgtaagtttcaattcgtacataccgactatgatctagtacgtgtagagctgttttttgttgtgtaatcaagcgtacgtacgtatgcatgtattccagtatgttctctgccctgtccagctgaaacgtggcgcaattgttcagttcagttcagtttcag

SEQ ID NO: 1340 - DNA, 901 bp, Avena sativa
cagaggaggttcctcgctccaccgagaaacagagcagcggcggaggcgagtccttcagctcgatccaagatggcattcgccgcctccacagcctgctgcaagccttccgcgctgctcgcccctcgcgcgtcgtcgtcgcccctccgcgcgcaggcgctcctctgcagcccctccacctcggccaagttccacggcctcagggcgccggcgtcggcattcgccgtcgcgccggtgcctcgccgccgcgcggcatccaccggcatcgtatgcggcaaggtgagcaagggcagcgtgccgcccaacttcaccctcaaggaccaggacggcaagacggtgtcgctctccaagttcaagggcaagcccgtcgtcctctacttctaccccgccgatgagacgccagggtgcacgaaacaggcgtgcgcgttccgtgactcgtacgagaagtacaagaaggctggggcggaggtgatcgggatcagcggggacgacgcggcgtcgcacaaggcgttcgcgaagaagtaccggctgccgttcacgctgctgagcgacgaggggaacaaggtgcgcaaggagtggggggtgccgtcggacctgttcgggacgctccccggaaggcagacctacgtgctcgacaagaagggcgtcgtgcagtacatctacaacaaccagttccagccagagaagcacatcggggagacgctcaagatcatcgagaacctctgagcgaggcaggatcgtcatctattgtatacttcgtatctattcccatcttttctctgcctcttgtaagtttcaattcgtacataccgactatgatctagtacgtgtagagctgttttttgttgtgtaatcaagcgtacgtacgtatgcatgtattccagtatgttctctgccctgtcca

SEQ ID NO: 1341 - DNA, 825 bp, Festuca arundinacea
  misc_feature (471)..(471): n is a, c, g, or t
  misc_feature (480)..(480): n is a, c, g, or t
  misc_feature (507)..(507): n is a, c, g, or t
  misc_feature (595)..(595): n is a, c, g, or t
  misc_feature (603)..(603): n is a, c, g, or t
  misc_feature (609)..(609): n is a, c, g, or t
  misc_feature (612)..(612): n is a, c, g, or t
  misc_feature (675)..(675): n is a, c, g, or t
  misc_feature (765)..(765): n is a, c, g, or t
  misc_feature (812)..(812): n is a, c, g, or t
cctccaccaagaaacagagcagcggcggaggcgagtacttgagctcgatccaagatggcattcgccgcctccacagcctgctgcaagccttctgcgctgctcacccctcgtgcgtcgtcgtctctccgcgctcaggccctcctctgcaggccctctacctcgaccaccttccgcggcgtcagggcgccggcgtcggcaatcgccgtcgcgccggtgccgcgccgccgcgccgcatccacgggcatcgtctgcggcaaggtgagcaagggcagtgtgccgcccaacttcacactcaaggaccaggacggcaagacggtgtcgctctccaagttcaagggcaagcccgttgtcctctacttctacccagcggatgagacgcccggctgcacgaaacaggcgtgcgcgttccgggactcgtacgagaagtacaagaaggctggcgcggaggtgatcgggatcagcggcgacgangcggcgtcncacaaggcgttcgccaagaagtaccgnctgccgttcacgctgctgagcgacgaggggaacaaggtgcgcaaggagtggggggtgccgtcggacctgttcgggacgctgccggggnggcagacntacgtnctngacaagaagggcgtggtgcagtacatctacaacaaccagttccagcccgagaagcacatcggngagacgctcaagatcatccagaacctctgaacttctctgaacaagtgaagatacatatctgcacctccattcgatccccatgcatctctntgccgccgcttgtaagctgtaaccatacatacatatactgacgaccnatgatcaccgtgt

SEQ ID NO: 1342 - DNA, 987 bp, Brachypodium distachyon
atcacagttcacagcaggttcccgttcctccagagaaaaccaagatcagagcaggccggggcggagttactcgtcgagttccacgactcgatccaagatggcattcgccgcctccacagcctgctgcaagccttctccgctgctggctcctcgggcgtcgtccctccgcgcgcaggcggtcctctgcaggccctcctccaccgcgaccacgccccgcggcctcagggcagcggcgcccgcatccgcattcgcgcaaacgcctgcgccccgccgccgcgccgcgtccacgggcatcgtctgtggcaaggtgaccaagggcagcgtcccgcccaatttcaccctgaaagaccaggacggcaagacggtgtcgctctccaagtacaagggcaagcccgtcgtcctctacttctaccccgctgatgaaacgcccggctgcaccaagcaggcgtgcgcgttcagggactcgtacgagaagtacaagaaggcgggggcggaggtgatcgggatcagcggggacgacgcggcgtcgcacaaggcgttcgccaagaagtacaagctgccgttcacgctgctgagcgacgaagggaacaaggtgcgcaaggagtggggtgtgccgtcggacctgttcgggacgctgccggggcggcagacctacgtgctggacaagaagggcgtcgtgcagtacgtctacaacaaccagttccagcccgagaagcacatcggcgagacgctcaagatcatccagaacctctgaacatcagtattctgaatttctgatcgtctcgtccccagataatttctttcttccctatctctgcctcgatctgtgtaactagacacttgaaggtgatatgtctgcatgtagagtcctcattttgatgtgtaatatataatccgccagtcttgatccgtttttccttgatataatcctcagcctaaacgccgttcggtgaattctggctacctggagtaattctcatcaccgat

SEQ ID NO: 1343 - DNA, 2713 bp, Sorghum bicolor
actgactttcacactactgtgcatggacctggaccctcctcctctgtcctctctctctctcatccataacgacatggcacctttgcaccacgctgctgcctactagtaccagactaccagcagtacctcttgaacccacctcggtggcctaatcccgggccctgatgaggccgagctttgcatttgcaggcactgcagtggtttggtttcttgttcctgagcagttgagcggcgcacaccaacttgttttgcatcagcagttctttggcacggcgttgttctgtgcatcacatgccatgtgagtagctgaccacagctcactccaagtgcagcggcagcccggcagcccactgctgctggatctccccgaggttcttccgcgatggagcagacctgctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgccgccaggaaccgcgcgtccgtcgcgcggagcctgctgctggagtgcgagtgcaggaacccgaaccaccaccgcgccggaggggagaacacgctgctccgggccgggtacggcgggtgggtgctctacacggcagcgtccgccggggacgcggcgttcgtgcgggagctgctggagagggacccgctgctcgtgttcggcgagggcgagtacggcgtcacggacatgttctacgcggcggccaggggccggagcgccgacgtgttcaggctgctgctcgaccacgccatgtcgccgaggtgctcgacggattgccggaacggccaaggcggtgctgggcgtggctccatgttccggcttgagatgatgagccgggccgtccacgctgcggcgagaggcgggagcgtggagatgctcagagagctgctcgaggaggggccgtccagcgtatcgacgtatctcgacatccgtggatccaccgtgctgcatgcggccgctgggagaggccagctgcaggtcgtcaagtaccttctggcctctttcgacatcatcaatttgacagataatcacgggaacacagcactgcatgtagcagcctatcgagggcaccaacctgttgtggaagtgttggttgctgcatctccatcaaccttgtcagctgtcaacaatgctggtgacacatttctccattcggcagttacaggattcaggaccccaggattccgacggcttgaccgccaattggagctgatgagatacctcatacgcgaaagaactgcagatatccagaagatcatcaatctgagaaacgatgcaggccttacagccctccacctggctgtggttggctgcgcacacccagatctggttgagctattgatgactgccccgtcaatcgacctgaatgctgaagacgcgaacggcatgactgcgctggcattgctaaaacagcagctgcgttcagcaacatccgaccggctcatcaggcagatagtttctgccggaggggtcttgaattccagcattctgagaacccgatcagccattgcttctcagattaagatgcagggtgggattgcaagcagtcccggtaccactttcaaggtatcagatgcagagatattcttgttctcgggtatgggggcagtggagtctctaaggccaagctcgtgctccagcaatgggaaggatgaccctactcatgcagatgcagattgcgccgaaaaccatggatcatcagagaagaggctgagctctgcgagccgggccaaagaccgtctcaagatgatgctgaggtggcctcgccacaagacacccaagaaatcagaggacagcagcccgctggactcgatcaagaagctgagccaacacgaggctgagacccctgctccactaaggcagaaatttaccaagacaacggcgctcaacggcaagcggaccctagcggtgaagagctccaccccaagctcctcgtccaccaagaagaagctcaacacaaagctcatacatggcatcatggaggccatgccacagctggcgccggctaccgtgcggtccgggtcgccaacggacatgcttcggaggtcctccatatcatccacacctcagccgctggcgaagctgaaggacatctgcctcgacgacgagatctccatggtgacgccgtccgtcggcaagctgaaggacatcgtcctggacagtgacgacaccacggaggacccctcgtgctccaactcgtccatggacgacggttgtggcaccgggacagcggagagcgcggcccggaagcacgggtgcggcaacgggaggctgatcaacatctgctttggcgcacagggactgaccgtggaggactcggcgagcgggcagcagacgagcaagatgttcaagcagcagtgcctgagggtgtcctgactgacggcataatgccacagcgtgtattgtatcataggattcacggcgtggtgtgattggtttggtatctcgcgtgcagctatgcgtgcttgttttcttgttgtgcatgctgccttgcataaccaggggtgaactggtaatccaatgaatttgtgcttgtgttaactgtgacgttgacgaattcatagtcttgtttctaaa

SEQ ID NO: 1344 - DNA, 1333 bp, Triticum aestivum
  misc_feature (16)..(16): n is a, c, g, or t
tcgacccacgcgtccnctccacttcactcccactgaagcagctcccactgaagcagcggcggaagaagaagaagaagctagaggacatgggggcgcagagagctctcctcgcgagcttcctgctcgccgcgttggccacccaggccttcgtctccgtctcggccaggaccggcccgacggacaaggcaggccaagatgacgtgaagaagccggactgcgtgccgtcgctcgacccgcacaatttccccggccacgggggcaccaccgtgccgcttccctcgcacggaggctcctccggcacgcccccctaccacggaggctccggcacgacgccgtcgcacggcggctccggctcgactccgtcgcacagcggctctggttcgttgcctgacccgtcgcacggctggtacgggacgccgccttcgcacgggggctctggttcgttgcctgacccgtcgcacagcggaggttacgggtccactccggatgcgccgtcacacggcgaaggcgcgtacgggagctccccgacgccttccactggcggtgcctacggcagctcacccacgccgtcccacgacggaggcgcctacgggagctccccgacgccggcccacgacggaggctcctacagcggaactccggctgcaccgtcgcacagcagccacgggtctgtgacaccgacgccgctcatcccagtcgaccccaacagcctcgggacatgcgactactggaggacgcaccccatgcagatctggtcggcgctggggagctggccgagctcagtgagccacttcttcggcgccgccggtggcgcggtcgccggcgggccgagcatgagcatccaggacgcgctggcgaacacgaggaccgacggcgccggtgcgctgctgcgcgagggcaccgccgcgctgctcaactccatgacccgtccggggttcgcctacaccacccagcaggtgagggacgcgttcgcggcggccgcggccggcggcgtagacagcgccgcggcggcgcaggcggcctcgttcaagaaagccaacgaggggaggaaggcgtagatcgaccggatcgccatggagagggctttagctagctggctacctatatttgtggcatgtctgcatgcatgcgtttaggccggacggacgtgtgcgttttgatgtgcgttttgatttggttgtttcgtttgagttcatggtttggttgtgtacgttggtgtcttcgtgggctagcttcgatctatcgtactatgtgttgtaatgaatctcgattaagttttttgcagttccgtaccctgtcgcattgaatggaatatatgaagtgaactattcct

SEQ ID NO: 1345 - DNA, 1573 bp, Brachypodium distachyon
ggcctcggcgatgaacggagcaagcgccggcgccggaaccggtgctggcggcgaggggccgttggtctaccaggcctggaaaggaaacaatgtatttttcttccaggggaggtttatatttggacctgatgcgagatccttgtttgtcaccatgctcctcattattgctccagtatcaatcttctgtgtgttcgttgcaagagaattgatgagtaatttctcctacagtctggggttacctgtgatggttgcagcggttgtattcacagcatacgatttgagtcttctgcttctcacttctgggagggatccaggtatcatacctcggaatgcacatcctccagaacctgaaggttttgaaggcaatgctgaagttggagctaaccagactccaccattgcgtttgccccgaattaaggatgttgttgtcaatggaatcactgtaaagacaaaatactgtgatacctgcatgctgtaccggcctcctcgttgctcccattgctctatctgcaacaactgtgtcgaacggtttgaccatcactgcccatgggttgggcaatgtataggacttcggaattacaggttcttttatatgtttgtcttctcaacaactcttctctgcctctatgtcttcggattctgctgggtgtacattgttaagatcagaaatgctgagcagataacaatatggaaggcaatggcaaagacccctgcgtctatcgctctggttgtctacacgttcattgcagtttggttcgttggtggcctctcagtatttcacttgtatctcatgagcactaatcagacaacatatgagaacttcaggtatcgctatgaccaacgagccaacccgtacaataggggagtcgtggagaacattaaggagatcttcttcacgcctatccctcaatccaggaacaactttggtggcagagttccacaggatcagggcctgaggcctcgcccgacgactggtttcatgagtccaaacatggggagagctgtcggtgacattgagatgggcagaaaaccggtggcatgggacgagccaaggatggcagctgagataggtgatctgggaggtctgggcaacttgttggaggacaaggatggccggttctgcaacgcatccccagatctaagccgtgatgccctcgcggttggaggcttagatgagcaaggctcctcagctatgaacccaccacggtcgagttggggagtcgaagcaggtcgatgatgttgatggccagtcggccatggaaccaactatagtggagggaggactcagggatgtagtgccagcttgttcctaatttggtgtttggttcaaatctgaggtagctaatgttattaggcctatgggttggtttttcttgtgttgctttgcatttcctgtatcagcggttttaagcagtgtgttggatttgtgaggtctccagtttagtactgcaattctaattgtgtttgtatatagtttgagcggtgaaccccaaaatggattgatttgcttgggttctgatgctgatgattgcgaacgagcttaaatttgagccatcattccgaagcttaaata

SEQ ID NO: 1346 - DNA, 1577 bp, Leymus cinereus x Leymus triticoides
  misc_feature (5)..(9): n is a, c, g, or t
  misc_feature (583)..(585): n is a, c, g, or t
  misc_feature (618)..(618): n is a, c, g, or t
  misc_feature (630)..(630): n is a, c, g, or t
  misc_feature (873)..(873): n is a, c, g, or t
  misc_feature (924)..(924): n is a, c, g, or t
  misc_feature (930)..(931): n is a, c, g, or t
  misc_feature (1296)..(1296): n is a, c, g, or t
  misc_feature (1310)..(1310): n is a, c, g, or t
  misc_feature (1384)..(1384): n is a, c, g, or t
  misc_feature (1401)..(1401): n is a, c, g, or t
  misc_feature (1406)..(1406): n is a, c, g, or t
  misc_feature (1468)..(1468): n is a, c, g, or t
  misc_feature (1485)..(1485): n is a, c, g, or t
  misc_feature (1547)..(1547): n is a, c, g, or t
  misc_feature (1550)..(1550): n is a, c, g, or t
  misc_feature (1562)..(1562): n is a, c, g, or t
ctctnnnnnggctcccgacatcggcggcggcgcagcggcgggcgggcattgggagctcaaggcgccggcgacggccagcggagcggggcgggagcaagggagggagctctccggcggacgtgccgcgatccgggtgatcccgccggggattgttggcccgggagggccgcggcgatgaacggagcgagcaccggagccggcggcgaggggccgctggtgtacaaggcctggaaagggaacaatgtatttttcctccgggggaggtttatatttggacctgatgcgagatccttgtttgtcaccatgttcctcattatcgctccagtaacagtcttctgtgtgttcgtcgcgaaagaattgatgaatagattctcttatggcctggggttaccggtgatggttgtggctgttgtattcacggcatatgatttgagtcttctatttctcacttctgggagggatccaggaatcatacctcgaaatgcacatcctccagaacctgaaggttttgaaggcaatgctgaagttggtgctaaccagactccaccattgcgtttgccccgagtgaaggatgtcgttgtgnnnggaatcactgtgaagacaaagtactgtgacacntgtatgctgtancggcctcctcgatgctcccattgctctatctgcaacaactgtgtcgagcgatttgaccatcactgcccatgggttgggcagtgcataggacttatcagagatgcggagcagataacaatatggaaggcaatggcaaagacccctgcgtcgatcgctctggttgtatacacatttatcgcggtttggtttgttggtggcctctcagtgtttcacttgtatctgatgagcactaaccagacaacntatgagaacttcaggtatcgctatgaccaacgggccaacccatacaacagnggagtnntggagaacatcaaggagatcttcttcacgccgatccctgtttccaggaacaacttcggcgccagagttccacaggagcagggcctgaggcctcgctcgacgaacggtttcatgagcccaaacatggggagagctgtcggcgatatcgagatgggcagaaagccagtggcatgggacgagccaaggatggcagccgagataggcgatctgggaggtcttggcaacttgctggaggacaaggatggcaggttccgcaacgcatcccctgatctaagccgtgacgcccttgtggtcggaggcctggatgagcaaggctcctcggtgatgaacccaccgcggacgagctggggagtcgaagcgggcagntgatggtaactggncaatgtggccatgtaagcagctatagtggaggactaagggatgtatgttagtgccagcttgttcctagtttggngtccggttgagactcgnggtcnctgatgttgttattaggcctatgacctgttgttgttttgctttgcatttcatgtatcagtgnttaagcagattgttggngtgtgaggtctccagttcagtagaatcctgattgtgtctgtatatagtttggagtggtgaanccngaaatggattgntttgctttggcttca

SEQ ID NO: 1347 - DNA, 1845 bp, Oryza sativa
gatttctctctctttcttcctcctctcctcttcgtgtcttgccctccggcatcagcggcggcggagtggcggggttgcggcattgggagctgacgtggccgccggaggaggagcaaggcgcgcggcgccgccggccatgtggtgatctgggggggcttgatcccgccggagtggttcttgggctgagagtgcggcgcccatgaacggagcaagctccggcggcggcggcggcgccggtgccggcggggatgggccgttggtgtaccagcgctggaaagggaacaatgtgtttgttcttcaggggaggtttatatttggacccgatgcaagatccttgtacgtcaccatgttcctcatcatcgcgccagcgtcaatcttttgtttgttcgttgccaaagaactgatgaataacttttcttatggtctgggattaccagtaatgatttcagcagttgtgttcacggcatatgacttgagccttctacttctcacttctggtagggatccaggtataatacctcggaatgcacaccctccagaacctgaaggtttggatggcaatgcagaggttggatctaaccagactccaccaatgcgtttgccccgagtgaaggatgttgttgtcaatggaatcactgtgaagacaaaatactgtgatacctgcatgctgtaccggcctcctcgttgctcccattgctctatctgcaacaactgcgttgaacgttttgaccatcactgcccatgggttgggcaatgcataggacttaggaattacaggttcttttatatgtttgtcttctcaacaactctgctctgcctctacgtctttgggttctgctgggtatacattgttaagatcagaaactctgagcagataacaatatggaaggctatggcaaagacccctgcttctattgctctgctagtctacacatttattgccgtttggtttgttggtggcctctctgtatttcacttgtatctcatgagcaccaaccagacaacatatgagaacttcaggtatcggtatgatcaacgggccaacccatacaacaggggagtcatggagaacattaaagatatattcttctctgcaattcctgcctccaagaacaacttccgcgccagagtcccagttccacaggagcaaggtctgaggcctcgcccaaccaatggtttcatgagtccaaacatggggagagccgtcggtgacattgagatgggtagaaagccggtggcatgggatgagccaaggatggcagccgatatcggcgatctgggagcaggcctgggcaacttgttggaggacaaggatggcaggtttcgcagtgcatctccagatctaagccgtgacgccctcgcaatcggaggcctggatgatcaaggatcctcagtgatgaacccagggcgtacaagctggggagttgaggcaggtcgatgatgacaatgtttagttgcccatgtatgcagttatagtggaagactcagggatttttagtgccggcttgttgctaatttggtgtttgggttgagatttgaggtcactgatgttcttaggcctatgaccttgggtggttgttttcacatttccatttctccttttaattttctgttcctccttattgtcccttgtatttcctgtatcagtggtttgaagcagttggttggttgtgaggtatccagattagttcagttctaattgtgtatgtatatagctagagcactgaacttaaagggattgttttacttggctttgatgaatgattgtgaacaagattgtattttgcagtggacaaacgccactcacttgagctgccattccaagcttaaacctgttggtttcgt

SEQ ID NO: 1348 - DNA, 1723 bp, Pennisetum glaucum
gaggccatgaccaaccggcctgtcataagggtaaggggaggcagtggcgtatgaggtgcggtgatccccgggaggctgagggtggagggacggagggaggtggctgcgccgccggctatgtagtgatctgggccgtgatctcgacggctgttcgctgcggagcgggcggcggcgatgaacggagcgagcgctagcgccggggccggcgccggcgccggcgccggcggggaggggcctctggtgtacgaggcctggaaggggagcaatgtgtttttccttcaggggagatttatattcggacctgatgcaagatccttgtttgtcaccatgttcctcattgtcgcgccggtatcaatcttctgtgcattcgttgcgagggaattgatggataatttctcttatggtatgggattgtctgtgatgattgcagcagttctattcacagcatatgatctgagtcttctgcttctaacttctggaagagatccgggtatcatacctcggaatgcacatcctccagaaccagaaggttttgatggcaatgcagaggttggggctaaccagactccacctttgcgtttgccccgagtgaaggatgttgttgtcaatggaatcactgtgaagacaaagtactgtgacacttgcatgttatacaggcctcctcgttgctcccattgctcaatctgcaacaattgtgtggaacgttttgaccatcactgcccatgggttggacaatgcataggactgaggaattacaggttcttctacatgtttgtgttctcaacgactctgctctgcctttatgtattcgggttctgctgggtgtacattattaagatcagaaatgcagagcagataacaatttggaaggcaatggcaaagaccccagcatctattgctctaatcatctatacattcattgctgtatggtttgttggtggcctctctgtgttccatttgtatctcatgagcacaaatcagacaacatatgagaacttcagatatcgctatgatcagcgagccaacccatacaacaggggagttgtagaaaacatcaaggagatcttctttacacccatccctccttccaagaacaacttccgtggcagggtcccacaggagcatggtctacggcctcgtgcaacaaatggtttcatgagtccaaacatggggagagctgttggcgacattgagatgggtagaaaaccagtggcttgggatgagccaaggatggcagctgagattggtgatttaggagcaggtctaagcaacttgttggaggacaaggatggcaggtttcgtagtgcatctccagatctcagccgtgatgcccttgctgttggaggaggcttagaagagcaaggctcctcagcgatgaaccctgggcggacaagctggggagtcgaagcaggtcgatgatggcagtgaccatgtaagcagctagtgagagtctcagggttgttagtgccagttcacagctaatttcttgtttggtttgagatttgaggtcactaatgtctatgacgtgtatggcggttgtttttgccttttggatttaagtttctcctttctcttagtttgagatgtctttcctgtatgttatttgaagcagttggtttatgacgtctccagtttgccaccgtctaatttcatctgtatatattggcgcagtaaacctgaaacagtttgagttgcttggctaattggctttggttgtggtttg

SEQ ID NO: 1349 - DNA, 1819 bp, Panicum virgatum
ctcctctctctctctccccccccttggcttccgacatcagcggcggcgcagcggcgggggggcgccattgcgtgctgacatcacccgcggtgcggcgatcccggggggcggagggaggtggccgcgccgccggctatgtagtgatctgggccgtgatctcgacggcgattctcggccgagcgggcggcggcgatgaacggagcgagcgccagcgccgggcccggcgccggcgctggcgcggaggggccgctggtgtacaaggcctggaagggcagcaatgtgtttttccttcaggggagatttatatttggtcctgatgcaagatccttgtttgtcaccatgttcctcattgttgcgcctgtatcgatcttctgtgcattcgttgcgagggaattgatggataatttctcttatggcatgggattgtcggtaatgattgcagtagttctattcacagcatatgatctgagtcttttgcttctaacttctgggagagatccgggtatcatacctcgcaatgcacatcctccagaacctgaaggttttgatggtaatgcagaggttggggctaaccagactccacctttgcgtttaccccgagtgaaggatgttgttgtcaatggaatcactgtgaagacaaaatactgtgatacttgcatgttgtacaggcctcctcgttgctcccattgttctatctgcaacaactgcgtggaacgttttgaccatcactgcccatgggttggacaatgcataggactgaggaattacaggttcttttatatgtttgtgttctcaacaactcttctctgcctttatgttttcaggttctgctgggtgtacattgttaagatcagaaatgcagagcagataacaatttggaaggcaatgtcaaagacccctgcatctattgctctaatcatctacacattcatcgcggtttggtttgttggtggcctctctgtgttccacttgtacctcatgagcacaaatcagacaacatatgagaacttcagatatcgctatgatcaacgagccaacccatacaacaggggggtcgttgaaaacatcaaggagatcttctttacacccatccctccttccaagaacaacttccgtggcagggttccacaggagcatggtctaaggcctcgtgcgaccaatggtttcatgagtccaaacatggggagagctgtcggtgacattgagatgggtagaaaaccagtagcttgggatgagccaaggatggccgctgagattggtgatttaggagcaggtctgagcaacttgttggaagacaaggatggtaggtttcgtagtgcatctccagatctcagccgtgatgctctcgctgttggaggaggctttgaagagcaaggctcctcggcgatgaaccctgggcggacaagctggggagttgaagccggtcgatgatggtaatgaccatgtaagcagctgtagtgagaggctcagggctgttagtgtcagtttgctgctaatttgttgtttggtttgagatttgaggtccctaatgttatagactcatgacctgtatggcggttgtttcctgatttaagtttctcatttctcttagtttgagatgtctttcctgtatgttgtttgaagcagttggtttgtgacgtctcaagtttggcagtgtctgattttttctgtatatattggctctgtagacctgaaacagtttgaactgcttggctttggatgttagttgtgaacaaatatttgaccttcgcagttaatgaacatcgctctgtccgagcacccacaagctaagattttttttctttgtttctttttgagg

SEQ ID NO: 1350 - DNA, 1574 bp, Brachypodium distachyon
  misc_feature (5)..(9): n is a, c, g, or t
  misc_feature (580)..(582): n is a, c, g, or t
  misc_feature (615)..(615): n is a, c, g, or t
  misc_feature (627)..(627): n is a, c, g, or t
  misc_feature (870)..(870): n is a, c, g, or t
  misc_feature (921)..(921): n is a, c, g, or t
  misc_feature (927)..(928): n is a, c, g, or t
  misc_feature (1293)..(1293): n is a, c, g, or t
  misc_feature (1307)..(1307): n is a, c, g, or t
  misc_feature (1381)..(1381): n is a, c, g, or t
  misc_feature (1398)..(1398): n is a, c, g, or t
  misc_feature (1403)..(1403): n is a, c, g, or t
  misc_feature (1465)..(1465): n is a, c, g, or t
  misc_feature (1482)..(1482): n is a, c, g, or t
  misc_feature (1544)..(1544): n is a, c, g, or t
  misc_feature (1547)..(1547): n is a, c, g, or t
  misc_feature (1559)..(1559): n is a, c, g, or t
ctctnnnnnggctcccgacatcggcggcggcgcagcggcgggcgggcattgggagctcaaggcgccggcgacggccagcggagcggggcgggagcaagggagggagctctccggcggacgtgccgcgatccgggtgatcccgccggggattgttggcccgggagggccgcggcgatgaacggagcgagcaccggagccggcggcgaggggccgctggtgtacaaggcctggaaagggaacaatgtatttttcctccgggggaggtttatatttggacctgatgcgagatccttgtttgtcaccatgttcctcattatcgctccagtaacagtcttctgtgtgttcgtcgcgaaagaattgatgaatagattctcttatggcctggggttaccggtgatggttgtggctgttgtattcacggcatatgatttgtctcttctacttctcacttctgggagggatccaggtaccataccctggaatgcacatccagaacctgaaggttttgaaggcaatgctgaagttggagcttaccagactccactgttgcgtttgccccgagtgaaggatgtcgttgtgnnnggaatcactgtgaagacaaagtactgtgacacntgtatgctgtancggcctcctcgatgctcccattgctctatctgcaacaactgtgtcgagcgatttgaccatcactgcccatgggttgggcagtgcataggacttatcagagatgcggagcagataacaatatggaaggcaatggcaaagacccctgcgtcgatcgctctggttgtatacacatttatcgcggtttggtttgttggtggcctctcagtgtttcacttgtatctgatgagcactaaccagacaacntatgagaacttcaggtatcgctatgaccaacgggccaacccatacaacagnggagtnntggagaacatcaaggagatcttcttcacgccgatccctgtttccaggaacaacttcggcgccagagttccacaggagcagggcctgaggcctcgctcgacgaacggtttcatgagcccaaacatggggagagctgtcggcgatatcgagatgggcagaaagccagtggcatgggacgagccaaggatggcagccgagataggcgatctgggaggtcttggcaacttgctggaggacaaggatggcaggttccgcaacgcatcccctgatctaagccgtgacgcccttgtggtcggaggcctggatgagcaaggctcctcggtgatgaacccaccgcggacgagctggggagtcgaagcgggcagntgatggtaactggncaatgtggccatgtaagcagctatagtggaggactaagggatgtatgttagtgccagcttgttcctagtttggngtccggttgagactcgnggtcnctgatgttgttattaggcctatgacctgttgttgttttgctttgcatttcatgtatcagtgnttaagcagattgttggngtgtgaggtctccagttcagtagaatcctgattgtgtctgtatatagtttggagtggtgaanccngaaatggattgntttgctttggcttca

SEQ ID NO: 1351 - DNA, 1797 bp, Zea mays
ccatttggtctcatatcttcttctcgtccgtctcgcttctctctctcctgaggcgcagcggtggggtggggtagggccgtagggggcggcattgcgagctcacaccacctgcggcgcggcgatcccgggccaccgactgtcgggctatgtgatgatccgggccgtgatctcgacggctattcgcggctgaacgggcggcggcgatgaacggagcgagcgccggcgccggcggggaggcgccgctggtgtacaaggcctggaaggggaacaatgtgtttctactgaaggggaggttcatatttggccctgatgcaagatccctgtttatcaccatgttccttattgtcgcgccggtatcaattttctgcgcgttcgttgccaaggaattgatggataagttctcttatggtctgggattgccggttatgattgcagcagttctattcacagcatatgatctgagtcttctgcttctaacttctgggagagatccagggatcatacctcgcaatgcacatcctccagaacccgaagggtttgatggcaatgcagaggttggggctaaccagactccacccgtgcgtttgccccgagtgaaggatgttgttgtcaacggaatcactgtgaagacaaaatactgtgacacttgcatgttgtacaggcctcctcgttgctcccattgctctatctgcaacaactgcgtagaacgttttgaccatcactgcccctgggttggacaatgcataggacttaggaattacaggttcttctatatgtttgtattctcaacaactttgctctgcctgtatgtctttgggttctgctgggtgttcattattaagatcagaaatgccgagcagataacaatttggaaggcaatgacaaagacccctgcatctattgccttaatcatctacacattcattgcagtttggtttgttggtggcctctctgtgttccatctgtatctcatgagcacaaatcagacaacatatgagaacttcaggtatcgctatgatcagcgagacaacccatacaacaagggagtcatggaaaacatcaaagagatcttctttacaacgatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagccgcgacgcccttgcggttggaggaggcttagaagagcacggatcctcggcgatgaaccctgggcgctcaagctggggagttgaagcaggtcgatgatggcaatggcattgaccatgtaaggcggatgtagtgagatgctcagggttgttagtgccagttcgtcgctaatttgttgttttgttggagatttgaggtcactaatgttattagactttgacctgtatggttgtttctgaactttcttttcttcttcctcttaatttggggcgtcttccatgtccattgtttgaagcagtcggtttgtgacgtctccagcttggtagtgtcaggttttgtctgtatataatcggagcagtaagcctaaaataggtttcggttgcttgggtttggatggtaatggttgtgaacaatgtcgaaccttcgctttggagtaaatgaacatcgtttgatcggagtgcttatgttgaga

SEQ ID NO: 1352 - DNA, 1794 bp, Zea mays
ccatttggtctcatatcttcttctcgtccgtctcgcttctctctctcctgaggcgcagcggtggggtggggtggggtagggggcggcattgcgagctcacaccacctgcggcgcggcgatcccgggccaccgactatcgggctatgtgatgatccgggccgtgatctcgacggctattcgcggctgaacgggcggcggcgatgaacggagcgagcgccggcgccggcggggaggcgccgctggtgtacaaggcctggaaggggaacaatgtgtttctactgaaggggaggttcatatttggccctgatgcaagatccctgtttatcaccatgttccttattgtcgcgccggtatcaattttctgcgcgttcgttgccaaggaattgatggataagttctcttatggtctgggattgccggttatgattgcagcagttctattcacagcatatgatctgagtcttctgcttctaacttctgggagagatccagggatcatacctcgcaatgcacatcctccagaacccgaagggtttgatggcaatgcagaggttggggctaaccagactccacccgtgcgtttgccccgagtgaaggatgttgttgtcaacggaatcactgtgaagacaaaatactgtgacacttgcatgttgtacaggcctcctcgttgctcccattgctctatctgcaacaactgcgtagaacgttttgaccatcactgcccctgggttggacaatgcataggacttaggaattacaggttcttctatatgtttgtattctcaacaactttgctctgcctgtatgtctttgggttctgctgggtgttcattattaagatcagaaatgccgagcagataacaatttggaaggcaatgacaaagacccctgcatctattgccttaatcatctacacattcattgcagtttggtttgttggtggcctctctgtgttccatctgtatctcatgagcacaaatcagacaacatatgagaacttcaggtatcgctatgatcagcgagacaacccatacaacaagggagtcatggaaaacatcaaagagatcttctttacaacgatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagccgcgacgcccttgcggttggaggaggcttagaagagcacggatcctcggcgatgaaccctgggcgctcaagctggggagttgaagcaggtcgatgatggcaatggcattgaccatgtaaggcggatgtagtgagatgctcagggttgttagtgccagttcgtcgctaatttgttgttttgttggagatttgaggtcactaatgttattagactttgacctgtatggttgtttctgaactttcttttcttcttcctcttaatttggggcgtcttccatgtccattgtttgaagcagtcggtttgtgacgtctccagcttggtagtgtcaggttttgtctgtatataatcggagcagtaagcctaaaataggtttcggttgcttgggtttggatggtaatggttgtgaacaatgtcgaaccttcgctttggagtaaatgaacatcgtttgatcggagtgcttatgttgaga

SEQ ID NO: 1353 - DNA, 1851 bp, Zea mays
ataatggcaaatttctcgtccccagcaaagtccctccattcggtctcatctcccatctctcttctctctctcccgcgacatcagcggcggcgcagcggtggggtggggggacggcattgcgagctcacagtctcacaccacccgccgcgtggtgattccgagaggttgctgtgccgctggctatgtagtgatgtggaccgtgatctcgacggctatccgcggctgagcgggcggcggcgatgaacgaagcgagcgccagcgctggcgtcgggaccggctctggcggggaggtgccgctggtatacaaggcctggaaggggaacaatgtgtttttactgaaggggagattcatatttggtcctgatgcaagatccttgtttgtcaccatgttccttattgttgcgccagtatcaatcttctgtccattagttgcgaaggaattgatggataaattctcttatggtctgggattaccggttatgattgcagcagttctattcacagcatatgatctgagtcttctgcttctaacttctgggagagatccggggatcatacctcgcaatgcacatcctccagaacctgaagggtttgatgacaatgcagaggttggggctaaccagactccacctgtgcgtttgccccgagtgaaagatgttgttgtcaatggaattactgtgaagataaaatactgtgacacttgcatgttgtacaggcctcctcgttgctcccattgctctatctgcaacaactgcgtggagcgttttgaccatcactgcccatgggttggacaatgcatagggcttaggaattacaggttcttctacatgtttgtattctcaacaactctgctctgcctgtacgtctttgggttctgctgggtgttcgttgttaagatcagaaatgcagaacagataacaatttggaaggcaatgacaaagacccctgcatctgttgctttaatcatctacacattcattgcggtttggtttgttggtggcctctctgtgttccatttgtatctcatgagcacaaatcagacaacatatgagaacttcaggtatcgctatgatcaacgagccaacccatacaacaggggaatcatggtaaacatcaaacagatcttatttaccacgatccctccttccaagaacaacttctgtggtagggtccaacaggagcatggtctaaggcctcgtccaacaaatggtttcatgagtccaaacatggggagagctgttggtgacatcgagatgggtagaaaaccagtggcttgggatgagcctaggatggcagctgagattggtgatttaggagcaggtctgagcaacctgctggaggacaaggatggcaggtttcgtagcgcatctccagatctcagccgcgacgcccttgcagttggaggaggcttagaagaggaaggctcctcggcgatgaacgctgggcgttcaagctggggagttgaagcaggtcgatgatggcattgaccgtgtaagcggctgtagtgagacgctctgggttgttagtgccagttcgctgctaatctgttgttttgtttgagatttgaggtcactaatgttattagactcatgacctgtatggcggttgtttctggactttcttttcttctttctcttaatttgagatgtctttcgtgtctattatttgaaccagttggtttgtgacgtctcccggtttggcaagttatgttttgtctgtatataatcggacagtaagcctaaaataggatccagctgcttggatttggatggtaatggttgtgaataatgccctaccttttgcattgcagtaactgaacattgctcggtcttggtgcccatgtcaagatta

SEQ ID NO: 1354 - DNA, 1849 bp, Zea mays
ataatggcaaatttctcgtccccagcaaagtccctccattcggtctcatctcccatctctcttctctctctcccgcgacatcagcggcggcagcggtggggtggggggacggcattgcgagctcacagtctcacaccacccgccgcgtggtgattccgagaggttgctgtgccgctggctatgtagtgatgtggaccgtgatctcgacggctatccgcggctgagcgggcggcggcgatgaacgaagcgagcgccagcgctggcgtcgggaccggctctggcggggaggtgccgctggtatacaaggcctggaaggggaacaatgtgtttttactgaaggggagattcatatttggtcctgatgcaagatccttgtttgtcaccatgttccttattgttgcgccagtatcaatcttctgtccattagttgcgaaggaattgatggataaattctcttatggtctgggattaccggttatgattgcagcagttctattcacagcatatgatctgagtcttctgcttctaacttctgggagagatccggggatcatacctcgcaatgcacatcctccagaacctgaagggtttgatgacaatgcagaggttggggctaaccagactccacctgtgcgtttgccccgagtgaaagatgttgttgtcaatggaattactgtgaagataaaatactgtgacacttgcatgttgtacaggcctcctcgttgctcccattgctctatctgcaacaactgcgtggagcgttttgaccatcactgcccatgggttggacaatgcatagggcttaggaattacaggttcttctacatgtttgtattctcaacaactctgctctgcctgtacgtctttgggttctgctgggtgttcgttgttaagatcagaaatgcagaacagataacaatttggaaggcaatgacaaagacccctgcatctgttgctttaatcatctacacattcattgcggtttggtttgttggtggcctctctgtgttccatttgtatctcatgagcacaaatcagacaacatatgagaacttcaggtatcgctatgatcaacgagccaacccatacaacaggggaatcatggtaaacatcaaacagatcttatttaccacgatccctccttccaagaacaacttctgtggtagggtccaacaggagcatggtctaaggcctcgtccaacaaatggtttcatgagtccaaacatggggagagctgttggtgacatcgagatgggtagaaaaccagtggcttgggatgagcctaggatggcagctgagattggtgatttaggagcaggtctgagcaacctgctggaggacaaggatggcaggtttcgtagcgcatctccagatctcagccgcgacgcccttgcagttggaggaggcttagaagaggaaggctcctcggcgatgaacgctgggcgttcaagctggggagttgaagcaggtcgatgatggcattgaccgtgtaagcggctgtagtgagacgctctgggttgttagtgccagttcgctgctaatctgttgttttgtttgagatttgaggtcactaatgttattagactcatgacctgtatggcggttgtttctggactttcttttcttctttctcttaatttgagatgtctttcgtgtctattatttgaaccagttggtttgtgacgtctcccggtttggcaagttatgttttgtctgtatataatcggacagtaagcctaaaataggatccagctgcttggatttggatggtaatggttgtgaataatgccctaccttttgcattgcagtaactgaacattgctcggtcttggtgcccatgtcaagatta

SEQ ID NO: 1355 - DNA, 702 bp, Solanum tuberosum
ctttggccatcctcaacaatggccatcaccaatcttttatccaccaccattacactcaaacactcgccatttcttctactgaaaccctcaacaaaactcagaaaccccaaaaggccaacaattcgagctcaatctaagaacgacgactctgtagatggtccagatcgtttaatctccgccataacttacttctaccctttctttgatggtgttcagtacggtaaatatgtaatcacacagtttgctccaatacaaacgcttattcaacctttagtaccagctataagggtttttaagagctttccacttaatgggttgttggttttctttacactctactttattgttgttagaaatcctaattttagtagatatgtcaggttcaacactatgcaagctattgttcttgatgtgcttctcatttttcctgatttgttggagaggagtttcaatccaacagatgggtttgggttggatttgatgatgagctttgatagtactgtgtttttgtttcttttggtatctttggtttatggtagttcgtcttgcttgttgggtcagctacctagattgcccattgttgctgaagctgctgataggcaagtgctatgaactcgtaaatttacttatttctgaggtttcatcctctttgtacacttaattaagttttgctttagctgacaataaatagctatttcgttc

SEQ ID NO: 1356 - DNA, 855 bp, Solanum phureja
cccccaaaacaaatatctttggccatcctcaacaatggccatcaccaatcttttatccaccaccattacactcaaacactcgccatttcttctactgaaaccctcagcaaaactcagaaaccccaaaaggccaacaattcgagctcaatctaagaacgacgattctgtagatggtccagatcgtttaatctccgccataacttacttctaccctttctttgatggtgttcagtacggtaaatatgtaatcacacagtttgctccaatacaaacgcttattcaacctttagtaccagctataagggtttttaagagctttccacttaatgggttgttggttttctttacactctactttattgttgttagaaatcctaattttagtagatatgtcaggttcaacactatgcaagctattgttcttgatgtgcttctcatttttcctgatttgttggagaggagtttcaatccaacagatgggtttgggttggatttgatgatgagctttgatagtactgtgtttttgtttcttttggtatctttggtttatggtacttcgtcttgcttgttgggtcagctacctagattgcccattgttgctgaagctgctgataggcaagtgctatgaactcgtaaatttacttgtttatgaggtttcatcctctttgtacacttaattaagttttgctttagctgacaataaatagctatttcgttctgaagtacatgtttatgctctttagggccttgttcatgcatatcattttgctgtttctaaatgtggatatgtatattcttgcgatggaattagaaacattttggtttcttttatcaatgtaactacttttttttcta

SEQ ID NO: 1357 - DNA, 913 bp, Solanum melongena
aatgaagaatcagtctacctagtactagtagcctcccatccgattttgccctttctcttctttctcacacaaaaacaatctttggccatcttcaagaatggccatcaccaatcttttatccaccaccattacacccatccacttctcacacaaacactccccatttcttctactgaaacccgcaagaaaactcagaaaccccaaaaggccaacaattcgagctcaatccaagaacgaagactctgtagatggtccagatcgtttaatctctgccatcacttacttctacccattctttgatggtattcagtacggaaagtatgtaatcacacagtttgctccaattcaaacacttattcaacctttagtaccagctataagggttttcaagatctttccacttaatgggttattggttttctttaccctttactttattgttgttagaaattctaattttagtagatatgtcaggttcaacactatgcaagctattgttcttgatgtgcttctcacttttcctgatttgttggagaggagtttcaatccaagagatgggtttggattggatttgatgatgagccttgatagcactgtgtttttgtttcttttggtctgtttagtttatggttcttcgtcttgcttgttgggtcagctaccaagattgcccattgttgctgaagctgctgataggcaagtgttatgacctcctaaattttacttatttctgaggttccatcctctttgtacacttgttaatttttgcttcacctgacaatttatagctattttgttttgtcgcttttattaatggcttcaccattagaatctggttcttggatatgatgattctaaatgtggatatgtatattcttgctaaggaattagaaacatttatgtctcttgtatcaaa

SEQ ID NO: 1358 - DNA, 727 bp, Petunia hybrida
tacaacctccaatccaattgccccttttctactttctcccaaaaaacaaatatctttggccatcctcaagatttcaattcacaggatggccataatcaatcttttatccaccaccataacacccatccccttctcatacaacaaacaacttttgtacactacaacttcccacttcacttcccagctcaaacactcaccatttcttccactcaaaaccccaaaaaggcctacaattagagcccaatccaagaacgacgacacagctgatggcccagatcgtttaatctcagccattgcttacttttacccattctttgatggtgttcaatatggtaaatatgtaataacccaatttgcaccaatccaaacaatcattcaacctttagttccagcaataagagtcttcaagagtttcccactaaatgggctattagtatttttcaccctttactttgttgtggttagaaaccaaaattttagcaagtatgtgaggttcaataccatgcaagctattgtacttgatgtacttctcatatttcctgatcttttggaaaggagttttaatccaaaagatgggttgggcttagatttaatgatgagctttgatagtactgtgtttttgttccttttggtttctttagcttacggtacgtcgtcttgtttgttgggtcagcttcctcggttgcctattgttgctgaagctgctgatagacaagtgctttgaact

SEQ ID NO: 1359 - DNA, 1450 bp, Sorghum bicolor
accgcaaacagcagagaaaaaacagaaccccagatccaccgctccccatttctatccgcggccatggcctccgccgatgccgacgccgggacctgcccgtgggacgccctcccgtcgcacctccaggagcgcatcctctccctcctccccatcaccgagctacttcccgtcgccgcggtgtcccgcgcgctccgccgcctcctgcggtccccggcgttccacgccctcctatccccgcaccgcctcgacgccttcttcctcctttccccacggctcgccgtccacccgctgtcccgccgcgtcctcactttgcctgcgctcgccgcgctctctcccccttcctacccgctcgtctcctccccgtccccatcgctcctcatcacctgcgcctcactccagttcctcccgccgatccccgacggagcctacctcctctccgttatcgtcccgtcgcgccgctcctccccctcctgcaccctcgtcgctgtcaccaccggcgcagccgtgcgttctcacaccctggacaccggcgatccctccccgcgttgggcgtctagaggcgatctcccgctgtctctcacgatcctgggaaacgccgcagtcgcccgtgaccgcggcaagctcttcgtcctcggccgtggtcccgacgcgctcttggcttttgatctcgtgacggggacatgggaggtgccgcctgttgtgatgccacaaggtctcactacggcgcacctgtttgtttttgatgggagcctgttcttagtaggtgggatcgagagctttggagaagtggagcgggtggtggtctggcggctggacgtcgataaggaggaggtgtggtggtggagggaggtgagcgagatgccgaccgaggttttcgatgagttgctggctggtaggtttggcagtttctggcattttcaggctgcggacagattggggattgtttgcttgtacaatgccgtggatgggaggctggtcatgtttgatgcatctgatggcgcgtggactgtgctgccacgattgtctgggttggatgcagacgagagcctcaggtggtttggacatgtcttggagccaggagttgaaatcttgatgggactacgttgatctcatgttcacgtcattaaactcacaaagctgaagttactaaaagaggtgtatgcaagttgctggcaattaccaatgcattagagctcctgaaggtttcttttactcagctcatcatcgtgttcagaagcacaagctgcattaatgtgtaacttttcacagagcaaaattcttaccatcctttccttttggagagagagagaagaacttcatggttagaatgtgtaacttatctatcaatatatcatatctttctcttttcgtttctttgctatgctgtacccagctttgatctgtacgtccccatgttacatatgaaaaatcaaatttattgataaaacca

SEQ ID NO: 1360 - DNA, 3246 bp, Sorghum bicolor
tttcaaaaactctattattggtacagtttatacattgccaactgtgctgaattttcctcaccatgtaaacaaagcacattattttcagagctaatgttcatgtgaggactactaggactaggcaagtttaaattttcaagcaaaaggagcaagaaaaagccaaagccttttggcctataacccatcctttcaagttgtccgtccagccagtcacatagataagggccaattccacggtcccctccaattgcttgcttcagacttcagaggccagagctctctctgtctccccgggaaagccatggaggaagagcagagcccgaggcttggccgggagccggcgaccgagcccagtccttcgctggaatggccggagccggaatgtaagaacgacgacggtgtgaaagacccagaagacccggagagcaccggcggcggcggtgacggcaacggcatcagctccctggagcagccgctgctcaagcggagcaccaccctgacggccagccacctcgccatcgtcggcgccaaggtctcccacatcgagagcctcgactacgagatcatcgagaacgatctgttcaagcacgactggcgcagccggtccaacgtggaggtgctgcagtacatcttcctcaagtgggccatggcgttcctcgtcggcctcctcaccggcgtcatcgcgtccctcatcaacctcgccatcgagaacatctccggcctcaagatgcaacacatggtcaacctcgtccgcgagaagcgctactgggcgggcttcctctacttcgccggcgtcaacttcgcgctcaccttcgtcgccgccgtgctctgcgtcgtcttcgcccccaccgccgccggccccggcatccccgagatcaaggcttatctcaacggcgtcgacacgcccaacatgttcggcgcgccgcagctcatcgtcaagatcattggcagcatcggcgccgtgtcgtcgggaatggatctcggcaaggaggggccgctggtgcacatcggcgcgtgcctggccaacctgctcagccagggcggcgagggccgctggcggctgcgctggcggtggctgcgctacttcaacaacgaccgggaccgccgggacctgatcacgtgcggcgcgtcgtccggggtgtgcgcggcgtttcgcgcgcccgtcggcggcgtgctgttcgcgctggaggaggtggcgacgtggtggcggagcgcgctgctgtggcgcaccttcttcagcacggccaccgtcgtggtggtgctgcgcggcttcatcgaggtgtgcagggacgggcgctgcggcatgttcggcgagggcgggctcatcctcttcgacgtcagcgacgtcaccgtccgctaccacgtcggcgacctcctccccgtcacgctcgtcggcgtcctcggcggcgtcctcggggcgctctacaaccacgtcctccaccaggtgctccggctgtacaacctgatcaatgccaagggacggatggcgaagctggcgctcgccctcgcggtgtccgtgttcacgtcggcggggctgtacctcctgccgttcgccgtgccgtgctcgccgtgcgacccggcgttcggcgacgcgtgcccgacggtgggcaagtccggcaacttcaagcagttcaactgccccgacggctactacaacgacctcgcgtcgctgctccacgccaccaacacggacgccacgcgcaacatcttctccacgggcaccgccggcgagttcaggctcgactcgctgctcatcttcttcgccatctactgcgtgctggggctcttcaccttcggcatcgccgtgccgtcgggcctcttcctgcccatcatcctcatgggctccgcctacggccgcatggtcgcgctcgtgctcgcgcgcttcgtgcggatcgaccacggcctctacgccgtgctcggcgccgccgcgctcatgtcgggctccatgaggatgaccgtctcgctctgcgtcatcttcctcgagctcaccaacaacctcctcctgctccccatcaccatgttcgtgctgctcatcgccaagacggtcggtgacgccttcaaccccagcatctacgagatcatcctcgacctcaagggcctgccgttcctggagcccaagccggagacgtggatgaaggacctggccgtcggcgagctcgcggccgccaagccgcgggtcgttacgctgcaggtcatcgagaaggtgtccaccgtcgtcgaggtgctcaggtccacgccgcacaacggcttccccgtgctggaccggccacggccaggcgtgtcggagctccacgggctggtgctccggtcccacctcatggcagtgctcaagaagcggtggttcctgacggagaagaggaggacggaggaatgggaggcccgtgagaggttctcgtcgacggagctcgcggagaagtccgggagcatcgacgaggtggcggtgcagttgacgccggaggagctggacatgtacattgacctccacccgttcaccaacaccacgccgtacaccgtcgtagagaccatgtcggtggccaaggccgtggtgctcttccgcacctgcgcgctccggcacatgctcatcatcccaaagttccaaggccctgagatagctccaattgttgggattctaacaaggcaggacctgagggcacacaacatccttggtgcatttcctcatctggcaaacaaaaggaaagtacactaaggtctgcacagccatttttggtaatttaatgttctctgcatccaaacaaaaaggtccagctgcttcaagttctgtcatattcctttccccccatgttctatttttttctgtaagtagattgagggttaattgcttatcctctgagattgtgtgaataatagcttcccatgtaaaatcacacctgcacttttctgctcgcaaattgaacgttgtaatcaaaaggggcaaacacctgtgatgcaatatagattttttttttgagatgtttcaaattgctgttgcttgattctattgcttcgttctacatctataagagataacagtgtttagtcgcaatttgctaaaggttcggactgtcaatttggtgggtcaaccagacgagtcaatcacactgggcatagactggcaaattccgaaggaaaatcgaatttatttaactgtaaatactgaactttcttggtttaaagagagaccaagtgcctttgttttgggtaagccagcatggattgtggacagcgaggaatgcagtaatgatcgtt

SEQ ID NO: 1361 - DNA, 3743 bp, Zea mays
gttcgtggttcatcgaactaggaatgcaagtgggcaagtgccaaggaactgagcccatccaggttcatgatcaactggtactttccttgctctctctcagggaaaaaaaaccacagtccgccagtccatccatagaccatagtccaaaaggcaaggtgaggttgcaccttgaggtcgttctatcaataatcaatccatccatagaggcaaggtgaggttgccaagggggcaagtgcgtggtcacaaaagtgagacaccggatgagcttgctgtgtccattgcactcttcacctgaagtgcgagctgtgaaccttggtgacctcccaagaggcacctcaccccctcaaggcagggatcacatgtattaaatttcaaaaaaaaactctattattggtgccaactgtgctgaattttcttcatcacgtaaacaaagcacattctgaaagcaaaatgttcatgtgagggctaggactcggcaagtttagaaattttcaagcaaaagacgcgagagaaggccaaattcttttggcctatatgaagttgaggtgtctgaaacgagagatctcattctcatcactcatcaggctgcctctgtcaatgggtcaccactcatccaagcccccccatccttgcaagttgtcggtccagccagccacatagagacatataatcacatagataaggcgaattccacggtcccatccaattgcttgcttcagacttcagaggctagaggcaatagttctctctcccggtcccggggaaagccatggaggaagagcagagcccaaggctgggccgggatccggcgaccgagcccagtcctgcgccggaatggccggattcggacagcaagaacgacgacagtgcgaacgacccggaggaccctgccggcggcagcggcagcggcagcggcaacggcatcagctccttggagcagccgctgctcaagcggagcaccaccctgacggccagccacctggccatcgtcggcgccaaggtctcccacatcgagagcctcgactacgagatcatcgagaacgacctgttcaagcacgactggcggagccgctccaacgtcgaggtgcttcagtacatcttcctcaagtgggccatggcgttcctcgtcggcctcctcaccggcgtcatcgcgtccctcatcaacctcgccatcgagaacatctccggcctcaagatgctccagatggtcaacctcgtccgcgggaagcgctactgggcgggcttcctctacttcgccggcgtcaacttcgcgctcaccttcgtcgccgcggtgctctgcgtcgtcttcgcccccaccgccgctggccctggcatccccgagatcaaggcttatctcaacggcgtcgacacgcccaacatgttcggcgcgccgcagctcatcgtcaagatcatcggcagcatcggcgccgtgtcgtcggggatggatctcggcaaggagggcccgctggtgcacatcggcgcgtgcctggccaacctgctcagccagggcggcgagggccggtggcgcctgcgctggcggtggctgcgctacttcaacaacgaccgcgaccgccgggacctgatcacgtgcggcgcgtcgtccggggtgtgcgcggcgttccgcgcgcccgtcggcggcgtgctgttcgcgctggaggaggtggcgacgtggtggcgcagcgcgctgctttggcgcaccttcttcagcacggccaccgtcgtggtggtgctgcgcggcttcatcgaggtgtgcagggacgggcgctgcggcatgttcggcgagggcgggctcatcctcttcgacgtcagtgacgtcaccgtccgctaccacgtcggcgacctcctccccgtcacgctcgtcggcgtcctcggcggggtcctgggggcactctacaaccacgtcctccaccaggtgctccggctgtacaacctgatcaacgccaagggccggctggcgaagctggcgctcgccctcgcggtgtccgtgttcacgtcggcggggctgtacctcctgccgttcgctgtgccgtgcacgccgtgcgacccggcgttcggcgacgcgtgcccgacggtgggcaagtccggcaacttcaagcagttcaactgccccaccggctactacaacgacctggcgtcgctgctccacgccaccaacgtggacgccacgcgcaacatcttctccacgggcaccgccggcgaattcaggctcgactcgctgctcatcttcttcggcatctactgcgtgctggggctcttcaccttcggcatcgctgtgccgtcggggctcttcctgcccatcatcctcatgggctccgcctacggccgcatcctggcgctcgtgctcgcgcgcttcgtgaggatcgaccacggcctctacgccgtgctcggcgccgccgcgctcatgtcgggctccatgaggatgaccgtctcgctgtgcgtcatcttcctcgagctcaccaacaacctcctcctgctccccatcaccatgttcgtgctgctcatcgccaagacggtgggcgacgctttcaaccccagcatctacgagatcatcctcgacctcaagggcctgccgttccttgagcccaagccggaaacgtggatgaaggacctcgcagtcggcgagctcgcggccgccaagccgcgggtcgtcacgctgcaggtgatcgagaaggtgtccaccgtcgtggaggtgctgaggtccacgccgcacaacgggttccccgtgctggactggccgcggccaggcgtatcggagctccacgggctggtgctccggtcccacctgatggccgtgctcaagaagcggtggttcctgacggacaagaggaggacggaggaatgggaggcccgtgagaggttctcgtcgacggagctcgctgagaagtccggaagtatcgacgaggtggcggtgcagctgacgccggaggagctggacatgtacattgacctccacccgttcaccaacaccacgccgtacaccgtcgtggagaccatgtcggtggccaaggccgtggtgctcttccgcacctgcgcgctccggcacatgcttatcatcccaaagttccaagggcctgagatagctccaatcgtggggatcctaacgaggcaggacctgagggcacacaacatccttggtgcattccctcatttggcaaacaaaaggaaagtacactaagctctgtcgcgccatttttggtaaatttaatgttctctgcatccaaagaaaaaggtccagctgttttgtttccccatgttctatttttctctgtaagtagattgaggatttaattgcttgtctcatgagattgtgtgaataatagcttcccatgtaaaatcacatcttcaccttcacttttctgctcgcacttcgatccttgtaatcaaaaggggcaaacaaaacaactacgaaatatacattttttgggagatgtttcgaattgctattacttgattattttgcttcgttctacattataagagataacagtgtttagtcgcaatttgctaaaggttcaggcacagactcacagtcaatttggtgggtcaaccagaaagacaactcttgagttaacgacacagcgcatagaccagcaaattccaaaagattttcgaattcatccaactgtaaatactgaactttactggtttaaagcggacccctgcctttgttttggccttttgcgtaagccagcatggattgtggaccgggaccgctaggcgctagggatgcaataatgcttgtt

SEQ ID NO: 1362 - DNA, 3154 bp, Zea mays
gaagtgcgagctgtgaaccttggtgacctcccaagaggcacctcaccccctcaaggcagggatcacatgtattaaatttcaaaaaaaaactctattattggtgccaactgtgctgaattttcttcatcacgtaaacaaagcacattctgaaagcaaaatgttcatgtgagggctaggactcggcaagtttagaaattttcaagcaaaagacgcgagagaaggccaaattcttttggcctatatgaagttgaggtgtctgaaacgagagatctcattctcatcactcatcaggctgcctctgtcaatgggtcaccactcatccaagcccccccatccttgcaagttgtcggtccagccagccacatagagacatataatcacatagataaggcgaattccacggtcccatccaattgcttgcttcagacttcagaggctagaggcaatagttctctctcccggtcccggggaaagccatggaggaagagcagagcccaaggctgggccgggatccggcgaccgagcccagtcctgcgccggaatggccggattcggacagcaagaacgacgacagtgcgaacgacccggaggaccctgccggcggcagcggcagcggcagcggcaacggcatcagctccttggagcagccgctgctcaagcggagcaccaccctgacggccagccacctggccatcgtcggcgccaaggtctcccacatcgagagcctcgactacgagatcatcgagaacgacctgttcaagcacgactggcggagccgctccaacgtcgaggtgcttcagtacatcttcctcaagtgggccatggcgttcctcgtcggcctcctcaccggcgtcatcgcgtccctcatcaacctcgccatcgagaacatctccggcctcaagatgctccagatggtcaacctcgtccgcgggaagcgctactgggcgggcttcctctacttcgccggcgtcaacttcgcgctcaccttcgtcgccgcggtgctctgcgtcgtcttcgcccccaccgccgctggccctggcatccccgagatcaaggcttatctcaacggcgtcgacacgcccaacatgttcggcgcgccgcagctcatcgtcaagatcatcggcagcatcggcgccgtgtcgtcggggatggatctcggcaaggagggcccgctggtgcacatcggcgcgtgcctggccaacctgctcagccagggcggcgagggccggtggcgcctgcgctggcggtggctgcgctacttcaacaacgaccgcgaccgccgggacctgatcacgtgcggcgcgtcgtccggggtgtgcgcggcgttccgcgcgcccgtcggcggcgtgctgttcgcgctggaggaggtggcgacgtggtggcgcagcgcgctgctttggcgcaccttcttcagcacggccaccgtcgtggtggtgctgcgcggcttcatcgaggtgtgcagggacgggcgctgcggcatgttcggcgagggcgggctcatcctcttcgacgtcagtgacgtcaccgtccgctaccacgtcggcgacctcctccccgtcacgctcgtcggcgtcctcggcggggtcctgggggcactctacaaccacgtcctccaccaggtgctccggctgtacaacctgatcaacgccaagggccggctggcgaagctggcgctcgccctcgcggtgtccgtgttcacgtcggcggggctgtacctcctgccgttcgctgtgccgtgcacgccgtgcgacccggcgttcggcgacgcgtgcccgacggtgggcaagtccggcaacttcaagcagttcaactgccccaccggctactacaacgacctggcgtcgctgctccacgccaccaacgtggacgccacgcgcaacatcttctccacgggcaccgccggcgaattcaggctcgactcgctgctcatcttcttcggcatctactgcgtgctggggctcttcaccttcggcatcgctgtgccgtcggggctcttcctgcccatcatcctcatgggctccgcctacggccgcatcctggcgctcgtgctcgcgcgcttcgtgaggatcgaccacggcctctacgccgtgctcggcgccgccgcgctcatgtcgggctccatgaggatgaccgtctcgctgtgcgtcatcttcctcgagctcaccaacaacctcctcctgctccccatcaccatgttcgtgctgctcatcgccaagacggtgggcgacgctttcaaccccagcatctacgagatcatcctcgacctcaagggcctgccgttccttgagcccaagccggaaacgtggatgaaggacctcgcagtcggcgagctcgcggccgccaagccgcgggtcgtcacgctgcaggtgatcgagaaggtgtccaccatcgtggaggtgctgaggtccacgccgcacaacgggttccccgtgctggactggccgcggccaggcgtatcggagctccacgggctggtgctccggtcccacctgatggccgtgctcaagaagcggtggttcctgacggagaagaggaggacggaggaatgggaggcccgtgagaggttctcgtcgacggagctcgctgagaagtccggaagtatcgacgaggtggcggtgcagctgacgccggaggagctggacatgtacattgacctccacccgttcaccaacaccacgccgtacaccgtcgtggagaccatgtcggtggccaaggccgtggtgctcttccgcacctgcgcgctccggcacatgcttatcatcccaaagttccaaggccctgaggtccatagctccaatcgtggggatcctaacgaggcaggacctgagggcacacaacatccttggtgcattccctcatttggcaaacaaaaggaaagtacactaagctctgtcgcgccatttttggtaaatttaatgttctctgcatccaaagaaaaaggtccagctgttttgtttccccatgttctatttttctctgtaagtagattgaggatttaattgcttgtctcatgagattgtgtgaataatagcttcccatgtaaaatcacatcttcaccttcacttttctgctcgcacttcgatccttgtaatcaaaaggggcaaacaaaacaactacgaaatatacattttttgggagatgtttcgaattgcta

SEQ ID NO: 1363 - DNA, 3047 bp, Brachypodium distachyon
aaatatgggaaaaatatattggcatggtacagtttacatgaactggcaacttacggactaattcatgtgaataatagccacatataattaacatacatgtggtgagaactgaggactaggcactagaaaataagcagaagagcaagaaaaagccaaaatattttgcctataagagggtagctctaatgagagatggcctccctcatcagggctcagcctgccaatgggtcgccacaagtaatcgatccatttgcaagccagataaggagcattgaaatggcgcctccaactgtccactactccatttatatacacacatcccatccttgacttgccacgagaccttcttcctgcttcggaaacttggagaaacagagccaccaaaacgctctgcgacagctctgtgccaaggacgggcatggagggcgagcagagccagctggggctcgccggagagccgcctacgacagcgagtccgggagcgcaacaaggcaaacacgacgacggcgtcaacaacgacaacgaggacccggagaaccaggagagcggcaatggcggcatccggtccctggagcagccgctgctgaagaggagcaacaccctgactgccagccatctcgccatggtcggcgccaaggtctcccacatcgagagcctcgactacgagatcatcgagaacgacctgttcaagcacgactggcggcggcggtcgaacggggaggtgctgcagtacatcttcctcaagtgggcgctggcgttcctggtgggcctcctgacgggtgtcatcgcgtcgctcatcaacctcgccatcgagaacatctccggcctcaagatgcttcacatggtccagctcgtccgggacaagcgctactgggcggggttcctctacttctccggcatcaacttcgcgctcaccttcgtcgccgccgtgctctgcgtcgtcttcgcccccaccgccgccggccccggcatccccgagatcaaggcctacctcaacggcgtcgacacgcccaacatgttcggcatgccgcagctcatcgtcaagatcatcggcagcatctgcgcggtgtcgtcggggctggatctgggcaaggaaggcccgctggtgcacatcggggcgtgcctggcgaacctgctgagccagggcggcggcatccgctggctccgctacttcaacaacgaccgggaccggcgggacctgatcacctgcggcgcctcctcgggcgtctgcgcggcgttccgttccccggtcggcggcgtcctcttcgcgctggaggaggtggccacgtggtggcggagcgcgctgctgtggcggaccttcttcagcacggcgaccgtggtggtcgtcctgcgcgggttcatcgaggtctgccgcgacgggcggtgcgggctcttcggcgaaggcgggctcatcatcttcgacgtcagcgacgtcaccgtccggtaccacgtcggcgacctcctgctcgtgaccctcgtgggcgtcatcgggggaatcctcggcagcctctacaactacctcctccacatggtgctccgcctctataacctcatcaacgacaaagggaaatccgccaagctctgcctcgcgctcgccgtctgcgtcttcacctccgccgggctctacctgctccccttcgccgttccctgcaccccctgcgacccggcgttcggggcggcgtgcccgtccacggggaagagcggcaacttcaagcagttcaactgcgccgccggggaatacaacgacctggcgacgctcctccacgcgaccaacgtcgacgcgacccggaacatcttctccacggggactccccacgagttccggctcgactcgctgctcatcttcttcgccatctactgcgttctcggcctcttcaccttcggcatcgccgtcccctcggggctcttcctccccatcatcctcatgggcgccgcctacgggcggatcgtggcgctggttctccagcgattcgctcaaatcgaccacggcctctacgcggtgctgggtgcggcggcgctcatgtcggggtccatgaggatgaccgtctccctgtgcgtcatcttcctggagctcaccaacaacctgctgctgctccccctgaccatgttcgtgctgctcatcgccaagacggtcggcgacgccttcaaccccagcatctacgagatcatcctcgacctcaaggggctgccgttcctggagcccaagccggagccctggatgaaggacctcacagtaggggagctcgccgccgccaagccgcggacggtctcgctccaggtggtcgagagggtttccaccatcgtggaagtgctgaggggcacgggccacaacgggttccccgtggtgggccggcccaggcccggcctgtcggagcttcacgggctcgtgctccgctcgcacctcgtcgccgtgctcaggaagcggtggttcctgacggagcagaggcgcacggaggactgggaggcccgggagcggttctcgtccgtggagctcgccgacaagagcgcgaagctcgaggacctccaggagatcacgcccgaggagatggagatgttcgtcgatctacatccgtttaccaacaccacgccgtacaccgtcgtggagaccatgtcggtggccaaggccgtcgtgctcttccgcgccgtcgcgctccggcacatgctcatcatgcccaagttccagggacccgagatatctccgatcgtggggatcttgacgaggcaggacctgagggcgcacaacattctgggtgcgtttcctcacctggcaaacaaaaggaaggctcattgagactgaagcttggcggcaccaattttgggaattgcttcactccatggttgttgtcttcggagcaagagaacgctcgcttgcttctgcgagattcacagaattctttcttttcttccttcttttatgtgcaggtagattcaggatttattttcttctcttctgggagtgtctgaataattgctgcccccatgtaaaatcacacctgtcccctctacacaccgatcatgatatgcaatacagagtttttttgtccttc

SEQ ID NO: 1364 - DNA, 2366 bp, Setaria italica
ccatggaggacgagcagagccagagacccgccggggagccggcggccgagcccggtcctgcgccggagctggaatgcaagaatgaggacggtgtggaggacctggaggaccccgagagcaccgccggcaacggcatcagctccctggagcagccgctgctgaagcggagccccaccctgacggccagccacctcgccatcgtcggcgccaaggtctcccacatcgagagcctcgactacgagatcatcgagaacgatttgttcaagcacgactggcggagccgtccaacgtggaggtgctgcagtacatcttcctcaagtgggcgatggcgttcctcgtcggcctcctcaccggcgtcatcgcgtcgctcatcaacctcgccatcgagaacatcaccggtctcaagatgctgcacatggtgggcctcgtccgcgagggccgctattgggcgggcttcctctacttcgccggcgtcaacctcgcgctcaccttcgtcgccgccgtgctctgcgtcgtcttcgcccccaccgccgccggccccggcatcccggagatcaaggcctacctcaacggcgtcgacacgcccaacatgttcggcgcgccgcagctcatcatcatcggcagcatcggcgcggtgtcctcggggatggatctcggcaaggagggcccgctggtgcacatcggcgcgtgcctggcgaacctgctgagccagggcggcgagggccggtggcggctacgctggcggtggctgcgctacttcaacaacgaccgggaccggcgggacctcatcacctgcggcgcctcgtcgggggtctgcgcggcgttccggtcgcccgtcggcggcgtgctcttcgcgctcgaggaggtggcgacgtggtggcggagcgcgctgctatggcgcaccttcttcagcacggccaccgtcgtcgtcgtcctccggggcttcatcgaggtctgccgcgacggccgctgcggcatgttcggtgagggcgggctcatcctcttcgacgtcagcagcgtcaccgtccgctaccacctcggcgacctcctccccgtcacgatcgtcggcgtccttggcggcgtcctcggcgcgctctacaaccacgtcctccaccaggtgctccgcctctacaacctcatcaacgccaaggggcggctggcgaagctggccctcgccctcgccgtctccgtgatcacctcggcggggctctacgtgctccccttcgccgtgccctgtacgccctgctctgccgccggcgccgccgccgatttctgcccgacggtgggcaagtccggcaacttcaagaagttcaactgccccgacgggttctacaacgacctggcgtcgctcctccacgccaccaacaccgacgccacccgcaacatcttctccacgggcaccgccggcgagttccgcctcgactccctgctcatcttcttcgccgtctactgcgtgctggggctcatcaccttcggcatcgccgtgccgtccggtctcttcctccccatcatcctcatgggctccgcctacggccgcatcctggcgctcctgctcgcgcgcttcgtgcacatcgaccatggcctctacgccgtgctcggcgccgccgcgctcatgtcggggtccatgcggatgaccgtctcgctctgcgtcatcttcctcgagctcaccaacaacctcctcctcctccccatcaccatgttcgtgctcctcatcgccaagaccgtcggcgacgccttcaaccccagcatctacgagatcatcctcgacctcaagggcctgccgttcctcgagcccaagccggagacgtggatgaaggacatcaccgtcggcgagctcgccgccgccaagccgcgcgccgtcacgctccaggtcgtcgagaaggtgtccaccatcgtcgcggtgctgcgcgccacgccgcacaacggcttccccgtgctcgaccggccacggccgggggtgtcggagctgcacgggctcgtgctccggcagcacctcatggccgtgctcaggaagcggtggttcctgcaggagaagaggaggacggaggagtgggaagcgagggagaggttctcgtcgacggagctcgccgagaaggccgggagcatcgacgacgtgcagctgtcgccggaggagctcgacatgtacattgacctccacccgttcaccaacactacgccgtacaccgtcgtggagaccatgtccgtcgccaaggccgtcgtgcttttccgcacctgcgcgctccggcacatgctcatcatcccaaagttccaaggcctagagatatctccgattatgggcaggatctgagggcgcacaacatccttggtgccttccctcatctggccaacaaaaggaaagtccactg

SEQ ID NO: 1365 - DNA, 2440 bp, Pennisetum glaucum
cgagatcatcgagaacgatctgttcaagcatgactggcggagccggtccaacgtggaggtgctgcagtacatcttcctcaagtgggcgatggcgttcctcgtcggcctcctcaccggcgtcatcgcgtcgctcatcaacctcgccatcgagaacatcaccggcctcaagatgctccacatggtcggcctcgtccgcgagggccgctactggtcgggcttcctctacttcgccggcgtcaacctcgccctcacctttgtcgccgccgtgctctgcgtcgtcttcgcccccaccgccgccggccccggcatccccgagatcaaggcctacctcaacggcgtcgacacccccaacatgttcggcgcgccgcagctcatcgtcaagatcatcggcagcatcggcgcggtgtcgtcggggatggatctcggcaaggagggtccgctggtgcacatcggcgcgtgcctggcgaacctgctgagccagggcggcgagggccggtggcggctgcgctggcggtggctgcgctacttcaacaacgaccgggaccggcgggacctcatcacctgcggcgcctcctctggcgtctgcgcggcgttccgggcgcccgtcggcggcgtgctcttcgcgctcgaggaggtggccacatggtggcggagcgcgctgctgtggcgcacctttttcagcacggccaccgtcgtcgtcgtcctccggggcttcatcgaggtctgccgcgacggccgctgcggcatgttcggcgagggcggcctcatcctcttcgacgtcagcggcgtcaccgtccgctaccacctcggcgacctcctccccgtcaccctcgtcggcgtccttggcggcgtcctcggcgcgctctacaaccacgtcctccaccaggtgctccgcctctataacctcatcaacgccaagggccggatggcgaagctcgccctcgccctcgccgtctccgtcatcacctcggcggggctctacatgctccccttcgccgtgccctgcacgccctgctccgccgccggcgccgccgcggacacctgcccgacggtcggcaagtcgggcaacttcaagcagttcaactgccccgacgggttctacaacgacctggcgtctctcctccacgccaccaacaccgacgccacccgcaacatcttctccacgggcaccgccggcgagttccgcctcgactccctgctcatcttcttcgccgtctactgcgtgctggggctcatcaccttcggcatcgccgtcccgtccgggctcttcctccccatcatcctcatgggctccgcctacggccgcatcctggcgctcctgctcgcgcggttcgtgcacatcgaccacggcctctacgccgtgctcggcgcggcggcgctcatgtccgggtccatgcggatgaccgtctcgctctgcgtcatcttcctcgagctcaccaacaacctcctcctcctccccatcaccatgttcgtgctcctcatcgccaagaccgtcggcgacgccttcaaccccagcatctacgagatcatcctggacctcaagggcctgccgttcctggagcccaagccggagacgtggatgaaggacctcaccgtcggcgagctcgccgccgctaagccgcgcgccgtcacgctgcaggtggtcgagaaggtgtccaccgtcgtcgccgtgctgcgcgccacgccgcacaacggattcccggtgctcgaccggccgcgcccgggggtgtccgagctgcacgggctcgtgctccggcagcacctcatggccgtgctcaggaagcggtggttcctggcggagaagaggaggacggaggagtgggaagccagggagaagttctcgtcgacggagctcgccgagaaggccggcagcatcgacgacttgcagctgtcgccggaggagatggacatgtacattgacctccacccgttcaccaacaccacgccgtacaccgtcgtggagaccatgtccgtcgccaaggccgtcgtgctcttccgcacctgcgcgctccggcacatgctcatcatcccaaagttccaaggcctggagatatccccgatcatggggatcctgacaaggcaggatctgagggcgcacaacatcctcggtgcgttccctcatctggccaacaagaggaaagtccactgatcaggtcggaggcaccatttttggcaattttaatgttcccctgcacgcatccaaacagaaagattcagctgctgcttgtagtgttgtgctacgagattcttttttttgctgtgttctgctgctcttctctgtaagtagaatgattgagggttattttactcctctcgtatgaggaactgtgtgaataattgcttctcatgtaaaaccacacctgcacttctccgctctcttccactgatgtaatcaaaatggagcaaaataccaatggttcaatacagattttttaatttt

SEQ ID NO: 1366 - DNA, 1549 bp, Solanum phureja
agaacatgtaggattttccagattaggttctgactcctctttttctctctcacactctccctcgtgtactgtcctctgcattgcggctagggtttcacctaaatatccctacttttttgttcctattgacctgtactgattttacaactgatttatgacgatggatattcggatgaactagcggttgtcgcggtgtgttgacacataaaaaggtaaaaagggtttttgtagctcttgaaaatggcggatttgaacccctttgatttgcttggtgatgatgataacgatgatccatcaaagctgattgctattcaccagcaaaaagttgatccggcgaagagagcctcagctccggcggctaagaagcagccggcgaagctccccactaagcctcctcccccgactcaagctgtcagggaggcaaaaacagaatttggacgtggtggaggtagaggtggtggacgtggctacagccgtggtcgtggtggaggtgggttcaatagggaagcatccaacaatgagaacttttctcgcaacagagaattttcaggtggtatagctgcacctgaatacatggaaggaggaagaccctccgaaagacgtggtggttatggtggaccccatgctttccgtggtggtagaccaggtggttttggtaatgaagaaatgcccgagggggaccggcctcgtaggacatttgaacgccgtagtggtactggccgcggaaatgagataaagcgtgaaggtgctggccgaggaaattggggaactgaagcagatgaagttactcagatgactggtgaagttgctgatgaaggtgagaaaaatctgaatgtggagaaaccctccaccgaagaagaagcaggagacgacaagaaggaaaatccagctgctgaagctgaggacaaggagcctgaagataaggagatgacccttgaagagtatgagaagttgctagaagaaaaacggaaggctttgcaggcgcttaagactgaggaaaggaaggtcgacaccaaagtatttgaatccatgcaacagatttcaaagaaacccagtgatgaaatctttgtcaaattgggatccaaggataagagaaaagagtctgctgagaaggaagagaaggcaaagaaggctgtcagcattaatgagtttttgaagcctgctgagggcgagaggtattatgcacctggtggtcgaggtcgagggcgtggccgcggttctagaggttacagtggagccaacacaatgagcaatgtggaagctgctcctcccattgaagatccaggtcacttccctacattgggtggcaagtgatgcttttgtagtgcttttctaccacgtccaagaggcaaatctgactataataatggagtggaagtttcaatgtaaatttcttccgtttatgtgatcctttctgtagcttttttattttattttatctgaatcctactgggttatatgaagcacattaacttacgcatgatcttttccttgtgctgttttattctagtaatattttctgtgcattatttaatgataattctcatct

SEQ ID NO: 1367 - DNA, 1485 bp, Solanum tuberosum
ctctttctctctcacacactctccctcgtgtactgtcctctgcattgcggctagggtttcacctaaatatccctacttttttgttcctattgacctgtactgattttacaactgatttatgacgatggatattcggatgaactagcggttgtcgcggtgtgttgacacataaaaaggtaaaaagggtttttgtagctcttgaaaatggcggatttgaacccctttgatttgcttggtgatgatgataacgatgatccatcaaagctgattgctattcaccagcaaaaagttgatccggcgaagagagcctcagctccggcggctaagaagcagccggcgaagctccccactaagcctcctcccccgactcaagctgtcagggaggcaaaaacagaatttggacgtggtggaggtagaggtggtggacgtggctacagccgtggtcgtggtggaggtgggttcaatagggaagcatccaacaatgagaacttttctcgcaacagagaattttcaggtggtatagctgcacctgaatacagaggaagaccctccgaaagacgtggtggttatggtggaccccatgctttccgtggtggtagaccaggtggttttggtaatgaagaaatgcccgagggggaccggcctcgtaggacatttgaacgccgtagtggtactggccgcggaaatgagataaagcgtgaaggtgctggccgaggaaattggggaactgaagcagatgaagttactcagatgactggtgaagttgctgatgaaggtgagaaaaatctgaatgtggagaaaccctccaccgaagaagaagcaggagacgacaagaaggaaaatccagctgctgaagctgaggacaaggagcctgaagataaggagatgacccttgaagagtatgagaagttgctagaagaaaaacggaaggctttgcaggcgcttaagactgaggaaaggaaggtcgacaccaaagtatttgaatccatgcaacagatttcaaagaaacccagtgatgaaatctttgtcaaattgggatccaaggataagagaaaagagtctgctgagaaggaagagaaggcaaagaaggctgtcagcattaatgagtttttgaagcctgctgagggtgagaggtattatgcacctggtggtcgaggtcgagggcgtggccgcggttctagaggttacagtggagccaacacaatgagcaatgtggaagctgctcctcccattgaagatccaggtcacttccctacattgggtggcaagtgatgcttttgtagtgcttttctaccacgtccaagaggcaaatctgactataataatggagtggaagtttcaatgtaaatttcttccgtttatgtgatcctttctgtagcttttttattttattttatctgatgtgttactcttctggtcctactgggttatatgaagcacatcaacttatgcatgatcttttccttctgctgtttattctagtaa

SEQ ID NO: 1368 - DNA, 2043 bp, Capsicum annuum
taaaatcttacaagtgatttattataatggatatatatatgccgatgaactgacacatatatataataatataaaaaaaaaaaagtgaaggaagggttattgtagttgtgcttgcaaaatggcggatttgaatccctttgatttgcttggtgatgatgacaccgatgatccatctaagctcattgctattcaccagcaaaaagctgctccgacgaagaaaccatccggtccggcggcggcggctaagaagcagccggcgaagctccctacgaagccacctcctccgactcaggctgtgagggaggcaaaaacagaatttggacgtggtggaggtagtggtggtggacgtggctacagccgtggtcgtggtggaggtgggtttaatagggaatcatccaacaatgagaactttcctcgcaacagagaattttcaggtggcatagttgcacctgaatatgtggaaggaggaagaccctctgaaagacgtggtggttatggtggaccccgtgctttccgtggtggtcgacaaggtggttttagtaatggagaaatgcctgagggggaccggcctcgtaggacatttgaacgccgcagtggtactggccgcggaagtgagataaagcgtgaaggtgctggccgaggaaattggggaactgaagcagatgaagttactcagatgactggtgaagtcgcaaatgaaggtgagaaaaatctgaatgtggagaaaccctccaccgaggaagaagcaggagatgacaagaaggaaaatctagttgctgaagctgaggacaaggagcctgaagataaggaaatgacccttgaagagtatgagaagttgctggaagaaaaacggaaggcgttgcaggctcttaagactgctgaggaaaggaaggtcgacaccaaagtatttgaatccatgcagcagctctcaaagaaatccggtgatgaaatcttcgtcaaattgggttccaaggataagaaaagagagtctgctgagaaggaagagaaggcaaagaaggcagtcagcattaacgagtttttgaagcctgctgagggcgagaggtattatgcacctggtggtcgaggtcgagggcgtggccgcggttctagaggttacagtggagccagcacgacaagcaacgtggaagctgctcctcccattgaagatccaggtcacttccctacattgggcggcaagtgatgcgttgtcagtgctttcctcccactccaagaggcaaattaactataataatggagtttggaagtgtcagtgtttcgatgtaaatttcttctgtcgtgtgattctctcttgttgttttttattttaaattatctgattgtgttactcttctgatatactggggtatatgaagcacattaacttgacgcaaaaaaaaagcaacacacattattacaataatcatacaacacactacatcaacaaatcatttaagtaattcaaatcaacaacacttaaacaatgaatccaacaatattcaaaatacttaaacactcctaaagatttttcactaattaaaagctaagttcaaaaatatctaaaaattatctaaaagtcaagtccaacaacactaaggagtagcctaacaaactcctcataactctctgtttcctctttgctacttgaattaggagcaacggcttgtgtcaaggcacgtctaagatgtgcaatctaatatgacatagcagtatgtctctcaaaaattgtagaaatggcctgatcgtgctttgccaaccaacaacacattgtcggaatgacgttgggctggaactggctcagctgtggagccagctggagcagcaattggtggtggagaggagctcaccgttgacggagagagcggcggcgacggctgtttgagaaggagagacggtggtagctgcagctatttcaccgatggcggcgctgggcgactgctgttgggggatgaatggagggaggcaaagcggcgacggaggttggcgaggtggctggtggtcagcaatggttttgttttagagagaaggtagacaagagcctcgtgc

SEQ ID NO: 1369 - DNA, 1444 bp, Solanum melongena
cagattaggttctctgactcatctttctctccccctacctctgaattgcggctagggtttcaccaaaaaatccctcgtgtactgatctctgattttacaactgttttacgattatggataatcggatgagctagagtttgtgaaggtgtctgatgcttagagttttctgtagctattgaaatatggcggatttgaatccctttgatttgctgtgtgacgatgataacgatgacccatctaagctgattgctattcaccagcaaaaagttgatccggcgaagaaagcctcagctccggcggctaagaagcagccggcgaagcttcccactaagcctcctcccccgactcaggctgtcagggaggcaaaaacagaatttggacgtggtggaggtagaggtggtggacgtggctacaaccgtggtcgtggtggaggtgggtttaacagggaagcatccaacaatgagaacttttctcgcagcagagaattttcaagtggtatagctgcacctgagtacgtggaaggaggaagaccctctgaaaggcgtggtggttatggtggaccccgtcctttccgtggcggtcgacaaggtgattctagtaatggagaaatgcctgagggagaccggcctcgtaggatatttgaacgccgtagtggtactggccgcggaagtgagataaagcgtgaaggttctggccgaggaaattggggaactgaagtagatgaagttactcagatgactggggaagtttctaatgaaggtgagaaaaatctgaatgtggagaaaccctccaccgaggaagaagcaggagatgacaagaaggaaaatgaggctgctaaagctgaggacaaggagcctgaagctaaggagatgacccttgaagagtatgagaagttgctagaagaaaaacgtaaggctttgcaggcacttaagactgaggaaaggagggtcgacaccaaagtttttgaatccatgcaacagctttcaaagaaatccagtgatgagatcttcgtcaaattgggctccaaggataagagaagagagtcttctgagaaggaagagaaggcaaagaaggcagtcagcattaacgagtttctgaagcctgctgagggtgagaggtatcatgcacctggtggtcgaggtcgagggcgtggccgtggtagaggttacactggagccaacacgacgagcaatgtggaagctgctcctcccattgaagatcgaggtcacttccctacattgggtggcaagtgatgcttctgtagtgcttgtctcccacatccaagaggcaaatctgactataataatggagtggaagtttcattgtaaatttcttccgttcatgtgatcctctctgtagcttttattttccttttcttttttcacaattttatctgatatgttactcttctgatctactggggtatatgaaactcattaactta

SEQ ID NO: 1370 - DNA, 1489 bp, Nicotiana benthamiana
  misc_feature (1049)..(1049): n is a, c, g, or t
gatctcacacacacacactcactctccctccctcgtgtactacactcagcattgcggctagggtttcaccgaatatctttttcacaaattatcatagggtttttgtctgttcttcacaactgatttatgataatggatatacggatgaattaagctttttcgagggattttagacttataaaaaactaaagggttttttgtaattgttgcttgaaatggcggatttgaacccatttgatttgctgggtgatgatgacaacgatgacccatctaagctgattgccattcagcagcaaaaagttgataccgcaaagaaaccctctgctccggcggcggcggcggctaagaagcagccggctaagctccccactaagcctcctcccccggctcaggctgtcagggaggcaaaaacagaggttggacgtggaggaggtagaggcggtggacgtggttacagccgtggtcgtggtggaggcgggtttaatagggaagcatccaacaccgagaatttttctcgaaacagagaattttctggtggtatagctgcacctgaagatgtggaaggaggaagactctatgaaagacgtggcggttatggtggaccccatgcttttggtggtggtcgacgagccggttttagtaatggagaatttcctgagggagaccggcctcgtaggatatttgagcgccgtagtggtactggccgcggaggtgagataaagcgtgaaggagctggccgaggaaattggggaactcaagcagatgaagttactcagataagtgatgaagttgctaatgaaggcgagaaaaatctgaatgcggagaaaccctccgcagatggagaagcaggagacgacaagaaggaaaatccagctgctgaagctgaggacaaggagcctgaaaataaggagatgacccttgaagagtacgagaaggtgctagaagaaaagcggcaggctttgcaggcacttaaaactgaggaaaggaaggtcgacaccaaagaatttgaatccatgcagcagctttcaaagaaatccagtgatgacatnttcatcaaattgggccccaaggataagagaaaagagtctgctgagaaggaagagaaggcaaagaaggcagtcagcattaatgagtttctgaagcctgctgagggtgagaggtattatgcacctggtggtcgaggtcgaggaggtcgtggccgtggttctagaggttacggtggagccgacactacgagcaatgtggaagcccctcccattgaagatccgggtcactttcctacattgggtggcaagtgatgctttattagtgcttttctccctcgtccaagaggcaaattgacttaaaaataatggagtgaaagggtcaatgtttctgatggccttcaatgtaaatttcttgccctcatgccatgccctctgtagtttttttcttaatgtggtgttacttttctgatatattggcgtatatgaagcacattaatttatgc

SEQ ID NO: 1371 - DNA, 1831 bp, Sorghum bicolor
caccgatctcgctctgcagtctgctcacatagcaaaataatggccccagcggcgacagctcggcacgtggtcgccgtgccataccccggccgtggtcacatcaaccccatgctcgtcgtgtgccgcctgctcgccgccgcggacgccgccgtcagcatcaccgtcgtcgtcacggaggagtggcacgcgctgcttgccgccgcgggggtgcccgacgcgctccccgaccgcgtccgcctcgccaccatccccaacgtcatcccctcagagcgggaccgcggcgccgacttcgcaggcttcgtcgaggccgtgcaggtcaagatggtggggcccgtcgagcggctgctggaccgcctgacgctggagcggaagccggacgccatcgtggccgacaccttcctgacttggggcgtgacggccggagctgcgcgggggataccggtgtgctcgctgtggacgcagccggccacgttcttcttggcgctctggcacctggaccgatggccgccggttgatgaagaaggcctaagctgcaaatccttggatcaatatttcccattcccagccctctcgtcagtaaaatgttctgacatcaagatcttccgctccatggtactgccaatgaaacgattagcagaagtgttctccaacgtgcgcaaggcacagtgtgtcctcttcacctccttctatgagcttgaaaccggtgccatcaatggaacaaggcaagtggttccttgccccatatatacagttggtccttcaattccatatctgtcactgaagggtgattcagccaagcttcaccatgagaactactttgattggctggattgccaaccaagaaactcggtattgtacgtatcatttggcagctatgtttcgatgccttcgtctcagttggaagaggttgctttggggctgcatgaaagcacagttaggttcgtctgggtggcccgggacagagctaccaccaccaccctccagcagatctctggtgacaagggtttggtggtgccatggtgtgaccagctgaaggtcctgtgccacccctccatcggtggcttcctgagccattgtggatggaactcgaccctggaggccgtgttcgctggagtgccaatgcttgcttttcccgttttttgggatcagttggtgattggtcatctcgtagccgatgaatggaagattggcatcaacttgagggaacagagaagggaggatggtgttgtcagcagggccgcaatctctgatgctgtaacaaagcttatggatttgagtgatgatgatagcctagagatgagaagaagggctgcagaattgcgggaggcttcactcggcgcaattcaggaaggtggatcttcacggtgttctttgaacaatttctttacagatatcatcgaaggaagactgaatgttgcagaaacttcgctgtaggtttttgcttaaatttgtggagtcagtgacagaaacgttgctcgtaggcaaaaacattgtgctcctgcaaataaggtatggggctcgtctcatgttcacgcattttcaccccacccgcaacaattatacaaggtgcggcttgaaatcattattgccacacacctatagttgtacactttctggagctgaaaacagaagacatgatgctgtctgtagcaaagatgggggacagcgataatcatgtcacaaaaattatgtgcctgggaaaacttgtgcaggaacttatgcttcataatactactattgtggaataatgaagtgctttgtatcgtatgggcccctatttcttatatttatgtaagtgcatctgtccctactttaggttcagtcgaaacag

SEQ ID NO: 1372 - DNA, 1519 bp, Brachypodium distachyon
tgtcatcaacatgttcaaaactatacatttcctgccttggttacggggaagctttgatcacacatgggcctgaccggttcatgtcagggagcagttcaaatggtcataaagaagaaaaagcaagcaaatggcaaccacttgtggagcatgagcttttacacctgttttgacaaacttgccccccatttctactgcaaaaccactccaatatgctatataatcccatgagagaactagaccaacaagagacacaggctagcaactgaaatgagctccctcgccatgaactccctgctcgccaccttggcagttgccgtccttgccctcttcccgattgctgctgtcggagctggcctgaaggtcgggttctacagcaagacctgcccatccgcggagaccctggtgcagcaggcagtggctgcttccttcaagaataacggtggtgtcgctgctggcctcatccgattgcatttccacgactgctttgtgaaaggttgcgacggctcagtcctgatcgactcaactgcaaacaacactgctgagaaggacgcaatccccaacaaccccagtctccgcgggtttgaggttattgatgctgcaaagaaggccattgaggccaaatgccccaagatagtctcatgcgctgacatccttgcctttgccgcccgagacagcatagcactagcaggtaatgttacttacaaggtgcctgctggtcgccgtgatggcaggatatccagtgaccagaatgccctgaacaacctcccctcgccgctctcaacggcatctgagctggtaggcaacttcaccttgaagaatctcacagctgaggacatggtcgtcctctccggtgcccacacgataggtgtctcgcgctgctcgtccttcacgaacaggctatatggcttcagcaacaccagtcaggttgatcctacaatgagctctgcctatgctttcctgctcaagaacatatgccctgccaacagcagccagttcttcccaaacacaacgatggatatggatatcatcacccccgcggtgcttgacaataagtattatgtgagtctgataaacaacctaggcctatttacgtcagaccaagcattactcacaaactcaactctgaaagcatcagtggacgagtttgtgaagaacgaaaatagatggaagagcaagtttgtcaagtccatggttaagatggggaacattgaggtgctaacaggaacacaaggagagattaggctcaactgcagggtcataaacaaagggagcactggtcttgagtttaattctggtatcaactctggtgaattcactgaaatagcaacaagctagtgggtgctgtggactgtggtctcaagtaatgcagtaaatcgaacttttaggttgttgctttgacaagaataaaagaaaacaagcatacaaaaactgaaggaaaacaaaagattgtcctgttttctgttttgcctcgtgtatgactaagtgctttgttgtatcaatacagaaacaaattttcagc

SEQ ID NO: 1373 - DNA, 1385 bp, Saccharum officinarum
caccgccccaccgtccaccgccaccaatcggcagcaacgcgcgcaaccgcgtcctcgtacggcagcagccggtgagagagagagagagagggaatgggcgaccacgagggtcgcggggacgatttcgagaagaaggccgatcagaagctctccggatggggcctcttcggcaacaagtacgaggaagccgccgacctcctcgacagggccggcaacttcttcaaactcgcgaagaactggagcagagcagctgcggtatacaaaaagattgcagattgtcatttgcggggagatagcaagcacgaggctgcctctgcttatgttgaggcagcaaactgctacaaaaagttctcaccacaagatgctgcacaagcacttaacaatgccgttaatcttttcctggaaatcggtagactgaacatggctgcaagatacagcaaggatatcggtgaaatctatcagcaagaacaagatttagagaatgctgcagtctacctgaatcgagctgctgatctttttgatagtgagggacaatcctctcaggcaaacagcatgacacagaaaattgcagaaatatatgctcagctggaaaagtaccagaaagcaaccgagctctttgaagaaattgctcgtaaatcaataaacaataaccttctcaagtacggtgtcagaggcattttacttaatgcgggcctttgccaactatgtagaggcgatactgttgctataaataattcattggagcgctatcaggacattgacccaaccttctcagggacacgcgaatacaagcttttggcggaccttgcagcctctatggatgaaggagacgttgacaagtttactgatgctgtaaaggaatttgacagcatgacacgcctggatccttggaaaacaagtctccttctaaaggcaaagaatgagttgaagaaaaaggatgaggatgaggatgatctaacctaggctttgttctacaaaaggttcaatgatttcattgaggatgccatgaagtcataagtatggatatagaaaaccgcctggataaatgctttcgctatggacacctgtttggactttggagtactctggttaccacttaattcaccgccgcatttggaatccagtagctgctatttgtgtcatcctatatgttgcatttcttccattagtgttcatgattatatatgctgcacatattactccaggctttctagtataaataggtttaaataataggagtagtgtggattttgttttatatatgtgtttgagagtatgtaatcagagagaaagaaatgattgaactacattgctttcattgattgatatggtatttatacatgctgaactgtcgcccagcaatcggtcggcgtccattcagaggc

SEQ ID NO: 1374 - DNA, 1337 bp, Zea mays
gcaggccgcaaacccaggaaggcgccaggtgccctgtcgcagcagttcgcactccgcagggcaccaccgtccacctccaccgccaccgatcggtagcaacgcgcaccaccgcgtcgtcgtacggcagcacacggaaagagagagagagagagagagagagagagaggaatgggcgaccacgagggtcacggggtcgatttcgagaagaaggccgatcagaagctctccggctggggcctcttcggcaataagtacgaggaagccgccgacctcctcgacagggctggcagcttcttcaaactcgcgaagaactggagcagagcggctgcggtatacaaaaagattgcagattgtcatttgcagggggataacaagcacgatgctgcctctgcttatgttgaggcagcaaactgctacaagaagttctccctgcaagatgctgcacaagcacttaacagtgccgttaatcttttccaggaaatcagtagactgaacatggctgcaagatacagcaaggatatcggtgaaatctatctgcaagaacaagatttagagaatgccgcagtctacctgaatcgcgctgctgatctttttgatagtgagggacaatcctctcaggcaaacagcatgacacagaaaatcgctgaaatatatgctcagctggaaaagtaccagaaagcaaccgagctctttgaagaaattgctcgtaaatcaataaacaataaccttctcaagtacggtgtcagaggcactcttcttaatgcgggcatttgccaactttgtagaggtgatgttgttgctataaataattcattggagcgctatcaggacattgacccaaccttctcagggacacgcgaatacaagcttttggcagaccttgcagcctctacggatgaaggagacgttggcaagtttactgatgcagtaaaggagtttgacagcatgacacgcctggatccttggaaaacaactctccttctgaaggcaaagaacgagttgaagaaaaaggaggaggatgaggatgatctaacctaggctctgttccacaaaaggtttcatgatttcgttgaggatgccgtgaaatcattacacaagattgtttgatataagtatggatatacaaaacctcctggataccgcatttggaatccagtagctgccatttatatatatggcatcctatatgttgcatttgtggattattgttcatggttatatatgctacccatattactccagtctttctagtataaagaggtttaatattccctccattcctttttagttgtcgcgttttagtcgaaaaataatctaacggacgacaaatatttgag

SEQ ID NO: 1375 - DNA, 1337 bp, Zea mays
gcaggccgcaaacccaggaaggcgccaggtgccctgtcgcagcagttcgcactccgcagggcaccaccgtccacctccaccgccaccgatcggtagcaacgcgcaccaccgcgtcgtcgtacggcagcacacggaaagagagagagagagagagagagagagagaggaatgggcgaccacgagggtcacggggtcgatttcgagaagaaggccgatcagaagctctccggctggggcctcttcggcaataagtacgaggaagccgccgacctcctcgacagggctggcagcttcttcaaactcgcgaagaactggagcagagcggctgcggtatacaaaaagattgcagattgtcatttgcagggggataacaagcacgatgctgcctctgcttatgttgaggcagcaaactgctacaagaagttctccctgcaagatgctgcacaagcacttaacagtgccgttaatcttttccaggaaatcagtagactgaacatggctgcaagatacagcaaggatatcggtgaaatctatctgcaagaacaagatttagagaatgccgcagtctacctgaatcgcgctgctgatctttttgatagtgagggacaatcctctcaggcaaacagcatgacacagaaaatcgctgaaatatatgctcagctggaaaagtaccagaaagcaaccgagctctttgaagaaattgctcgtaaatcaataaacaataaccttctcaagtacggtgtcagaggcactcttcttaatgcgggcatttgccaactttgtagaggtgatgttgttgctataaataattcattggagcgctatcaggacattgacccaaccttctcagggacacgcgaatacaagcttttggcagaccttgcagcctctacggatgaaggagacgttggcaagtttactgatgcagtaaaggagtttgacagcatgacacgcctggatccttggaaaacaactctccttctgaaggcaaagaacgagttgaagaaaaaggaggaggatgaggatgatctaacctaggctctgttccacaaaaggtttcatgatttcgttgaggatgccgtgaaatcattacacaagattgtttgatataagtatggatatacaaaacctcctggataccgcatttggaatccagtagctgccatttatatatatgtcatcctatatgttgcatttgtggattattgttcatggttatatatgctacccatattactccagtctttctagtataaagaggtttaatattccctccattcctttttagttgtcgcgttttagtcgaaaaataatctaacggacgacaaatatttgag

SEQ ID NO: 1376 - DNA, 1136 bp, Pennisetum glaucum
ggagcagcggaagggagcgagagggatgggggaccacgagttgcgcggggacgatttcgtgaagaaggccgatcagaagctatccggctggggcttcttcggcaacaagtacgaggacgccgccgagctcctcgacaaggccggcaacttcttcaagctcgccaaaaattggagcagagcggctgaagtatacaaaaagattgcacattgtcatttgcagggagatagcaagcatgaggctgcctccgcttatgttgaggctgcaaactgctacaaaaagttctcaccacaagatgctgcacaagcacttgacagtgctgttaatctgttcttggaaattggcagactgaacatggctgcaagatacagcaaggatattggtgaaatctatctgcaagaacaagatttagagaatgctgcagtctacctgaatcgggctgtggatctttttgacagtgagggacaatcatctcaggcaaacagcgtgacacagaaaattgcagagatatatgctcagctggaaaagtatcagaaggcaactgagctctttgaagaaatcgctcgtaaatcaataaacaataaccttctcaagtacagtgtccgaggaattctacttaatgcaggcatttgccagctatgtagaggtgatcctgttgctataaataattcattggagcgctatcaggatattgacccaaccttttcagggacacgcgaatacaagcttttggcggatcttgcagcctccatggatgaaggagacgttgccaagtttactgatgccgtgaaggagtttgacagcttgacacgcctggatccttggaagacaactctccttctcaaggcaaagaacgagctgaagaagaaggaagacgatgaggatgatctaacctaggctttggttgctctacaaatggtggcacatggtccctttgctcgagattgacatttgtatagaatatagagatacaaaacctcctggatgcctctgttgtggatgtctgtttggattttggagcactccggttaccccactcagtttgctgtcggattggaaatttagaacgcagtacctatatattacaacttactctttttgttatcctgctactatatgctaagaactcgtttctctt

SEQ ID NO: 1377 - DNA, 1223 bp, Pennisetum glaucum
ttcccttcccttcctttccctcgccgcagtccgggccgggcggcagcgagccagcgatcgggaagccagcacgcgacgctgctctccgccggagcagcggaagggagcgagagggatgggggaccacgagttgcgcggggacgatttcgtgaagaaggccgatcagaagctatccggctggggcttcttcggcaacaagtacgaggacgccgccgagctcctcgacaaggccggcaacttcttcaagctcgccaaaaattggagcagagcggctgaagtatacaaaaagattgcacattgtcatttgcagggagatagcaagcatgaggctgcctccgcttatgttgaggctgcaaactgctacaaaaagttctcaccacaagatgctgcacaagcacttgacagtgctgttaatctgttcttggaaattggcagactgaacatggctgcaagatacagcaaggatattggtgaaatctatctgcaagaacaagatttagagaatgctgcagtctacctgaatcgggctgtggatctttttgacagtgagggacaatcatctcaggcaaacagcgtgacacagaaaattgcagagatatatgctcagctggaaaagtatcagaaggcaactgagctctttgaagaaatcgctcgtaaatcaataaacaataaccttctcaagtacagtgtccgaggaattctacttaatgcaggcatttgccagctatgtagaggtgatcctgttgctataaataattcattggagcgctatcaggatattgacccaaccttttcagggacacgcgaatacaagcttttggcggatcttgcagcctccatggatgaaggagacgttgccaagtttactgatgccgtgaaggagtttgacagcttgacacgcctggatccttggaagacaactctccttctcaaggcaaagaacgagctgaagaagaaggaagacgatgaggatgatctaacctaggctttggttgctctacaaatggtggcacatggtccctttgctcgagattgacatttgtatagaatatagagatacaaaacctcctggatgcctctgttgtggatgtctgtttggattttggagcactccggttaccccactcagtttgctgtcggattggaaatttagaacgcagtacctatatattacaacttactctttttgttatcctgctactatatgctaagaactcgtttct

SEQ ID NO: 1378 - DNA, 889 bp, Setaria italica
ggatgggggaccatgagttgcgcggggacgatttcgtgaagaaggccgatcagaagctctccggctggggcttcttccgcaacaagtacgaggacgccgccgacctcctcgacaaggccggcaacttcttcaagctcgccaagaactggagcagagcagctgcagtatacaaaaagattgcagattgtcatttgcagggagatggcaagcatgaggctgcctctgcttatgttgaggctgcaaattgctacaaaaagttctcaccacaagatgctgcacaagcacttgacagtgccgttaatctattcttggaaattggcagattgaacatggctgcaagatacagcaaggatattggtgaaatctatcagcaagaacaagatttagagaatgctgcagtctacctgaatcgggctgctgatctttttgacagtgagggacaatcatctcaggcaaacagcatgacacagaaaattgcagaaatatatgctcagctggaaaagtaccagaaggcaaccgagctctttgaagaaattgctcgtaaattaataagcaataaccttctgaagtacagtgtccgaggaattctacttaatgcaggcatttgccaactatgtcgaggtgatcctgttgctataaataattcattggagcgctatcaggatattgacccaaccttctcagggacacgcgaatacaagcttttggctgatcttgcagcctccatggatgaaggagacgttgccaagtttactgatgccgtaaaggagtttgacagcttcacacgcctggatccttggaaaacaactctccttctcaaggcaaagaacgagctgaagaaaaaggaagatgatgatgaggatctaacataggctttgctagctctaca

SEQ ID NO: 1379 - DNA, 1234 bp, Cenchrus ciliaris
ctccggccagcccatcacccaaggaggcgccagatccccctttcccttccattcccttccctcgccgtagtccggaccgggcggcagcgagccagcgatcggtagcagcacgcgacgccgctcagccgtagcagcgggagagagcgagagggatgggggaccacgagttgcgcggggacgagttcgtgaagaaggccgatcagaagctctccggctggggcttcttcggcaacaagtacgaggacgccgccgacctcctggacaaggccggcaacttcttcaagctcgccaagaactggagcagagcagctgcagtgtacaaaaggattgctgattgccatttgcagggagataacaagcatgaggctgcctccgcttatgttgaggctgcaaactgctacaaaaagttctcaccacaagatgctgcacaagcacttgacagtgcagttaatctattcttggaaattggcagactgaacatggctgcaagatacagcaaggatatcggtgaaatctatcagcaagaacaagatttagagaatgctgcagtctacctgaatcgggctgtggatctttttgacagtgagggacaatcatctcaggcaaacagcatttcacagaaaattgcagaaatatatgctcaactggaaaagtatcagaaggcaacagagctctttgaagaaattgctcgtaaatcaataaacaataaccttctcaagtacagtgtccgaggaattctacttaatgcaggcatttgccaactatgcagaggtgatcctgttgctataaataattcattggagcgttatcaggatattgacccaacattctcagggacacgtgaatacaagcttttggcggatcttgcagcctccatggatgaaggagatgttgtcaagtttactgatgccgtaaaggagtttgacagcttgacacgcctggatccatggaagacaactctcctactcaaggcaaagaacgagctgaagaagaaggaagttgatgaggatgatctaacctaggctttgctagctttagaaattgtggcttgatcactttgcagatgctacctattctgtttctcttcatactgtttgtgcttatctattctgtgcatattcctccagactttatgtgtgatatatggactaaaatagtaggaaagagtgttaaatttgttttcaaatgccacggatcgattgttgaggtgaatggaaataaagatggggactga

SEQ ID NO: 1380 - DNA, 1255 bp, Saccharum officinarum
cgactcaacagacccgcacgacgaagcaaacagaggcatcccaccctttcgctttccgccgtttcctctcccgactctctcttcgccgggagccggcgaccgccgcggagtaggaggaacagagaccgatcgaggcggcggcggcggcggtggctgcagctgcagaggcgatgggtgatcacgaggctcgcggtgacgacttcgagaagaaggcggagaagaaactctcgggctggggcctcttcagctccaagtacgaggacgccgccgacctcttcgacaaggctgcgaactccttcaagctcgccaagaactggagcagagctgcatcagtgtacatcaagattgctaactgtcatttgaagggagatagcaagcacgaggctgcctcagcgtatgtcgaggcagcaaattgctacaaaaagttctcacctcaagaagctgcgcaagcgctaaaccagtctgttaatcttttcttggaaattggtaggttgaacatggctgcaagatacagcaaggacattggtgagatatatcagcaagaacaagatttagagaaggctacagattacttggaaagggcagctgacctttttgacagtgagggacagtcgtctcaatcaaacatcatcaaacagaaagtagcagaaattgctgctcagttggaacagtacccaaaagcaactgagatatttgaagcgattgctcgccagtcaatcaacaataatcttcttaagtatagtgtcagaggaattctccttaatgctggcatctgccaactatgtagaggtgatcctgttgccatcataaattcattggagcgataccaggaaattgacccgactttctctgggacacgtgaatacaagcttttagctgatcttgctgcatctatggatgaaggggatgttgccaaattcactgatgccatcaaagaatttgatagcatgacacgtctggatccttggaaaactaccctgctgctcagggcgaagaatgagctgaagaaaaaggacgacgatgaggacgaccttacataagtattgttgtaaaaaatggtaccatatgttttggtttgtgcctccattgcattggaggccacgtgttccttacaaacgagcatgatgaaactaatcgcaggtctggttgcacagaacgtcaatttgggttgtcctgttgatgtgactaccagtttcgttgacttcatgatttgctgtcagattgaaaattagtaccgaatgcttttttctgcgac

SEQ ID NO: 1381 - DNA, 1301 bp, Panicum virgatum
acagacatcccacccctccgcgtgggtgtgcgccgttcccctcccccctctccctttttcctcttccggcctctcccctcgccggccaccgccgcggaggagtaggcgtgacagagacacagatcgtcgcggcggcgacgatgggcgaccacgaggctcgcggggacgacttcgagaagaaggcggagaagaagctcacgggctggggcatcttcggctccaagtacgaggacgccgccgacctcttcgacaaggctgctaactccttcaagctcgccaagaactggagcagagctgcatcagtgtacatcaagattgcaaactgccatttaaagggagatagcaagcatgaggctgcctcagcatacgttgaggctgcaaattgctacaaaaaattctcacctcaggaagctgcgcaggcgctaaatcaagctgttaatcttttcttggaaattggtaggttgaacatggccgcaagatacagcaaggacattggtgagatatatcagcaagaacaagatttagagaaggctacagattacctggaaagagcggctgacctttttgacagtgaggggcagtcatcccaagcaaacaccatcaagcagaaagtggcagaaattgctgctcagttggaacagtacccaaaggcaactgagatttttgaagggattgcccgtcagtcaatcaataataatcttcttaagtatggtgtcagaggcattctccttaacgctggcatttgccaactatgtagaggtgatcctgttgctatcacaaattcattggagcgataccaggaaattgacccaactttctctgggacacgggaatacaagcttttagctgatcttgctgcatcaatggatgaaggagatattgcgaaattcactgatgccatcaaagaatttgatagcatgacacgtctggatccttggaaaaccaccctgcttctcagggcaaagaacgagctgaagaaaaaggaagacgatgaggatgacctaacataaacattgttgtaaaattcatatgatatggtttggtttgtgcttgcatttcatcgtggaggcttcttgttccttataaatgagcatcatgagatcaatccctggtctggttgtacagaatttcaatttgggctatcctgttgatttgctgtcagaatgaaaattagtaccgaatgcttgtttctggggttcctgttacttggttgttttaacatttgcgactgtcttatttgctatggtagtccatataaggtatacacctcttatttgttaccttggtggtccgacttcatc

SEQ ID NO: 1382 - DNA, 1374 bp, Setaria italica
cgccgttccccttccccctccccatccccctcctttccctccggcctctcccctcgccggcgaccgccgcgaaggagcaggcggaacagacaaaccgatcgcggcggtggaagcgatgggcgaccacgaggcgcgcggggacgacttcgagaagaaggcggagaagaagctctcgggttgggccatcttcggctccaagtatgaggacgccgccgacctcttcgacaaggccgccaactccttcaagctcgccaagaactggagcagagctgcatcagtgtacatcaagattgctaactgtcatttaaagggagatagcaagcatgaggctgcctcggcatacgttgaggctgcaaattgctacaaaaagttctcacctcaggaagctgcacaggcactaaatcaggctgttaatcttttcttggaaattggtagattgaacatggccgcaagatacagcaaggacattggtgagatatatcagcaagaacaagatttagagaaggctacagattacctggaaagagcggctgacctttttgacagtgagggacagtcatctcaagcaaacaccatcaagcagaaagtagcagaaattgctgctcagttggaacagtacccaaaagcaactgagatttttgaagggattgctcgccagtcaatcaacaataatcttcttaaatatagtgtcagaggcattctccttaacgctggcatttgccaactatgtagaggtgatcctgttgctatcacaaattcattggagcgataccaggaaattgacccgactttctctgggacacgtgaatacaagcttttagctgatcttgctgcatcgatggatgaaggagatattgccaaattcactgatgccatcaaagaatttgatagcatgacacgtttggatccttggaaaaccaccctgctcctcagggcaaagaacgagttgaagaaaaaggaggacgatgaggacgacctaacttaagcattattgtaaaattcctatgatatggtttggtttgtgcctgcgtttcagcgttgaggctttggtgtttcttataaatgaacatcatgagattaatcactagtccggttgtacagtacttcgatttgggttatcctgttgatttgctgtcaaaatgaaaatggtaccgtatgcttgtttctggggttcctgttacttggttgttttcgtatttgtgacgatcttatttgctatggtagtcctatacacctcttatttatttatattggcggtcctactttatacagtttttttccgaccttattgtgttactgttgtaaacatttaccagctttatgaagttcatgcaactggtggattttgcagttgtcttaaagttatgatgttac

SEQ ID NO: 1383 - DNA, 1388 bp, Zea mays
aaataatgttacaaatggaaaagtgagaagcaacttctttggactaaaaaaatccaattttctccgcgacgaaggagaggcatccctcccttccgcgtggtgtgctctctgttcccctacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcagtcaatcaacaacaatcttcttaagtatagtgtcagaggaattcttcttaatgctggcatctgtcaactatgtagaggtgatcctattgccatcacaaattcattggagcgataccaggaaattgacccgactttctctgggacacgtgaatacaagcttttagctgatcttgctgcatctatggatgaaggggatgttgccaaattcactgatgcaatcaaagaatttgatagcatgacacgtctggatccttggaaaaccaccctgctgctcagggcgaagaacgagctgaagaaaaaggaggacgatgaggacgaccttacataagtattgtagtaaaaagaaatggtacgatatgttttggtttgtgcctccattgcattggaggcatcgtgttccttacaaacgagcatgatgaaattaatcgctggtctggttgtacagaacgtcaatttgggttctactgttgatgtgactgccagtttcgttgacttgatgccagagtgaaaattagtaccgagatgcttgtttctggggttctgttcttttcaaatctttagaccttatttcctattgtacttctatacctcgtattaataatctaagcggtttccaatggattgtatc

SEQ ID NO: 1384 - DNA, 1390 bp, Zea mays
aaataatgttacaaatggaaaagtgagaagcaacttctttggactaaaaaaatccaattttctccgcgacgaaggagaggcatccctcccttccgcgtggtgtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcagtcaatcaacaacaatcttcttaagtatagtgtcagaggaattcttcttaatgctggcatctgtcaactatgtagaggtgatcctattgccatcacaaattcattggagcgataccaggaaattgacccgactttctctgggacacgtgaatacaagcttttagctgatcttgctgcatctatggatgaaggggatgttgccaaattcactgatgcaatcaaagaatttgatagcatgacacgtctggatccttggaaaaccaccctgctgctcagggcgaagaacgagctgaagaaaaaggaggacgatgaggacgaccttacataagtattgtagtaaaaagaaatggtacgatatgttttggtttgtgcctccattgcattggaggcatcgtgttccttacaaacgagcatgatgaaattaatcgctggtctggttgtacagaacgtcaatttgggttctactgttgatgtgactgccagtttcgttgacttgatgccagagtgaaaattagtaccgagatgcttgtttctggggttctgttcttttcaaatctttagaccttatttcctattgtacttctatacctcgtattaataatctaagcggtttccaatggattgtatc

SEQ ID NO: 1385 - DNA, 1244 bp, Pennisetum glaucum
agcagacgcacgacgaagcaaacagggacacccagcagacgtcccccctcccctccccgtgccgacgcggaggagcagccgggcccaagagagaccgaccgcggcggaggggggctatgggggaccacgaggcgcgcgggcacgacttcgagaagaaagcggagaagaagctctcgggctgggccatcttcggctccaagtacgaggacgccgccgacctcttcgacaaggccgccaactccttcaagctcgccaagaactggagcagagcagcatcagtgtacatcaagattgctaactgtcatttaaagggagatagcaagcatgaggctgcctcggcatatgttgaggctgcaaattgctacaaaaagttctcacctcaggatgctgcacaggcgctaaatcaggctgttaatcttttcttggaaattggtagattgaacatggccgcaagatacagcaaggacattggtgagatatatcagcaagaacaagatttagagaaggctacagattacctcgaaagagcggctgacctttttgacagtgaggggcagtcatctcaatcaaactccatcaagcagaaagtagcagaaattgctgctcaattggaacagtacccaaaagcaactgagatttttgaagcgattgctcgccagtcaatcaacaataatcttcttaagtatagtgtcagaggcattctccttaatgctggcatttgccaactatgtagaggtgatcctgttgctattacaaattcatttgagcgataccaggaaattgaccctactttctctgggacacgtgaatacaaacttttagctgatcttgctgcatctatggatgaaggagatattgccaaattcactgatgccattaaagaatttgatagcatgacacgtttggatccttggaaaactaccttgctcctcagggcaaagaacgagttgaagaaaaaggaggacgatgaggacgacctaacataagcattgttgtaaaattggtatgatatggtttggtttgtgtgtgcattccatcgtggacgtttctgtgttccttataactgagcatcatgagcgccagtctgtctgtaaagtatttttcctatcctgttgttttgctgtcagaatggaactagtacaaaattcttgcatctgggctcctgttacttggttttcatatttgtgacgatcttatttgctacggtagtcatacacctcttatttatatatacgcaaatgact

SEQ ID NO: 1386 - DNA, 1085 bp, Pennisetum glaucum
gaggcgcgcgggcacgacttcgagaagaaagcggagaagaagctctcgggctgggccatcttcggctccaagtacgaggacgccgccgacctcttcgacaaggccgccaactccttcaagctcgccaagaactggagcagagcagcatcagtgtacatcaagattgctaactgtcatttaaagggagatagcaagcatgaggctgcctcggcatatgttgaggctgcaaattgctacaaaaagttctcacctcaggatgctgcacaggcgctaaatcaggctgttaatcttttcttggaaattggtagattgaacatggccgcaagatacagcaaggacattggtgagatatatcagcaagaacaagatttagagaaggctacagattacctcgaaagagcggctgacctttttgacagtgaggggcagtcatctcaatcaaactccatcaagcagaaagtagcagaaattgctgctcaattggaacagtacccaaaagcaactgagatttttgaagcgattgctcgccagtcaatcaacaataatcttcttaagtatagtgtcagaggcattctccttaatgctggcatttgccaactatgtagaggtgatcctgttgctattacaaattcatttgagcgataccaggaaattgaccctactttctctgggacacgtgaatacaaacttttagctgatcttgctgcatctatggatgaaggagatattgccaaattcactgatgccattaaagaatttgatagcatgacacgtttggatccttggaaaactaccttgctcctcagggcaaagaacgagttgaagaaaaaggaggacgatgaggacgacctaacataagcattgttgtaaaattggtatgatatggtttggtttgtgtgtgcattccatcgtggacgtttctgtgttccttataactgagcatcatgagcgccagtctgtctgtaaagtatttttcctatcctgttgttttgctgtcagaatggaactagtacaaaattcttgcatctgggctcctgttacttggttttcatatttgtgacgatcttatttgctacggtagtcat

SEQ ID NO: 1387 - DNA, 1234 bp, Leymus cinereus x Leymus triticoides
  misc_feature (56)..(56): n is a, c, g, or t
  misc_feature (269)..(270): n is a, c, g, or t
  misc_feature (1129)..(1129): n is a, c, g, or t
  misc_feature (1143)..(1143): n is a, c, g, or t
  misc_feature (1157)..(1157): n is a, c, g, or t
ccttcctcctctcccttcgttttctgctcctcccctgcaacaaatcttggtcgctncgccgccggcacaagcgatcggagcagcggcccgtcggcagcgatgggggaccacgaggcgcgcggggacgacacggagaggaaggcggacaagaagctctccggctgggggctcttcggctccaagtacgaggacgccgccgacctatacgataaggccgccaactttttcaagctcgcaaagaactggaacagagctgcatctgtgtacannaagattgctaattgccatctgaagggtgatagtaagcatgaagctgcctcagcttatgtggaagctgcaaactgctacaaaaaattctcacctcaggaagctgcgcaagcgctagaccaggctgttaatctttttctggaaattggtagattgagcatggctgcaagatactgcaaggacattggtgagatttatcagcaagaacaagatttggagaaggcttcagattacctagaaagggccgctgatcttttcgacagtgaaggacagacatctcaatcaaacaccatcaagcagaaagttgcagaaattgctgcgcagttggaacagtacccaaaggcaacggagatttttgaagaaattgctcgtcaatcaattaacaacaatctgctgaagtatagtgtcagaggcatcctccttaatgcaggcatctgccaactatgtagagctgatgctgttgctatacaaaattcgttggagagataccaggaaattgatccgactttctcaggaactcgtgaatacaaacttttagctgatcttgctgcatcaatggacgacggagatgttgccaaatttactgatgccatcaaggaatttgatggcatgacacgcctggatccttggaaaacgacactgctgctgagggcaaagaatgagctgaagaaacaagaggatgatgaggatgatctaacctaagccttgttataaaaattctttcatgcttcaacatggtgtgatttatgcctctttcatctgggaggtacatataatgggcataatgaagatccaccttttggttgtaacttcattttgaagtaccatatcgggtgtcatgtgtcatttgttcttgtcatgncttgttttccgtcngaatgaaaataccntagtacgcttgttgctggtatccttctgtaacatgttctatttcaccgtcattcaggacctttgtttactactgtta

SEQ ID NO: 1388 - DNA, 1285 bp, Triticum aestivum
cgcgtttcctttttttgtttgcggggtcgcgtgctgcgtttccgatccccttcctcctctcccttcgttttctgctcctcccccgcaacaaatcttggtcgcttcgccgccggcacaagcgatcggagcagcggcccgtcggcagcgatgggggaccacgaggcgcgcggtgacgacacggagaggaaggcggataagaagctctccggctgggggctcttcggctccaagtacgaggacgccgccgacctatacgataaggccgccaactttttcaagctttcgaagaactggaacagagctgcatctgtgtatatcaagattgctaattgccatctgaagggtgatagtaagcatgaagctgcctcagcttatgtggaagctgcaaactgctacaaaaaattctcacctcaggaagctgcgcaagcgctagaccaggctgttaatctttttctggaaattggtagattgagcatggctgcaagatactgcaaggacattggtgagatttatcagcaagaacaagatttggagaaggcttcagattacctagaaagggccgctgatcttttcgacagtgaaggacagacatctcaatcaaacaccattaagcagaaagttgcagaaattgctgcgcagttggaacagtacccaaaggcaactgagatttttgaagaaattgctcgtcaatcaattaacaacaatctgctgaagtatagtgtcagaggcatcctccttaatgcagggatctgccaactatgtagagctgatgctgttgctatacaaaattcattggagagataccaggaaatcgatccgactttctcaggaactcgtgaatacaaacttttagctgatcttgctgcatcaatggacgacggagatgttgccaaatttactgatgccatcaaggaatttgacggcatgacacgcctggatccttggaaaacgacactgctgctgagggcaaagaatgagctgaagaagcaagaggacgatgaggatgatctaacctaagccttattgtaaaaattctttcatgcttcaacatggtgtgatttatgcctctatttcgtcttggaggtacatataatgggcataatgaagatccaccttttggttgtatagaacttcattttgaagtaccatatcgggtgtcgtgtgtcatttgttcttgtcatgacttggttttccgtccgaatgaaaataccatagcacgctgttgctgctatccttctgtaacatgttctatttcaccctcattaatgactttgctattttccaa

SEQ ID NO: 1389 - DNA, 1274 bp, Triticum aestivum
tttttttgtttgcggggtcgcgtgctgcgtttccgatccccttcctcctctcccttcgttttctgctcctcccccgcaacaaatcttggtcgcttcgccgccggcacaagcgatcggagcagcggcccgtcggcagcgatgggggaccacgaggcgcgcggtgacgacacggagaggaaggcggataagaagctctccggctgggggctcttcggctccaagtacgaggacgccgccgacctatacgataaggccgccaactttttcaagctttcgaagaactggaacagagctgcatctgtgtatatcaagattgctaattgccatctgaagggtgatagtaagcatgaagctgcctcagcttatgtggaagctgcaaactgctacaaaaaattctcacctcaggaagctgcgcaagcgctagaccaggctgttaatctttttctggaaattggtagattgagcatggctgcaagatactgcaaggacattggtgagatttatcagcaagaacaagatttggagaaggcttcagattacctagaaagggccgctgatcttttcgacagtgaaggacagacatctcaatcaaacaccattaagcagaaagttgcagaaattgctgcgcagttggaacagtacccaaaggcaactgagatttttgaagaaattgctcgtcaatcaattaacaacaatctgctgaagtatagtgtcagaggcatcctccttaatgcagggatctgccaactatgtagagctgatgctgttgctatacaaaattcattggagagataccaggaaatcgatccgactttctcaggaactcgtgaatacaaacttttagctgatcttgctgcatcaatggacgacggagatgttgccaaatttactgatgccatcaaggaatttgacggcatgacacgcctggatccttggaaaacgacactgctgctgagggcaaagaatgagctgaagaagcaagaggacgatgaggatgatctaacctaagccttattgtaaaaattctttcatgcttcaacatggtgtgatttatgcctctatttcgtcttggaggtacatataatgggcataatgaagatccaccttttggttgtatagaacttcattttgaagtaccatatcgggtgtcgtgtgtcatttgttcttgtcatgacttggttttccgtccgaatgaaaataccatagcacgctgttgctggtatccttctgtaacatgttctatttcaccctcattaatgactttgctattttcc

SEQ ID NO: 1390 - DNA, 1280 bp, Hordeum vulgare
ctcttacattgctctttttgtttgcggggtcgcgtgctgcgtttccgttccccttcctcttctcctttcgttttctgctcctcccccgcaacaaatcttggtcgcttcgccgccggcacaagcggccggagcagcagccagtcggcagcgatgggggaccacgaggcgcgcggggacgacacggagaggaaggcggacaagaagctctccggctgggggctcttcggctccaagtacgaggacgccgccgacctatatgataaggccgccaactttttcaagctctcaaaaaactggaacagagctgcatctgtgtacatcaagattgctaattgccatctgaagggcgatagtaagcatgaagctgcctcagcttatgtggaagctgcaaactgctacaaaaaattctcacctcaggaagctgcgcaagcgctagacgaggctgttaatctttttttggaaattggtagattgagcatggctgcaagatactgcaaggacattggtgagatttatcagcacgaacaagatttggagaaggcttcagattacctagaaagggccgcagatcttttcgacagtgaaggacagacatctcaatcaaacaccatcaagcagaaagttgcagaaattgctgcgcagttggaacactacccaaaggcaacggagatttttgaagatattgctcgtcaatcaattaacaacaatctgctgaagtatagtgtcagaggcatcctccttaatgctggcatctgccaactatgtagagctgataccgttgctatacaaaattcgttggagagataccaggaaattgatccgactttctcaggaactcgcgaatacaaacttttagctgatcttgctgcatcaatggacgacggagatgttgccaaatttactgatgccatcaaggaatttgacggcatgacacgcctggatccttggaaaacgacactgctgctgagggcaaagaatgaactgaagaaacaagaggatgatgaggatgatctaacctaagccttgtaaaaattctttcatgcttcaacatggtgtgatttatacatttgtatgcctctatttcatcttggaggtacatataatgggcataatgaagatccaccttttggttgtatagaacttcattttgaagtagcatatggggtgtcatgtgtcatttgtttgtcatgaattggttttccttccgaatgatatgcttattgcttgtatccttctgtaacatgttctatttgaccgtcattcagggcctttgtttgcta

SEQ ID NO: 1391 - DNA, 1254 bp, Hordeum vulgare
ctcttacattgctctttttgtttgcggggtcgcgtgctgcgtttccgttccccttcctcttctcctttcgttttctgctcctcccccgcaacaaatcttggtcgcttcgccgccggcacaagcggccggagcagcagccagtcggcagcgatgggggaccacgaggcgcgcggggacgacacggagaggaaggcggacaagaagctctccggctgggggctcttcggctccaagtacgaggacgccgccgacctatatgataaggccgccaactttttcaagctctcaaaaaactggaacagagctgcatctgtgtacatcaagattgctaattgccatctgaagggcgatagtaagcatgaagctgcctcagcttatgtggaagctgcaaactgctacaaaaaattctcacctcaggaagctgcgcaagcgctagacgaggctgttaatctttttttggaaattggtagattgagcatggctgcaagatactgcaaggacattggtgagatttatcagcacgaacaagatttggagaaggcttcagattacctagaaagggccgcagatcttttcgacagtgaaggacagacatctcaatcaaacaccatcaagcagaaagttgcagaaattgctgcgcagttggaacactacccaaaggcaacggagatttttgaagatattgctcgtcaatcaattaacaacaatctgctgaagtatagtgtcagaggcatcctccttaatgctggcatctgccaactatgtagagctgataccgttgctatacaaaattcgttggagagataccaggaaattgatccgactttctcaggaactcgcgaatacaaacttttagctgatcttgctgcatcaatggacgacggagatgttgccaaatttactgatgccatcaaggaatttgacggcatgacacgcctggatccttggaaaacgacactgctgctgagggcaaagaatgaactgaagaaacaagaggatgatgaggatgatctaacctaagccttgtaaaaattctttcatgcttcaacatggtgtgatttatacatttgtatgcctctatttcatcttggaggtacatataatgggcataatgaagatccaccttttggttgtatagaacttcattttgaagtagcatatggggtgtcatgtgtcatttgtttgtcatgacttggttttccttccgaatgatatgcttattgcttgtatccttctgtaacatgttctatttga

SEQ ID NO: 1392 - DNA, 1268 bp, Brachypodium distachyon
gagaaacgcagacatccgcgtgcgcgtgttcccgttccccttcctctctccctttggcttcctgctcctccccgcaacaaatcttggtcgcctcgccggcggcacaagcgacctccccggcggcagcgatgggggaccacgaggctcgcggggacgacatggagaagaaggcggagaagaagctctccggctggggactcttcagctccaagtacgaggacgccgccgacctctacgacaaggccgccaacttcttcaagctctcaaagaactggaatagagctgcatccgtgtacaccaagattgctaactgtcatatgaagggtgatagcaagcatgaagctgcctcagcttatgtggaggctgcaaattgttacaaaaagttctcacctcaagaagctgcgcaagcgttagaccaggctgttaatctttttttggaaatcggtagactgaacatggctgcaagatactgcaaggacattggtgagatatatcagcaagaacaagatttagagaaggcttcagattatatggaaagggctgccgatctttttgacagtgaggggcagacatctcaatcaaacaccatcaagcagaaagttgcagaaattgcagctcagttggaacagtacccaaaggcaactgagatttttgaagcaattgctcgtcaatcaatcaataacaatcttctgaagtatagtgtcagaggcatcctccttaatgcaggcatttgccaactttgtagagctgatcctgttgctatacaaaattcattagagcgataccaggaaattgatccgactttctcaggaactcgtgaatacaaacttttagctgatcttgctgcatcaatggacgagggagatgttaccaaatttactgatgccatcaaggactttgatggcatgacacgtctggatccttggaaaacgacactgctgctgagggcaaagaatgagctgaagaaacaggaggaggatgaggatgacctaacctaagcctagttgtaagaatcgtttcattattcaatatggtttgatttatgcctctgtttatgttggaggtccatataatgggcatgatgagattgaccgtttggttgtatagaatttcagttccaaataccatgttggctgtcatgtattgtgttctgtcaccacttagtttgccgtccgaaagcaaattaagaccatacgcttgttgctggtatccttgtgtatcatgtactgtttcagtccttcgagaattgagactttctttgtttcaat

SEQ ID NO: 1393 - DNA, 1265 bp, Oryza sativa
cacaacctcctctcctcttctcgccttctccgcttctcccttcccatctgctgctcgcgaatctcctcgtcgtcgtcgtcgtcgtcgtcgtctcctcgccgccgggagaagcgcagggcggagcgcggaggcggaggcgatgggggaccacgaggcccgcggggatgacttcgagaagaaggcggagaagaagctctccgggtgggggatcttcggctccaagtacgaggacgccgccgacctcttcgacaagggggccaactccttcaagctcgccaagaactggagcagagctgcacaagtgtacatcaagattgctaactgccatttgaagggtgacagtaagcatgaagctgcctcagcttatgtcgaggcggcaaattgctataaaaagttctctcctcaagaggctgcacaagcgctaaaccaggctgttgatcttttcttggaaattggtagattgaacatggctgcaagatattgtaaggacattggtgagatatatcatcaagaacaagatttagagaaggcttcagattacctggaaaaatcggctgatctttttgacagtgaggggcaatcatctcaatcaaacagtatcaagcagaaagttgcagaaattgctgctcagttggaacaataccagaaggcaaatgagatatttgaagcaattgctcgccaacaaatcaacaataatcttcttaagtacagtgtcagaggtattctcctcaacgcaggcatttgtcagctatgcagaggtgatgttgttgctatcacaaattcaatggagcgatatcaggatattgacccaacattctcggggacacgagaatacaagcttttatctgatcttgctgcagctatggaggaaggagatgttgccaagttcactgatgccattaaggaatttgacagcatgacacgtctggacccctggaaaacaaccctcctcctcagggcaaagaatgagctgaagaaaaaggaggatgacgaggatgatctaacctaagttttgttgtaaagctcgtttcatgcttaatatggttgcctcctttgcattctggaggctccatgttccatatgatgagcatgagagctgtcgtttgccctgttgtatagaactccttccagctatcatattggatgtttggttgccctggttcttttctggccaccacctgatttgccgtcagtgtttaaactagtaccctacgtgtgttgctgataccttatattataacatgtttgtttcacctgctttcgtc

SEQ ID NO: 1394 - DNA, 1319 bp, Avena sativa
ggcgtgctacgtttcccttccccttctcccttcgcgtttttttctcctcccagcaacaaatcttgggcgcctcgccgggcaccttcccggcggcagcgatgggggaccacgaggcgcgcggggacgacatggagaagaaggccgagaagaagatctccggctgggggatattcggctccaagtacgaggacgccgccgacctctacgacaaggccgccaactttttcaagctctccaagaactggaacagagctgcatccgtgtacatcaagattgctaactgccatttgaagggtgacagcaagcatgaagctgcatcagcttatgtggaggctgcaaattgctacaaaaagttttcacctcaggaagctgcgcaagcgctagatcaggctgttaatttatttatggaaattggtagattgagcatggctgcaagatactgcaaggacattggtgagatatatcagcaagaacaagatttggagaaggcttcagattacctggaaagggcagctgacctttttgacagtgaggggcagacatctcaatcaaacaccatcaagcagaaagttgcagaaattgctgctcagttggaacagtacccaaaggcaactgagatttttgaagcaattgctcgtcaatcaatcaacaacaatcttctgaagtatagtgtcagaggcattctccttaatgcaggcatctgccagctatgtagagctgaacctgttgctatacaaaattcattggagcgataccaggaaattgatccgactttctcaggaactcgtgaatacaaacttttaactgatcttgctgcatcaatggatgatggagatgttgccaagtttactgatgccatcaaggattttgatggcatgacacgtctggatccttggaaaacaacactgctgctcagggcaaagaatgagctgaagaaacaggaggaggatgaggacgatctaacctaagccttgttgtaaaaatcgtttcaggccacaatatgctttggtttgtgcatcaatttgatcatggaggtctatataatggacataatgagattgaccgtttggttgtatagaactccattttcaactaccaggttgggttcatgtgttctggtgaccactttgctgttcgaatgcaaattaaaattccattcgcttgttgctggtatcattttgtgtaagatgttttatgccgtcgccctacaagacctattcttgcttttagtttctgattgtactgttacaccgctctatgatcgagcttgtatactataatcaccggtgctgatgttgtaacatcagtatttcaagaga

SEQ ID NO: 1395 - DNA, 1313 bp, Avena sativa
cgtttcccttccccttcatctcccttcgcgtttttttctcctcccagcaacaaatcttgggcgcctcgccgggcaccttcccggcggcagcgatgggggaccacgaggcgcgcggggacgacatggagaagaaggccgagaagaagatctccggctgggggatattcggctccaagtacgaggacgccgccgacctctacgacaaggccgccaactttttcaagctctccaagaactggaacagagctgcatccgtgtacatcaagattgctaactgccatttgaagggtgacagcaagcatgaagctgcatcagcttatgtggaggctgcaaattgctacaaaaagttttcacctcaggaagctgcgcaagcgctagatcaggctgttaatttatttatggaaattggtagattgagcatggctgcaagatactgcaaggacattggtgagatatatcagcaagaacaagatttggagaaggcttcagattacctggaaagggcagctgacctttttgacagtgaggggcagacatctcaatcaaacaccatcaagcagaaagttgcagaaattgctgctcagttggaacagtacccaaaggcaactgagatttttgaagcaattgctcgtcaatcaatcaacaacaatcttctgaagtatagtgtcagaggcattctccttaatgcaggcatctgccagctatgtagagctgaacctgttgctatacaaaattcattggagcgataccaggaaattgatccgactttctcaggaactcgtgaatacaaacttttaactgatcttgctgcatcaatggatgatggagatgttgccaagtttactgatgccatcaaggattttgatggcatgacacgtctggatccttggaaaacaacactgctgctcagggcaaagaatgagctgaagaaacaggaggaggatgaggacgatctaacctaagccttgttgtaaaaatcgtttcaggccacaatatgctttggtttgtgcatcaatttgatcatggaggtctatataatggacataatgagattgaccgtttggttgtatagaactccattttcaactaccaggttgggttcatgtgttctggtgaccactttgctgttcgaatgcaaattaaaattccattcgcttgttgctggtatcattttgtgtaagatgttttatgccgtcgccctacaagacctattcttgcttttagtttctgattgtactgttacaccgctctatgatcgagcttgtatactataatcaccggtgctgatgttgtaacatcagtatttcaagaga

SEQ ID NO: 1396 - DNA, 500 bp, Triticum aestivum
gatcgcatccgcctctccacacgcatctccctctccaccttgccagcatccgcgcgcgcgcgcatctctccacgccatggacgggtcggcgttcctgtcgctgtcgccggagctccgcgacgcgctcgccaaggtggccgtgttcgtgctcgtccaggggctggtctacctcatcctccgcagctcctccgacgtcttctccaaggacggcggcgggctcaggtccctcagcttccgccccatgcgctccatgagcgtcaggcgcgtgctggctccgctctctgacgtccccgtcggcaccgacgagccctcgccttcgccgtcgtggtccatgtcgcccgccgcgtcgtcgtcgcgccgcagggctgcccgcgaggattgaaatggccgcaacttctgggtctgggcaccttggaatcggaggtagtttatttggtcgttctggattgtaattggtttgttattgtggatggaaatggtatttgagttcctatatgtaa

SEQ ID NO: 1397 - DNA, 586 bp, Saccharum officinarum
gcgccaccatcatctcacggatcacatacacccatacgccgcgcggcgcatccacgcgcatctccctctccaccttgccagcatctctccgcgccatggacgggtcggcgttcctatcactgtcgccggagctccgcgacgcgctcgccaaggtggccgtgttcgtgctcgtccagaggctggtctacctcatcctccgcagctcctccgacgtcttctccaaggacggcgggcggctcaggtccctcagcttccgccccatgcgctccatgagcgtcaggcgcgtgctggcgccgctctccgacgtccccgtcggcaccgacgagccctcgccttcgccgtcgtcgtcgatgtcgcccgccggagggctgcccgcgaggattgaaatggccgcaacttctgggtctgggcaccttggaggtagtttatgtggtccttctggattgtaattggtctgttattgtggatggaaatggtactccatttgagttcctatgatatctgtaagtagtagaatggatataatcttgttaaatataccgattggaggcagattgggaaagaaatggcataatttgattcttct

SEQ ID NO: 1398 - DNA, 743 bp, Zea mays
cccgccatcatctcatcgatcacacacacccatacgccgcgaatccacacgcatctccctctccagtctccagttctccaccttgccagcgtctctccacgtacgccatggacgggtcggcgttcccgtcgctgtcgccggagctccgcgacgcgctcgccaaggtggccgtgttcgtactcgtccaggggctggtctacctcatcctccgcagctcctccgacgtcttctccaaggacggccggctcaggtccctcagcttccgccccatgcgctccatgagcgtcaggcgcgtgctggcgccgctctccgacgtccccgtcggcaccgacgacgcctctccatcgttgtcgcccgccgcgacgtcgtcgcaccgcaaagctgcccgcgaggattgaaatggccgccacttctgggcagcttgcagttgcaggttgttcatctggtccttatgggttataaatgggtctgttactatgtaagtaggtagtactagaatggatggaatcttgtagacatattggttgagcagaattggaaacactggattatttgattctttacagcaacatgcttgctctttctttcttcctgtgaatatacaccactacttgtagcctcttgctggaaacgagtcagaagagaaattaaattgccagactggatagacttcagcggctatgatatgacagggacgtgaaaagtttagcttattgaccattgcaactttttattgtcacgca

SEQ ID NO: 1399 - DNA, 744 bp, Zea mays
cccgccatcatctcatcgatcacacacacccatacgccgcgaatccacacgcatctccctctccagtctccagttctccaccttgccagcgtctctccacgtacgccatggacgggtcggcgttcccgtcgctgtcgccggagctccgcgacgcgctcgccaaggtggccgtgttcgtactcgtccaggggctggtctacctcatcctccgcagctcctccgacgtcttctccaaggacggccggctcaggtccctcagcttccgccccatgcgctccatgagcgtcaggcgcgtgctggcgccgctctccgacgtccccgtcggcaccgacgacgcctctccatcgttgtcgcccgccgcgacgtcgtcgcaccgcaaagctgcccgcgaggattgaaatggccgccacttctgggcagcttgcagttgcaggttgttcatctggtccttatgggttataaatgggtctgttactatgtaattaagtagtactatattggatggaatcttgtagacatattggttgagcagaattggaaacactggattatttgattctttacagcaacatgcttgccctttctttcttcctgtgaatatacacgcactacttgtagcctcttgctggaaacgagtcagaagagaaattaaattgccagactggatagacttcagcggctatgatatgacagggacgtgaaaagtttagcttattgaccattgcaactttatattgtcacgca

SEQ ID NO: 1400 - DNA, 827 bp, Pennisetum glaucum
ctccggtgtaagtcgatcgatcggtagtgctagctagctgcatgacagaagagagggagcatgcttagataggtttatccgatcggaggtgattccgtgacgggttcgctgctgggtggctccggccgttctggccgccactacacgagcacaaaccgtgacatctcggcatcacacaagcatcccacacgcatctccctctccatcccattgccatccagccacagcatcctctcgaattctcgattcccccgtctcgccgccgccgatcgaccggccggttgtagccatggacgccgccgccgccgccttcctgtcgctctcgccggagctccgcgacgcgctcgtcaaggtcgccgtgttcgtgctcgtccaggggctggtctacctcatcctccgcagctcgtccgacgtcttctccaaggacggcaggctcaggtccctcagcttccggcccatgcggtccatgagcgtcaggcgcgtgctcgcgccgctctccgacgtgcccgtcggcaccgatgagccctcggcgtcgacgtcgccgtcgctgtcctccgcggtgtcgcgccgcagggcaagccgtgaggattgagatgcccggagcgggtacggtgccggtggtcgacctgaccggcaagctaggtagtttggtcactcggaattgtaatttgtttgttatacggttgatgaaaatattatttgagtttgtaaggggaatagatgtgatcttgtagatatattgattaaaacaagaattggaggagtggattatttgattctttacaaacacgtttgttgtttcttcttgtgaatacacactacttgtg

SEQ ID NO: 1401 - DNA, 720 bp, Cenchrus ciliaris
  misc_feature (319)..(319): n is a, c, g, or t
tcggcatcatacgcgcatccacacgcatctccgtccattccaattgccagcgccagcatcctctcgattcccctctcgccgccgatcgaccggccggtagccatggacgccgccaccttcctgtcgctctcgccggagctccgcgacgcgctcgtcaaggtcgccgtgttcgtgctcgttcaggggctggtctacctcatcctccgcagctcgtccgacgtcttctccaaggacggcaggctcaggtccctcagcttccggccgatgcggtccatgagcgtcaggcgcgtgctggcgccgctctccgacgtgcccgtcngcaccgatgagccctcgccgtcgccgtcgccgtcgtccgcggcgtcgcgccgcagggccagccgtgaggattgagctactagacgccctgagcggatggcgcatctcccggcaagctaggtagtctggtcattcggaattgtaatttgtttgttatacggttgatgagaatagtacttgagactttaaattttaatgtaatgtaatgtaaggcgattagatgtgatcttgtagatatattgattaaaaagaattggaggagtggattatttgattctttacaacacgtttgctgtttcttcttgtgagtacttcctccgtcccagaatataaggacttgttgacttttgctgatcacgtttgaccactcgtcttattcaaaaaatttatgaaaatattata

SEQ ID NO: 1402 - DNA, 2676 bp, Arabidopsis lyrata
atgaacgctttttccctccatttactcataccgacgcctgttcatctcaaatcctcacgtgccgcttcaccattcttttcacgcgcctcctcactgtcttctttacgctttgcttctccgttaattctacgcgccgcctcctcagacgactcacagtcagtcgaaaaccaaactctagaggtcctcgaatggcgtgctctctgcaatcagctcgctccattcgcctccacatccatgggactttccgccaccaaaaacgccgaaattccggtgggaaattcgccggaagagagcaggaatctccttgacgagacggcggctgcgttagcagctatggagatgatggaatcacagcgattaggtctttctgagatccaagacttgtctgatatcgttgagcgtgctgttgccggtcaattgcttaccgttagagagctctgctctgttcgaagcacgttaatggcggctacatcagtgtttcagaaactccgaaaagcagccattagtgataagagggttagtccactcgtaggtttagttcagggttgtgatttcaaggatacattgcagcagaagattggattttgtatcgactgcaacatgtctatgattcttgatagagctagtgaagatttggagattataagatctgaacggaggagaaacatggagaaattggattctcttttgaagaaaatatcaactcagatttttcaggctggggggattgataggcctttgataacgcagcggagatcaaggatgtgtgtagctattagagcgacgcacaaaagtttacttccaggtggtgttgttttaagtgttagtagctcaagggcaacgtgctatatagaaccgaaagaggcagtggagcttaataacatggaagtgaggcatgcaaactctgagaaagctgaggaaatggcaattttgagcattttaacatctgaagtgtcaatggcgcagaaggatatattgcatttgttggatagaatactagaacttgacattgcttttgcaagagcatcacatgcaaaatggatgaatggtgtctatcccaacgtaacttcagaacacactaaaacaccgggcttgggtggagaccataaatcattatctgtagacattgattctgcgcagcacccgctacttcttggttcagtattaggcagcccaaatgatggaatggtttttcctgtgccaatagacattaaagttgaaagcagagccaaagtagtcgtcatctcgggtccaaacacaggaggaaagactgctttattaaagacattgggattaatatctcttatgtccaagtcggggatgtatttgcctgctaagaattgcccaaggttgccttggtttgattttattctggcagatatcggggatccgcagtccttggagcaaagtctctcaacctttagtggccacatctcacggatacgtcagatacttgacattgcttcagaaaattcgcttgtcctactagacgaaatttgtagtggaactgatccttcagaaggggttgcacttgctactagtatcctacaatatattaaaaaccgtgttaatgtggctgttgtgtcaacacattacggtgacttaagtcgcctgaaggataatgagcctcaattccaaaatgctgcaatggagttctccatggaaactttgcagcctacattccgagtactctggggaagtactggtctatcaaatgcattgacagtagctaagtccattggtttcaatacaggaatattagagaatgcacataaatggacagagaaattaaatccggagcaggatgtagagcggaaaggctcactctttcagtcccttgtggaagaaagaaataagctaaagcttcaggcatctaagactgaagcttttcatagagacttaatgaacctttaccacgagcttgagcatgagtcgcatgatcttgaaaaacgtgagagggctcttctgaagaaagaaacccaaaaggtacaagaagatctaaactctgctaagtcgaaaatgcagaaactggtggctgaattcaaaagtcaactagaaatcgctcaagctgatcaatacaattccttaattctgaaaaccgaagaggcagttgcagagattattgaagcttgctgtcctatcgatcttgattccattgaagaaccgtacagtgactactcgccacaagcaggtgaaaaagttcttgtaactggacttggagataagttaggtactgttgttgaagaacctggagatgatgagacagttctagtccagcatggtaagataagagtacgtataaagaaaaaggacataaagccccttcctcgtagcacaagtagccaaacatccaatcgttctctacgttcaaagagacaggtaaacatgaaagatctaggcagtgtgttgcagatgcagcagagcgaaccagtgcggattcaaacgtcaaagaacaccttggatctcagaggaatgcgggcggaagaagcggttcaccagctagacatggccatctcgggaagagactctggctcgatcctctttatcattcatggaatggggacaggcgttataaaggagttagtgcttgagaggttaagaaagcacactcgtgtctcaaggtatgaacaggcaaatcctatgaactatggatgtacagttgcttacattaaatga

SEQ ID NO: 1403 - DNA, 2061 bp, Solanum phureja
aaaaccaaccattgaattccaagaatgtagatatacataacaacacaaaacacacacaaaaaaaaaaacattagtaattttttttcatttttcactaatggcaagtgctactacatcatcaacacataaatttcaagaatatgatgatgatgaagttaccagttacaaaaacaagaattgtgaagttgttgttaatagacaagaaattaaaggtgcaattgctaaagcaattgaattaagagctttacatgctacccttttacaacaacaacaacaacaagggaatagtcctattaaaaaattcccttcttctgcttctccaactgtttcacttcattctcaccatttttcttctcaagattatcctattttcacaccaagctatgaagatgaaccattgccaggatacaaacaactacacttagatcacaatccaaactatgctgaactttgggatgaatatggatttggaggagtaggaaatggtaacaatgaatctgttttatcggattacaggaaggcgaattcgaccttaaaaaatggatttacgaatagtctgatcaacttagaaccccacatttgtccggctgatgatcagagatcggtcacgagctcgtgtactgatcaagtcactacgcgtaaagcttctcccatcgctcgttacatcaagtctcggagaaactcgttaggggacttgaactcgatttcatcttgcaataagtgtaagcctgcaacaattagtactgaggttgatggtggtggtagtagtacaagtaagagtgggaagaactcgaatgtcatcgtgccattgacggattcacatgtttctgttcaatcgcagccaaagagtaaaggcggaatgaacttgtcgtggctgttccctaagctaaagaagaaaaacaaggttgaaaattcaccaaaccgaacagatcaatccgatgaggtttctcaggtcttaaaggatcatatagggatggtttcaatcgagacgttgaagaaagagctaatggaagcaaacgagagtagagatgcagcgttgattgaagtcttgggaatgaagtcgtctttaggtgagctaaagcaaaagttagagtacttagaaacttactgtgaagagctgaaaaaggccttgaggcaagcaattcaagctacagagtcccctgtatcctccaagcttagaaattttcctaaaaacggaaaatccatcgatggggacggagaaaatgtgatcccggttagtgatgaggtaatgctagaagggttcttacagatggtatcggagtcaagattatcggtgaaacagttctgcaagactctaataggacagattgaagaaacagacaatttgttaactgataacttgaaccttttgcttcaaccttacaagctatctctcaactcgaagtactcgaaagcagttctataccacattgaatccatcataaaccaatcacttttccaagactttgaaaactgtgtgttccaaaagaatggctcatcaaaacacttagaccctcaacatgatcgccacgctcagttctcatcatttgtcgcgttgaggaacctaagttggaatgaggtgttgaggaagggtacaaagtactatagcgaagagttcagtaagttctgtgatcagaaaatgagttgcattatcgcaacgcttaattggacaaggccatggcctgaacaactcctccaagcgttcttcgttgctgctaagtgcatttggttgctgcatttgttagccttttcgttcaatccttctctcgggattctacgagtggaagagaatagaactttcgatatgcattacatggaggacgttttcgcggatagacaaagatcacaaggtcctagcaaggttaaggtcatggttatgcctggtttttatgtgcatgatagagtacttaggtgtaaggtaatatgcaggtacaaaaatgtatcatagttaggttctcttttcaccactttttcccctttttcttctttagtaaactaacttgtaatagtgttttcttgttgattatttgatttgagtgagttctataaactagttgtcat

SEQ ID NO: 1404 - DNA, 1723 bp, Sorghum bicolor
cgagaaaaacgataacctcatacttcccttctcgctcggcaatggcggccgtagcggcggctccacggccgcagctctccccgctatctggcggcggtggcgccacaatctccagtctcaccctccaaacactggccttcatctcccccctccccacacgccgccgtcgccgctgtgtgctccgctccaacgcctcgtcgtccccgtctccgccgccgtcgcaggagaaggaggcagcggctgaggtggtgccaacagctgagtcctgcgtcaacctcggactccagctcttctccaagggcagggtgaaggatgctcttgaacaatttgagaatgccttagagctgaatccaacacctgttgaggcccaagcagcactgtataacaaggcatgctgccatgcatatagagaagaaagcaaaaaagctgcagaatgtttaagggaagctttgcgagactacaatctcaaatttggtaccatacttaacgatccagacttggcgccattcagagcatcaccggaattcaaggaacttcaagaagaggctttgcgtggtggagaagatattggttctggtttccgaagagacctgaaactcattagtgaagtacaagcaccatttcgtggtgtccgaagattcttctatgtagctttgacagccgcagctggaatttcaacattctttaccattccccgacttgtactagcagttcgagggggtgatggcgcccctgatcttctggaaactgctggaaatgctgccatcaatattggaggtatcgttgtgctagtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgttatattggcaggttcaaaagcatctgttactcgggcattgcaaagagccgagaggtaccggactgaactgcttaaacgaggcgttcttctaattcctgtgatctttggtgcttctcagaaagaccaaaccaaaccaaggggttttggtacaagaagagcagctgcatcagttccttccgttgggggtgacttcgaaaagcgtactgaatctattgcagcaaagtcacggttgaagtctgaggttcgatttaaggctgatattgtctcccctgaacaatgggaaagttggatacgggaccagcaagagtccgaaggtgtcactcctggtgaggatgtctacataatccttcgtctagatggccgtgtcagaagatctggaataggtatgccaaactggaatgacatattacaggaactgccacgacttgaagatctgatgagcaaacttgaacggtgaaaaagaatacaaacagtttactatgatggaccatgtggaagcgaggttgccaaggggtttcattatgctctcctgtttctggaactccagtgcagatgatatgcttttcacaaaacgtacttggagttgttagaactactatagcactcgatctattttgatgagagcatctatctctccacattacaaagttcacatttctctccacgtccatcaatttgtatatttcaattgcgcttgttggtcttgtgccggtgcaaatgcggcatatatacctgacacgtttattagaatcgattgtgttccatgaaatgaaaaatctaaggtct

SEQ ID NO: 1405 - DNA, 1832 bp, Brachypodium distachyon
gggaaccgcaaatccgcaatgtctgccgcgcccgcagccgcggtgcttcggccccacctctcccttctctccggcggcggcggcggcggaatccccagcggcacattccagactctatcctatgtctcaccccttctccaccaccgccgccgccgccgcggcggcgtcgtccttcggtccaacgcttcctcgtcgcttccttctccccgcccttctccggagaaggaggccgagaaggctccgacggcggagtcgtgcgtcaacctcggcctcgagctcttctccaagggcagggtgagggacgcacttgaacaatttgagaatgccctagagctggaaccaaatcctattgaagcccaagcagcactctataacaaagcatgctgccatgcgtacagggaagaaagcaaaaaagctgcagaatgcttgaggacagctttgcgagattacaatctcaaatttggtactgtacttaatgatccagacatggcaccgttcagagcatcaccagaatttaaggaacttcaagaggaggcattgcgcggtggagaagatatcggttctgggttccggagagatctgaagctcattagtgaagtacaagcaccgtttcgtggtgtccggaggttcttttatgtggcgttcattgcagcagctggaatttcaacattctttaccattcccagacttatacttgcagttcaaggtggtgatggtgctccagatttgcttcaaactgctgggaatgctgccattaatattggaggtattgttgtgctggtggctttgtttatctgggaaaacaggaaagaagagcagcagatcaccgtaatttctcgcaatgaaacgctttcaaggttacctgtgcgtctgtcaacaaatcgcattactgaacttgtgcaactccgggacattactaggccagttatattggcaggttcgaaagcatcagtaactaaagcaacgcaaagagctgagaggtaccgaactgaacttctcaaacgaggtgttcttctaattcctgttatctttggtgcttcggagaaagcccagaccaaacctaagggattcggtactacaagatctgctgcatcagtcccttcagttgggggtgattttgaaaagcgtactgaatctattgccgcaaaatcacggttgaaagctgaggttcgatttaaggctgacattgtctctcctgaccagtgggaaagttggataagagaccagcaagagtctgaaggtgtcactcctggtgaagatgtctacataatcctccgtcttgatggtcgcgtgagaagatctggaagaggtatgccgaattggaacgacattttacaggaactgccacggcttgaagatttgctgagcaaacttgaacgatgaaaaacaccgtaaaactgcagtttggcaatctgttaattattgcttgtgcctcagtttggcatgtcgtgaaggctggcggaccagcaaattgcacatcctgttaggttttgaaaatggaaacttttattgatctcgacggcatatcgatcgatacacataaagtatcacatcctgttacgtgagggtcagttgcagcttcttttagttttattcttaatttgcatacatcaagatgggaggccttgtctctgtgggaagtgttttttatatgccagagatgaagcgataccgtataggtatagcataaactgttaggagtattaacaaataaaagagttgttttccagtggtggcacggtatttcattgttatgtgatatactccggtactacatagctattgaatgcatcttaacgctatggttaacacatggcaattttgtgtggagc

SEQ ID NO: 1406 - DNA, 1616 bp, Hordeum vulgare
gggctgcaggcaattcggcacgaggctcaccatccctccgtactccatagtcgcaatggcggccgcggcactccgaacccacctttcccttctctcggccggcggcggaatccccaacccggcgctccaaactctatccttcgttgcccccctcctcctccgccgccgctgccgccgccgcagcagcgtcgttctctccaacgcgtcctcgtcgcccccgtctccccctccttcgccggagaaggcggtcgaggcggctccgacggcggagtcgtgcgtcaacctcggcctcgagttcttctccaagggcagggtgaaggacgcacttgaacaatttgacaaggccctagagctgaatccaaatcctaccgaagcccaagcagcgttctataacaaggcatgctgccatgcatacagggaagaaagcaaaaaagctgcagattgcttgagaatagctttgcgagattacaatctcaaatttggcacagtacttaatgatccagacatggcgccattcagggcatcaccagaatttaaggaacttcaagaggaggcattgcgtggtggagaagatattggttctggattccgaagagatctaaagcttattagtgaagtacaagcaccatttcgtggtgtccggaggttcttttatgtggcgttcattgcagcggctggaatttcaacattctttaccattcccagacttatacttgcacttcaaggtggtgatggtgctccagattttctggaaacggctgggaatgctgccattaatattggaggtattgttgtgctcgtggctttatttgtctgggaaaacaagaaagaagaagagcagattacaaatatctctcgtaatgaaaccctttcaaggttacctgtgcgtctgtcaaccaatcgcataactgaacttgtgcaactccgggacattactaggccagttatattggcaggttcaaaagcatctgttactcaagcaatgcaaagagctgagaggtaccgaactgaactgctcaaacgaggcgttcttctaattcctgtgatctttggtgcttcacaaaaagtccaaggcaaaccaaaaggcttcggtactacaagatctgctgcatcagctccttcaattgggggcgactttgaaaaacgtactgaatctattgcggcaaaatcacgactcagagccgaggttcgatttaaagccgatattgtctctccagaacaatgggaaagttggatacgtgatcagcaagaatcggaaggtgtcactcctggtgaagatgtctacataattctccgtcttgatggtcgtgtgagaagatccggaagaggcatgccaaactggaatgatattttgaaggaattgccacgtcttgaagatttgctcagcaaacttgaacgatgaaaactatgtgtatatgggtttcgttttcttccccacgccctttatctttgtgaaggccgagccactatttcgttgcacagagattgaccatcatgttgagtgatatttcgatgtagctttttttcagttcttatgcaaaaacagaggtgaaggtcttatttctctaagaagtgaggtctttgtgtgcgagataagatgtacacaacattttaaa

SEQ ID NO: 1407 - DNA, 1772 bp, Triticum aestivum
cctcaccattcctccgtactggcaatggcggccgcgcccgcagccgcggcactccgaccccacctttcccttctctcggccggcggcggaatccccaaccccacgctccaaactctatccttcgtcgcccccctcctcctccgccgccgctgccgccgctgccgccgccgcagcagcgtcgttctctccaacgcctcctcgtcgcccccgtccccccctccttcgccggagaaggaggccgaggcggctccgacggcggagtcgtgcgtcaacctcggcctcgagttcttctccaagggcagagtgagggatgcacttgaacaatttgacaatgccctagagctgaatccaaatcctaccgaagcccaagcagcgttctataacaaggcatgctgccatgcgtacagggaagaaagcaaaaaagctgcagagtgcttgagaatagctttgcgagattacaatctcaaatttggtacagtacttaatgatccagacatggcgccattcagggcatcgccagaatttaaggaacttcaagaagaggcattgcgtggtggagaagatattggttctgggttccgaagagatctaaagctcattagtgaagtacaggcaccatttcgtggtgtccggaggttcttttatgtggcgttcattgcagcagctggaatttcaacattcttcaccattcccagacttatatttgcacttcaaggtggtgatggtgctccagattttctggaaacggctggcaatgctgccattaatattggaggtattgtcgtgctcgtggctttgtttttctgggaaaacaagaaagaagaagagcagattacaaatatctctcgtaatgaaaccctttcaaggttacctgtgcgtctgtcaaccaatcgcataactgaacttgtgcaactccgggacatttctaggccagttatattggcaggttcaaaggcatctgttactcaagcaatgcaaagagctgagaggtaccgaactgatctgctcaaacgaggcgttcttctaattcctgtgatctttggtgcttcactaaaagtccaaggcaaaccaaaaggcttcggtactacaagatctgctgcatcagctccttcaattgggggtgactttgaaaaacgtactgaatctattgcggcaaaatcacgactcagagctgaggttcgatttaaagctgatattgtctctccagaacaatgggaaagttggatacgtgaccagcaagaatctgaaggtgtcactcctggtgaagatgtctacataattctccgtcttgatggtcgtgtgagaagatctggaagaggcatgccaaactggaacgacattttgaaggaattgccacgtcttgaagatttgctcagcaaacttgaacgatgaaaaagacgtgtatacgggtgtagttttcttcttcatgccctttatctttgtgaagaccggaacactatttcgttgcacagggattgaacatcctgtttcgtaagatttcaatgtagcttcttttcagttctccttgctatgcgaaaaccaaggtggatgccttatttctctataagaagtgaggtccttgtgtgccagataagaacatgtacacaagattgtaattacagcagaggatatattaacaaaccaagaattggctctgttttttttgttgttgtaaaagacgaaaggtcccaagcaaaaatacaaaggtgaacatggttatccaaaagttctgaaaaaaaaaaaaactcgagactagttctctctctctctca

SEQ ID NO: 1408 - DNA, 1773 bp, Triticum aestivum
  misc_feature (423)..(423): n is a, c, g, or t
  misc_feature (1733)..(1733): n is a, c, g, or t
  misc_feature (1740)..(1740): n is a, c, g, or t
cctcaccattcctccgtactggcaatggcggccgcgcccgcagccgcggcactccgaccccacctttcccttctctcggccggcgccggaatccccaaccccacgctccaaactctatccttcgtcgcccccctcctctgccgccgccgctgccgccgccgcagcagcgtcgttctctccaacgcctcctcgtcgcccccgtccccccctccttcgccggagaaggaggccgaggcggctccgacggcggagtcgtgcgtcaacctcggcctcgagttcttctccaagggcagagtgagggatgcacttgaacaatttgacaatgccctagagctgaatccaaatcctaccgaagcccaagcagcgttctataacaaggcatgctgccatgcgtacagggaagaaagcaaaaaagctgcagantgcttgagaatagctttgcgagattacaatctcaaatttggtacagtacttaatgatccagacatggcgccattcagggcatcaccagaatttaaggaacttcaagaagaggcattacgtggtggagaagatattggttctgggttccgaagagatctaaagctcattagtgaagtacaggcaccatttcgtggtgtccggaggttcttttatgtggcgttcattgcagcagctggaatttcaacattctttaccattcccagacttatatttgcacttcaaggtggtgatggtgctccagattttctggaaacggctggcaatgctgccattaatattggaggtattgtcgtgctcgtggctttatttttctgggaaaacaagaaagaagaagagcagattacaaatatctctcgtaatgaaaccctttcaaggttacctgtgcgtctgtcaaccaatcgcataactgaacttgtgcaactccgggacatttctaggccagttatattggcaggttcaaaggcatctgttactcaagcaatgcaaagagctgagaggtaccgaactgatctgctcaaacgaggcgttcttctaattcctgtgatctttggtgcttcactaaaagtccaaggcaaaccaaaaggcttcggtactacaagatctgctgcatcagctccttcaattgggggtgactttgaaaaacgtactgaatctattgcggcaaaatcacgactcagagctgaggttcgatttaaagctgatattgtctctccagaacaatgggaaagttggatacgtgaccagcaagaatctgaaggtgtcactcctggtgaagatgtctacataattctccgtcttgatggtcgtgtgagaagatctggaagaggcatgccaaactggaacgacattttgaaggaattgccacgtcttgaagatttgctcagcaaacttgaacgatgaaaaagacgtgtatacgggtgtagttttcttcttcatgccctttatctttgtgaagaccggaacactatttcgttgcacagggattgaacatcctgtttcgtaagatttcaatgtagcttcttttcagttctccttgctatgcgaaaaccaaggtggatgccttatttctctataagaagtgaggtccttgtgtgccagataagaacatgtacacaagattgtaattacagcagaggatatattaacaaaccaagaattggctctgttttttttgttgttgtaaaagacgaaaggtcccaagcaaaaatacaaaggtgaacatggttatccaaaagttcttgaaaaaaaanaaaaaanctcgaagactagttctctctctctctcaacctg

SEQ ID NO: 1409 - DNA, 1596 bp, Hordeum vulgare
gggctgcaggcaattcggcacgaggctcaccatccctccgtactccatagtcgcaatggcggccgcggcactccgaacccacctttcccttctctcggccggcggcggaatccccaacccggcgctccaaactctatccttcgttgcccccctcctcctccgccgccgctgccgccgccgcagcagcgtcgttctctccaacgcgtcctcgtcgcccccgtctccccctccttcgccggagaaggcggtcgaggcggctccgacggcggagtcgtgcgtcaacctcggcctcgagttcttctccaagggcagggtgaaggacgcacttgaacaatttgacaaggccctagagctgaatccaaatcctaccgaagcccaagcagcgttctataacaaggcatgctgccatgcatacagggaagaaagcaaaaaagctgcagattgcttgagaatagctttgcgagattacaatctcaaattttaatgatccagacatggcgccattcagggcatcaccagaatttaaggaacttcaagaggaggcattgcgtggtggagaagatattggttctggattccgaagagatctaaagcttattagtgaagtacaagcaccatttcgtggtgtccggaggttcttttatgtggcgttcattgcagcggctggaatttcaacattctttaccattcccagacttatacttgcacttcaaggtggtgatggtgctccagattttctggaaacggctgggaatgctgccattaatattggaggtattgttgtgctcgtggctttatttgtctgggaaaacaagaaagaagaagagcagattacaaatatctctcgtaatgaaaccctttcaaggttacctgtgcgtctgtcaaccaatcgcataactgaacttgtgcaactccgggacattactaggccagttatattggcaggttcaaaagcatctgttactcaagcaatgcaaagagctgagaggtaccgaactgaactgctcaaacgaggcgttcttctaattcctgtgatctttggtgcttcacaaaaagtccaaggcaaaccaaaaggcttcggtactacaagatctgctgcatcagctccttcaattgggggcgactttgaaaaacgtactgaatctattgcggcaaaatcacgactcagagccgaggttcgatttaaagccgatattgtctctccagaacaatgggaaagttggatacgtgatcagcaagaatcggaaggtgtcactcctggtgaagatgtctacataattctccgtcttgatggtcgtggcatgccaaactggaatgatattttgaaggaattgccacgtcttgaagatttgctcagcaaacttgaacgatgaaaactatgtgtatatgggtttcgttttcttccccacgccctttatctttgtgaaggccgagccactatttcgttgcacagagattgaccatcatgttgagtgatatttcgatgtagctttttttcagttcttatgcaaaaacagaggtgaaggtcttatttctctaagaagtgaggtctttgtgtgcgagataagatgtacacaacattttaattacaatagg

SEQ ID NO: 1410 - DNA, 2091 bp, Zea mays
ttatccacaaaccctcgtcggctcggcctcgttcctcgcgcgtactgccgcttgccggctaccagaaaaatggccgcggcggcggcggcggctaggcgtgccgctggccttctccctctcctcctatcctcgcggtccggtgctcgcatacccctccaccgggctgtatcccagatccctccgccttgctcctatcgcctactctcgcagcaagccaagcccttctccgcctctgcctctgcctctgcctcagcctccgcgtcgaatggcgcgaccgcggaaagaacccgtgagctgcatctgtacaacacgaagtcgcggaagaaggagcagtttcggccgcgcgatccaggcggggaggtcggcatgtacgtctgcggcatcactccctacgacgacagtcacatcggccatgcccgcgcatacgtagcctttgacgtcgtctacaggtacttgcgctatttggactatgaagttcgctatgttcggaacttcaccgacattgatgacaagataatcgcaagagcaaatcagctgggggaagatccttttaacttaagtaaaaggttctctgatgacttcttgttagacatggccaatcttcaatgtttaccaccatctgtggagccccgtgtttcagatcatattgatgagattataaatatgattaaacagatccttgataatagttgcgcatatgtagtgggtggggatgtttatttctctgtagacagttttcctgactacggagaattatctggtcgaaaattagatgataatagagctggtgaaagggtttctgttgatgagaggaagagaaatccagctgattttgctctatggaaggccgcaaaagatggggagccatggtgggatagcccatggggcccaggaaggccaggatggcacatagaatgcagtgccatgagtgcacattatttgggtcattcttttgacatacatggtggtggggaggatctcatctttccacaccatgagaatgagattgctcagagccgtgcggcatgttgtgacagtaccataaattactggatacacaatggttttgtcaatgtaaatagccaaaaaatgtctaaatcgcttggtaattttgtcaccatacgaaaggttatagagatgtaccatccgctggctttgagaatgttcttacttggcacacactacaggtccccaattaactacacaatagaacaactcaatgtcacatcagacagattgtactacacatatcagaccttgcttgattgtgaagagatttgtcagcagcaacaaagcaacactggaaattcattgcctgctaataccttaaattacatccaaaaacttcatgaggaatttgagacctcaatgtcagatgatcttcacacttcagtggcattggctgctatttctgagccattgaaagttatgaatgatctgttgcacactcgtaagggaaagaagcaggacaaaaggctggaatctctttctgccttagaagagaaaataagagtagttctctctgttctaggattgctaccttcaagttatcatgaggctttgcaacagctgcgggataaggcactgagacgagcttccatcaccgaggagcttgtggtgcagaagattgaagagaggactgcagcaaggaaggcaaagcagtatgaaaaatccgacgagatccggaaagaactggctgccataggaattgccctcatggatggccccgacggaaccacttggagaccatctttgccaattttagaggaagcggtggttgcgaaaacatgatctgtgcaagggattccaatacgacccatggacaccagttctagtcggtaatcatggatttgctatatgtgacgaacttgttcgtttgactttcattcataccggcttgtaatgcttctataatgttttttcataattctctgctcccattagatctatagtagttactagctgaatgcacgtgtgttgtaatgaaaatatataatatgagtatactatgataacttatatacaaaatgtatgttataccgttatgagaaaatgtttcataatcaatttatgattcgggccatacataaa

SEQ ID NO: 1411 - DNA, 2063 bp, Zea mays
ggctcggcctcgttcctcgcgcgtactgccgcttgccggctaccagaaaaatggccgcggcggcggcggcggctaggcgtgccgctggccttctccctctcctcctatcctcgcggtccggtgctcgcatacccctccaccgggctgtatcccagatccctccgccttgctcctatcgcctactctcgcagcaagccaagcccttctccgcctctgcctctgcctctgcctcagcctccgcgtcgaatggcgcgaccgcggaaagaacccgtgagctgcatctgtacaacacgaagtcgcggaagaaggagcagtttcggccgcgcgatccaggcggggaggtcggcatgtacgtctgcggcatcactccctacgacgacagtcacatcggccatgcccgcgcatacgtagcctttgacgtcgtctacaggtacttgcgctatttggactatgaagttcgctatgttcggaacttcaccgacattgatgacaagataatcgcaagagcaaatcagctgggggaagatccttttaacttaagtaaaaggttctctgatgacttcttgttagacatggccaatcttcaatgtttaccaccatctgtggagccccgtgtttcagatcatattgatgagattataaatatgattaaacagatccttgataatagttgcgcatatgtagtgggtggggatgtttatttctctgtagacagttttcctgactacggagaattatctggtcgaaaattagatgataatagagctggtgaaagggtttctgttgatgagaggaagagaaatccagctgattttgctctatggaaggccgcaaaagatggggagccatggtgggatagcccatggggcccaggaaggccaggatggcacatagaatgcagtgccatgagtgcacattatttgggtcattcttttgacatacatggtggtggggaggatctcatctttccacaccatgagaatgagattgctcagagccgtgcggcatgttgtgacagtaccataaattactggatacacaatggttttgtcaatgtaaatagccaaaaaatgtctaaatcgcttggtaattttgtcaccatacgaaaggttatagagatgtaccatccgctggctttgagaatgttcttacttggcacacactacaggtccccaattaactacacaatagaacaactcaatgtcacatcagacagattgtactacacatatcagaccttgcttgattgtgaagagatttgtcagcagcaacaaagcaacactggaaattcattgcctgctaataccttaaattacatccaaaaacttcatgaggaatttgagacctcaatgtcagatgatcttcacacttcagtggcattggctgctatttctgagccattgaaagttatgaatgatctgttgcacactcgtaagggaaagaagcaggacaaaaggctggaatctctttctgccttagaagagaaaataagagtagttctctctgttctaggattgctaccttcaagttatcatgaggctttgcaacagctgcgggataaggcactgagacgagcttccatcaccgaggagcttgtggtgcagaagattgaagagaggactgcagcaaggaaggcaaagcagtatgaaaaatccgacgagatccggaaagaactggctgccataggaattgccctcatggatggccccgacggaaccacttggagaccatctttgccaattttagaggaagcggtggttgcgaaaacatgatctgtgcaagggattccaatacgacccatggacaccagttctagtcggtaatcatggatttgctatatgtgacgaacttgttcgtttgactttcattcataccggcttgtaatgcttctataatgttttttcataattctctgctcccattagatctatagtagttactagctgaatgcacgtgtgttgtaatgaaaatatataatatgagtatactatgataacttatatacaaaatgtatgttataccgttatgagaaaatgtttcataatcaatttatgattcgggcc

SEQ ID NO: 1412 - DNA, 2615 bp, Zea mays
gtgccacacacacagccacgcccgtcggcccgctaggccgctactacccagaaggatggcggcggcggtggtggtgaggcgtgccgctggccttatccctctcctctcctcgcggttcggtgctcgcatgcccctccaccgggcgctatcccagatccctccgcctcgcttctgtcgcctactatcgcagcaaaccaagcccttctccgcctccgcgtcgaatggcgcggctacggacagaacccgcgagctgcgtctgtacaacaccaagtcgcggaagaaggagcagtttcggccgcgcattccaggcagggaggtcggcatgtacgtctgcggtgtcaccccctacgatgacagtcacatcggccatgcccgcgcatacgtagcctttgacgtcctctacaggtacttgcgctatttggactatgaagttcgctatgttcggaacttcaccgacattgatgacaagataattgcaagagcaaatcagctgggggaagatccttttagcttaagcaaaaggttctctgatgacttcttgtcagacatggccaatcttcaatgtctaccaccatccgtggagccccgtgtttcagatcatgttgatgagattataaatatgattaaacagatccttgataaccgttgcgcatatgtagtgggtggggatgtttatttctctgtagacaattttcctgagtacggagaattatctggtagaaagttagatgataatagagctggtgagagggttgctgttgatgagaggaagagaaatccagctgattttgctctatggaaggctgcaaaagatggggagccatggtgggatagcccatggggcccaggaaggccaggatggcacatagaatgcagtgccatgagtgcacattatttgggtcattcttttgacatacatggtggtggggaggatctcatctttccacaccatgagaatgagattgctcagagtcgtgcggcatgttgtgacagtaccataaattactggatacacaacggttttgtgaatgtaaacagccaaaaaatgtctaaatcacttggtaattttgttaccatacgtaaggttatagagatgtaccacccgctggctttgagaatgttcttacttggcacacactataggtccccaattaactacaccatagaacaactcaatgttgcatcagatagattgtactacacgtatcagaccttgcgtgattgtgaagagatctgtcagcatcaacaaagcaacactggaaatccattgcctgctaataccttaaattacatccagaaacttcatgatgaatttgagacctcaatgtcagatgatcttcacacttcagtggcattggctgctatgtctgagccattgaaagttatgaatgatctgctgcacactcgcaagggaaagaaacaggacaagaggttggaatcgctttccgccttagaagagaaaataagagtagttctctctgttctaggattgctaccttcaagttatcatgaggctttgcaacagctgcgggataaagcactgagacgagcttccatcactgaggagcttgtggtacagaagattgaagagaggactgcagcaaggaaggcgaagcagtatgaaaaatccgacgagatccggaaggaattggctgctgttggaatcgccctcatggatggccccgacggaacaacttggaggccatctttaccacttccagaggaggaagcggtgcttgctaaaacatgatgtgcgccgactttaggatcgagtcgagtatataggggtgattaatcttgttttaaaaagttaaatgcgtctgctagcagaaataaatgtgaatttagttagttgctctagtcaagactacggctctttatctatactagatctatgcccgtgcgttgccacggaaaacacatgaaatcgttatgtgtggtactacaaatcaaacaaagtgaaaaacattaaatatttattcacacgatattgtaaataaaacaacatatcatagcaacagtgagagatccatccatgccacaaacgagcataggagagagctggagtgtgccttttcatcaccttcttgacactggcagcatctactaacaaacgactactaattaactactactactattattatttatgcctactactcactcactatcatatacttatcataggcctaagagctaaaaaaacaacctggacttgtttcttctctgttgctgtcttcactgtcccctccttaagattacacctctccaaaggtatttcttttttctttgtcaaagcttctctacgctcggttgatagggccggccatcatgtagccatattagtagtcccctgcgcacaacagcccgtcaacacacagattatgaccatcatgattcaggatctatgctggcatatatatgcatcatggtcatggaagcagcagctagcttattattaatggttacagcactatcagaaagataggcacaaggagagctattgttgacacttactcccagattagaggaatggagggccccccttcccctttttttgctctatgcacctcacacatcatagcccaatggcttcatgcccaggagaaaacctg

SEQ ID NO: 1413 - DNA, 1851 bp, Zea mays
gtgccacacacacagccacgcccgtcggcccgctaggccgctactacccagaaggatggcggcggcggtggtggtgaggcgtgccgctggccttatccctctcctctcctcgcggttcggtgctcgcatgcccctccaccgggcgctatcccagatccctccgcctcgcttctgtcgcctactatcgcagcaaaccaagcccttctccgcctccgcgtcgaatggcgcggctacggacagaacccgcgagctgcgtctgtacaacaccaagtcgcggaagaaggagcagtttcggccgcgcattccaggcagggaggtcggcatgtacgtctgcggtgtcaccccctacgatgacagtcacatcggccatgcccgcgcatacgtagcctttgacgtcctctacaggtacttgcgctatttggactatgaagttcgctatgttcggaacttcaccgacattgatgacaagataattgcaagagcaaatcagctgggggaagatccttttagcttaagcaaaaggttctctgatgacttcttgtcagacatggccaatcttcaatgtctaccaccatccgtggagccccgtgtttcagatcatgttgatgagattataaatatgattaaacagatccttgataaccgttgcgcatatgtagtgggtggggatgtttatttctctgtagacaattttcctgagtacggagaattatctggtagaaagttagatgataatagagctggtgagagggttgctgttgatgagaggaagagaaatccagctgattttgctctatggaaggctgcaaaagatggggagccatggtgggatagcccatggggcccaggaaggccaggatggcacatagaatgcagtgccatgagtgcacattatttgggtcattcttttgacatacatggtggtggggaggatctcatctttccacaccatgagaatgagattgctcagagtcgtgcggcatgttgtgacagtaccataaattactggatacacaacggttttgtgaatgtaaacagccaaaaaatgtctaaatcacttggtaattttgttaccatacgtaaggttatagagatgtaccacccgctggctttgagaatgttcttacttggcacacactataggtccccaattaactacaccatagaacaactcaatgttgcatcagatagattgtactacacgtatcagaccttgcgtgattgtgaagagatctgtcagcatcaacaaagcaacactggaaatccattgcctgctaataccttaaattacatccagaaacttcatgatgaatttgagacctcaatgtcagatgatcttcacacttcagtggcattggctgctatgtctgagccattgaaagttatgaatgatctgctgcacactcgcaagggaaagaaacaggacaagaggttggaatcgctttccgccttagaagagaaaataagagtagttctctctgttctaggattgctaccttcaagttatcatgaggctttgcaacagctgcgggataaagcactgagacgagcttccatcactgaggagcttgtggtacagaagattgaagagaggactgcagcaaggaaggcgaagcagtatgaaaaatccgacgagatccggaaggaattggctgctgttggaatcgccctcatggatggccccgacggaacaacttggaggccatctttaccacttccagaggaggaagcggtgcttgctaaaacatgatgtgcgccgactttaggatcgagtcgagtatataggggtgattaatcttgttttaaaaagttaaatgcgtctgctagcagaaataaatgtgaatttagtta

SEQ ID NO: 1414 - DNA, 2220 bp, Oryza sativa
gtggggcggaaaacccaaaaaaaatgggaaaagagggaaacgctatccgctaacccctcgcgccgtcgcgcttcctgtgcctcgaggaccgaccatggcggcggcgaggcgcgccgctggcctcctccctctcctcctctcctcgccgtcgcgagctcgcctaccgcaccgccaagcgcttgccctgacccctcctctgcttcgcccccaccgcctctactcccactcccccaagccctcgtcgtccgccgcgttttccgccttcgcctccgcctcgaatggcgcgcctgcggggagagcccgggagctgcacctctacaacaccaagtcgcggaggaaggagctcttccagccccgggtgcccggcggggaggtcggcatgtacgtctgcggcgtcaccccctacgacgacagccacatcggccacgcccgcgcctacgtcgccttcgacgtcctctacaggtacttgcgttatttggaccataaagtgcgctatgttcggaattttactgacattgatgacaagataattgcaagagcaaatcaattgggagaagatccttttagcttaagcaaaaggtactctgatgacttcctatcagacatggctaatcttcattgtttaccaccatctgtggagcctcgcgtttcagaccacattgatcagattataaacatgattaaacagatcattgataatgattgtgcatatgcaattggcggggatgtttatttctctgttgaaaatttccctgaatatggggatttatctggtcgaaaattagatgataatagagctggtgaaagggttgctgttgatgagaggaagaagaacccagctgattttgctctttggaaggctgcaaaagatggggagccatcttgggatagcccttggggccctggaaggccaggatggcacatagaatgcagtgctatgagtgcacattacttgggccactctttcgacatacatggcggtggggaggacctgatctttccacaccatgaaaatgaaattgctcagagccgtgcagcatgttgtgacagcagcataaattactggatacacaatggctttgtcaatgtaaacagccagaaaatgtcaaaatcgctgggcaactttgtcactatacgcaaagttacggaactgtaccacccacttgctttgaggatgtttttacttggtacacactacaggtccccaatcaactataccatagaacagcttaatgttgcatcagacagactgtactacacttaccagacactacaagattgtgaagaaagttgtcaacagcaccaaagcaaggctggagatccattacctgttaatactacaaattgtatccagaagctccatgatgaatttgagacttcaatgtctgatgatcttcacacttcagtagcactggctgctatttctgagccattaaaagttatgaatgacttgctgcatactcgtaagggaaagaagcaggaaaaacggctggaatcactttctgctatggaagagaaaataaggatggtgctttctgtcctagggctactaccatcaagctattatgaggctctgcagcagctgcgggaaaaagcactaagaagagcttccatgacagaggagcaggtgcttcagaaaattgaagaaaggacttcagcaagaaaggcaaaacagtatgaaaaatccgatgaaatcagaaaagaattggctgctgttggaattgccctcatggacggtcctgacggaacaacttggaggccatctgtacctctttctgagcaaggggtggttgccagtacatgatctgcgcaacaaaagctccggagtgaccatttcaaatacccatcaccacatgatccattcatgaggaactgcgatgttttccaggttttgagagaaaatcaagagaacatctgacgaatcagatggcctgcatgattcggtagagtggatatgagtttctgtctgacagaagatagccaagttttacagttttattacatcatacatattttgttctcgagtcagctgatatggtgcaacattttgcctatttttttacctgcagagtttactgcgcgatactttttagaaacatcagtacaaaatattgtgtgctgattcattttttgaatgataatacggtttggcatttcaaatggaagtaaagcaaatgtataagctattcggagcaaaatgttttcaccatcatttttctc

SEQ ID NO: 1415 - DNA, 1941 bp, Brachypodium distachyon
cacggcccatgatggcggcggcggcggcggtgaggcgcgccgccagtggcctctcccctctgctcctctcctcgttgcctcgaactagcctgcgccacagcgagtccctaccccgtcttcttcgtccccaccgcatccctccgcaccccgccaagcccttctgctccgcggccctttcctcgaatggcgcggctgcggagagagcccgggacctgcacctgtacaacacgaagtcgaggaggagggagctgttccggccgcgggcgcccggcggagaggtcggcatgtacgtctgcggcgtcacgccctacgacgacagccacatcggccacgcccgcgcctacgttgccttcgatgtcctcttcaggtacttgcgttatttggactatgaagtacgctacgtccggaactttactgacatcgatgacaagataattgcaagagctaaccaattgggggaagatccttttagcttgagcaaaaggtactctgatgctttcttatcggacatggctcatcttcaatgtctgccaccatctgtggagccccgtgtttcagatcacattgaccagattgtaaacatgattaagcagatccttgataatggttgcgcctatgttgtcagtggggatgtttatttctctgttgacaactttcccgaatatgggatgttatcgggtcgaaagctagatgataatagagctggtgaaaggattgcagttgatgaacggaagaaaaacccagctgattttgctctatggaaggctgccaaagatggggagccatggtgggatagcccttggggtccgggcaggccaggatggcacatagaatgcagtgccatgagtgcacaatacttgggcaattcttttgacatacatggtggtggagaggaccttatatttccacatcatgagaatgaaattgctcaaagccgtgcggcatgttgtgacagtagcataaattactggatacacaatggttttgtcaatgtaaatagccaaaaaatgtctaaatcacttggtaactttgtcactatacgcaaggttatagagcagtaccaccctcttgcattgaggatgtttttacttggcacacactacaggtccccgatcaactacacagtagagcagcttaatgttgcatcagatagattgtactacacttatcagacattacgggattctgaagaaagtactcagaaggaccaaatcaatagtgaagatgcattgcctgctaccaccacacattgcatcgagaagcttcaaaatgaatttgagacttcaatgtctgatgatcttcatacttcagtggcactggctgcaatttccgagccattgaaagttatgaatgatttgctgcatacacgcaagggaaagaagcaggaaaaacgattggaatcactttttgccctggaagagaaaataagaacagtgctttctgttctggggctgatgccttcaagttattatgaggctctacaacagctccgggaaaaggcgctgcaaagagcttccatcaccgaggaccaagtgctgcagaagatcgaagaaaggacctctgcaaggaaggcgaaacagtacgagaagtccgacgagataaggaaagagttagccgctcttggaatcgccctcatggacggcccggacggaactacctggaggccatccgtaccgttttccgagcaaggggtggttgccaataagacatgatgagtgattgatctgatataatttgatgaatcagaggacttgcagtaaattagatgtagagattttgatttaatttctttcacctgcatcttctgttcttgctgaaacatccttgacgcgggacaacatttttagcttgcatattgctgagcattttgactggtaatatacgttttgtacttttcaaattgatgagaatatatactggttgagtggttctgtggttggc

SEQ ID NO: 1416 - DNA, 3275 bp, Brachypodium distachyon
caatcccggcggccatggccaccgtcgccaccatcaccagcagaagctcgaacctcaccctcctcttcttcacatcgacacctcccttcagggttgccctcccctcccgccgcctcccacgcagccatcgacacgctccccagctacttcgcctcaggacggccgcctcggcctcctcccgaaccctaatgccgcccgtctcgccggaagctcgggaggccgcggaggagctgcggctggaggcggagtccgccctggaatggggcggcgtttgcgcgcggctggccgacttcgccgccaccgccgcgggccgcgccgcctgcggagacggccgggtgcccgtcggccggagccgggaggagagcgagcggctgctcgagcagaccgcggcggccgcggcgctgctctcttcttcttcgtcggcgccgctggatttcggcggcgtgggcgacgtgtcggccgtcgtcgccgccgcggcccgcggccggctgctcgccgtgagggagatttgcggcgtcgggcgcagcctccgggcagcccgtggagtgttcgaccaagtcaagggtcttactgatgagatgccggatgagaggtactctcctcttctggatatactgcaggactgcgacttcctgacagagcttgtacagatgatagagttttgcctcgactccaatctttctatggtccttgatcgggccagtgagaaactaggaacaatccgcaaggaaagaaggagcaacatcgaaattttagaatctctgctgagagatgcatccatgaagatcttccaggctggtggtgttgatagccctctggtcactaagcggcgctctaggatgtgcgttggtgttaaagcttcacacaagcatttgctgcctggtggaatcgttctgagttccagtggctctggtgcgacgtactttatggagccaagagatgctgtcaagctgaacaacatggaagtgaaactgtcaagcgatgagagaactgaggaattggcagtattgggcttactaacttcaagaatagcagattcccgaatgaagatcaggcatttgatggggaaaataatggaactggacctggcttgtgctagaggttcatatgccctttggataaatggtgtgaggccagccttcagtgacagggataacagtggtcaattggatccgagtagtgatttttcagtatttatcgacggcattcaacatcctttgctccttgaacagtcttttgggattgcaaaaggatcaactgaagtagggaaagggcagctttctgaagaacaccctgtctcttcaatgcctgttccattggacatgcacgtgaagagtgatactaggatagttgtaatctctggacccaacaccggaggtaaaactgccactatgaagaccttgggattggctacgctgatgtcaaaggctggaatgttcttcccggctaaaggaagtcctaagctcccatggtttgaccaggttcttgctgacattggtgaccaccagtcgctggagaatagcctctctaccttcagtgggaacatatcgcgccttcgcaagattgtacaggttgtgtcgagagattctcttgttcttattgatgagataggcagtggtactgacccatcagaaggtgtatccctttcaaccagcattttgaagtatcttgctggtagactaaacttggccatcgtgacaacccattatgccgatctaagccgtcttaaagctgtcgatggtcgatttgagaatgctgcaatggaattttgtttggaaactctgaaaccaacatatcgaattttatggggaagtactggtaattcaaatgcattgagcattgcaaagtcaattggttttgaccagaaagtactagatcgtgcacaagaatgggttgaaaaattattaccggacaaacaaaaggaacgccaaggtttactttatggctccctgctagatgaaagaaacctgctggagtctcaggcaaatgaagtagcatctgttctttcagaagttgaggttctgtacaatgagatttgcttagaagctgatgacctagataatcgagtagctgctttgagggcaagagagtctcaaaaggttcaacatgagttgaagcttgtgaagtctcagatggacctaataatcagaaactttgaagttcagcttaagaattcaaaacttgaacagtacaactcagtaatgaagaaagcagaagcttcgactgcttcattggctgccgctcatcagccaactgagtttgctttcagtgatgatgaaaacaagagttcatatgttccacaaattggagacaaagtgtacgttgaagggctggggggagggagtctggctactgttgttgagatactcagtgaagatggtagctgtatggttcagtatggcaaaataaaggtccgggccaagaataacaagatgaagttggcccaaagggacacgaaggaaacttcagcttcttcttcggtacaaggaaagggacgaccagtgaaacgatcttcaccagagacgaagcaagatggcagcatctccttcggcccggtggtgcagacgtccaagaacacggtggatctgcggggaatgcgggtctcagaggcatcccacgagcttcagatggcaatcgacgggtgcaggtcttaccaggtcctcttcgtggtccatggcatgggcacaggggcagtgaaggagtgcgctctagacatcctccggagccatccccgggtggccaagctcgaagacgagagccccctgaactacggttgcaccgtcgcctacatcgaatgaacagaccctcaacgcctcattgaacacaacgacatgccagccaactcatacagatctaccatcatacacagcacacttggaaactatatacacaacagaatacacagtttacagatcaaatccgaggccgacctccaaagacatttttcctcacctgattcctgcgagaattgaactgtgaaatcaactgctatccaaaacctgccttagaataaaaggttgcgttgcagggacaacctaggatggcccaggaattaatcgaggctgcgtgtggccggcgaccgctgctggtctggctgggctattcgggtcgggtggatatacggtcgtggtattcaagttttgcctttgcgagcaacgaatccatgcgtgcgagcacatgtgaatctgtacctcattttgttgtgtgtcctacagaatcggtggtctgcatgcacgcacatgcaaccttttctatatgctgggggttctgaatct

SEQ ID NO: 1417 - DNA, 1714 bp, Solanum phureja
tttttttgtggtcataataaatggatcaatctacacttgtttttggatcaatttttgccttgagctttctttatattatagcaaatatatgcaataaaggcaacaacaaagttccaccaggtccatcaccatggccaataattggaaatcttcacttattaggtgcaaaacctcatgcatcactagccaatcttgcaaaaatttatggtccaattatgagtttaaaattaggacaaataacaacaatagttatttcttcatcatccatggcaaaacaagtcctcaaaattcaagatcaagctttttctacaagatttattcctaatgctcttcaagcacacaaccattacaaattttccgtggcatggcttcctgtttgtcctcaatggcgaacgcttcgcagaatattgaacactaacctcctctcttccaataggcttgatgcaaatcaacatctaagatctcaaaaggtgaaacaattgattgcttattgtgacatatgtagtctacaaggtgaagctttggatataggtcaagttgctttcaagactaatctcaacttgttgtcaaacacacttttctccaaggatttggctgaccctttttcagattcaaaggtagagttgaaggaagttatatggggtgtcatggctgaggtagggaagcctaatctagtagatttttttcccatacttaaaaagattgatcttcaaggaataagacgtcgcacaatcattcattttagtaagttgtttaaactttttgatggtttgatcaatgagcgattggaggaaaagagaagatcaggattcacagaaaagagtgatgttctggaaatgtttcttaatattactgaaaaaaatcctgaagatattgatcataatcacatcaagtccatgttcctggacctatttggtgcgggtactgatacaactacaagcacattagaatgggcaatgacagaattgcttaaacaacctgagataataaaaaaagctcaagttgaactcgcagaaaccattggaaaaggaaaaccaatagaagaaactgatgtttctcgactcccttacttgcaatgcattatcaaagaaacattaagactgcacccaccaattccgctcttacttccgcgcaaagtagagcaagatgttgaattgtgtgactacatcattcccaagggctcacaggtactagttaatgtgtggacgattggtcgagattttactttttggaaggatcctttagtgtttaaacccgagagatttttgagtttgaatttggacacgcgaggacaagattttgagttgattccatttggtgcggggagaagaatatgccctggcttgccactagcattgaggatgattccagtaatgttgggctcactcttgaattcattcaattggaaacttgaagcaggcattgagccacaagcattagacatggaggagaagtttggtatcaccttagccaaagctcgtcctttgcgagctatcccctctcctctttgatgttgcattgcctagtctataaatacttatttgtatttgatatttacaatgaaccaagtatttaagtcttaatcttatcatatatatgtatattgcctatatgatgtttctcatgaatgttatttgctttagacaaatagacaaaaagagaataaatataaaagattatgaagatcaaaagaggagattcatgttgtgcaata

SEQ ID NO: 1418 - DNA, 1505 bp, Solanum phureja
aattgaaaaataatggattactatactcttttatacttgtgttggcatcaatttttgctttgatttttgtatatagtctagcaaaattatccagcaaaaaacttccaccagggccatcaccatggccaattattggaaatattcatttgttaggtgcaaaacctcatgtgtcactagccaatcttgcaaaaaaatatggtccaattatgagtttaaaattaggacaaataacaacaatagtaatttcttcatcatccatagcaaaacaagtccttaagaatcaagatcaagcattttcttctagatttatccctaatgcaattcaaggacacaattattgtgaattctctgtgggttggcttcctgtttgtcctcaatggcgaacgcttcgcagaatattgaacataaacatcttctctcctaatagacttgatgcaaatcaacatctaaggtcacaaaaggtgaaagaattgattgcttattgtgaaaaatgtagtcaacaaggtgaagctttggatataagtcaagttgttttcaagactagtcttaatttgttgtcaaacacccttttctctaaggatttggctgaccctttttcgaattcaaaggtagagttgaaggaagttatagcgggtatcctaactgagtttgggaggcctaacctagtggattttttccctatacttggaatgattgatcttcaaggaataaggcgtcgcacaactattcatattggtaaattgtttgaactttttgatgatttgatcaacgagcgattggaggaaaagagaaagggattcagtgaaaagagtgatgttctggaaatgtttctcaatatttgtgaagagaatcctgaagagattaatcataatcacatcaagtctatgttcatggacttatttctggcggctacggatacaactacaagcacattggaatgggcaatggcagaaatactcaaacaacctgagattatgaaaaaggttcaagctgaacttgcaaaaattattggaaaaggaaaatcaattgaagaagttgatgttactcgtcttccttacttacaatgcatcatcaaagaaaccttaagaatgcacccaccagctccatttttagttccgcgcaaagtggagcaagatgttgaattatttgattacatcatccctaagggttcacaggtactagtcaatgtgtggtcgattggtagagattttactttttgggatgagcctttagtatttaaacctgaaaggttttggggttcggatttagatatgcaaggacaagattttgatttgattccatttggtgcgggtcgaagaatgtgccccggctttccactagcattgagaattgttccagtaatattaggctcactcttaaattccttcaattggaagcttgaggcagacattggaccagaagatctagacatggaagagaagtttggtatcaccttagccaaagcccatcctttgcgagttatcccatttctactctgatgttgt

SEQ ID NO: 1419 - DNA, 1522 bp, Triticum aestivum
aactttggttccttcttcgtccctctgcccggtttgcccatcgccgagcccagaaccctaatctgagatcgcgaactatcctctcccgatgtcagacgtcaccgccgagtccacgccgcgccagcgcctgcctacgccgtcgccatcactatcccagcagcagtctcgcggtcgtcagccgccccctcccggctccgaccccctcgctctcggcgtcgtcatcttcatcgccgtctgcttcctcctggtttcaatctcagctccatcaagcattttacatcaagttcctgaaggacatgttggggtatactggagaggaggtgctcttttgaaaaccattactactccaggctatcacctgaagctgcctttcatcacccagtttgagccaatacaggttacactccaaacagaccaggtcaaaggtattccttgtggaacgaaaggcggtgtcatgatcagctttgacaagatagaggttgtcaatcgtctcaataaagactttgtttatgagaccctgctcaattatggtgtgcattatgataagacatggatatatgacaaaattcatcacgagataaaccagttctgcagtgctcatagtttgcagcaagtttacattgacatgttcgatcagattgatgagaccatgaaagaagctatccaaagggactgcacgcgctatgctcctggaattgagattatcagtgttcgtgttacaaagccaaacatacctgttagtattaggagaaattttgaacttatggaggaggagcgtacaaaggcgctaattgccatcgaaaggcaaaaggtggcagaaaaggaggcagaaactcagaagaagatcgcactatctgaagcagaaaagaatgcactagtgagcaagatcctcatgcagcagatgctaacggagaaggacagttccaaaaggcagcagcagattgataatgaaatgttccttgcccgagagagagcccttgcagatgcaaactattacaggattacgaaggaagcagaggctaacaaactaaaacttacacctgagtatcttgagctgaggttcattgaatcaattgccaataacacaaagattttctttggtgaaaagattccgaacatgatcatggatcaaaggttgattcgaaatcaccttgattctgctccgagcaaggaccagttagaaatatagtatcatctcttgtaaatttgaaggaacgatggttgttttgtaatcctgtatggaggtttggatttccttgaagcccttaggcgcatgagaatcaaaaaaggatgtagtagtaggaggaccccttttcaattgccttgacgttgttttcaatcaaggaccgtttagccttgtggaatacttgtagttgaaggatatgcacgcccttttgacctgcaagggaaagaaatgcagagctcataactgtaatgtgttgcaactggttgtgatttgttaggacttcctcaacatgctagtagtactattactgaagagctataaatgtgtttcacggaa

SEQ ID NO: 1420 - DNA, 1647 bp, Triticum aestivum
  misc_feature (1237)..(1237): n is a, c, g, or t
  misc_feature (1278)..(1278): n is a, c, g, or t
  misc_feature (1332)..(1332): n is a, c, g, or t
  misc_feature (1385)..(1385): n is a, c, g, or t
  misc_feature (1632)..(1632): n is a, c, g, or t
atggctgcatagagacatggctaggccattttcctgcgtttgtatctgacgttgtaattggcgatatgccatgtacaatatcgtaatgcattacttatgttttccttcgaaaaaaaaaactttggttccttcttcgtccctctgcccggtttgcccatcgccgagcccagaaccctaatctgagatcgcgaactatcctctcccgatgtcagacgtcactgccgagtccacgccgcgccagcgcctgcctacgccgtcgccatcactatcccagcagcagtttcgcggtcgtcagccgccccctcccggctccgaccccctcgctctcggcgtcgtcatcttcatcgccgtctgcttcctcctggtttcaatctcagctccatcaagcattttacatcaagttcctgaaggacatgttggggtatactggagaggaggtgctcttttgaaaaccattactactccaggctatcacctgaagctgcctttcatcacccagtttgagccaatacaggttacactccaaacagaccaggtcaaaggtattccttgtggaacgaaaggcggtgtcatgatcagctttgacaagatagaggttgtcaatcgtctcaataaagactttgtttatgagaccctgctcaattatggtgtgcattatgataagacatggatatatgacaaaattcatcacgagataaaccagttctgcagtgctcatagtttgcagcaagtttacattgacatgttcgatcagattgatgagaccatgaaagaagctatccaaagggactgcacgcgctatgctcctggaattgagattatcagtgttcgtgttacaaagccaaacatacctgttagtattaggagaaattttgaacttatggaggaggagcgtacaaaggcgctaattgccatcgaaaggcaaaaggtggcagaaaaggaggcagaaactcagaagaagatcgcactatctgaagcagaaaagaatgcactagtgagcaagatcctcatgcagcagatgctaacggagaaggacagttccaaaaggcagcagcagattgataatgaaatgttccttgcccgagagagagcccttgcagatgcaaactattacaggattacgaaggaagcagaggctaacaaactaaaacttacacctgagtatcttgagctgaggttcattgaatcaattgccaataacacaaagattttctttggtgaaaagattccgaacatnatcatggatcaaaggttgattcgaaatcaccttgattctgntccgagcaaggaccagttagaaatatagtatcatctcttgtaaatttgaaggancgatggttgttttgtaatcctgtatggaggtttggatttccttgaagcccttnggcgcatgagaatcaaaaaaggatgtagtagtaggaggaccccttttcaattgccttgacgttgttttcaatcaaggaccgtttagccttgtggaatacttgtagttgaaggatatgcacgcccttttgacctgcaagggaaagaaatgcagagctcataactgtaatgtgttgcaactggttgtgatttgttaggacttcctcaacatgctagtagtactattactgaagagctataaatgtgttncacggaattggaagt

SEQ ID NO: 1421 - DNA, 1436 bp, Brachypodium distachyon
tccccacttcctcttccttctctgttcccggttcgcccgagcccaaaaccctagtctgaactataccttaccgatgtcggacgtcaccgccgactcgccgccgcgccagcgcccgccgcctccgccgtcgccgtcgctgtcccagcagcagacgcgtggccgccagccgccccctcccggctctgaccccctcgctctcggcgtcatcgtcttcatcgccgtctgcttcctcctggtttcgatctcagcaccatccagcattttacatcaagttcctgaaggacacgtcggggtatactggagagggggtgctcttttgaaggccatcacttctccaggttatcatctgaagctgcctttgatcacccagtttgagccaatacaggtgacactccaaacagaccaggtcaaaggtattccttgtggaacaaaaggtggtgtcatgatcagctttgataagatagaggttgtcaatcgtctcagtaaagactttgtttatgacaccttactcaattatggtgtgcattatgataagacatggatatatgacaaaattcatcatgagataaaccagttctgcagtgctcacagtttgcagcaagtttacattgacatgtttgatcagattgatgaaacaatgaaagaagctatccaaagggactgcacacgttatgctcctggaattgaaattatcagtgttcgtgttacaaagccgaacataccaagtagtattaggagaaattttgaacttatggaggaggagcgtacaaaggcgctgatcgctatggaaagacaaaaggtggcggaaaaggaggcagaaactcagaagaagatcgcactatctgaagcagaaaagaatgcactggtgagcaagatcctcatgcaacagatgctgacggagaaggacagttccaaaaggcagcagcagattgataatgaaatgtttcttgctcgagagagagccctgacagatgcaaactattacaggatcacaaaggaagcagaggccaacaaactcaaacttactcctgcatatcttgagctgaggttcattgaatcgattgccaataactcaaagattttctttggtgaaaagatcccaaacatgattatggatcaaaggatgattcggaattaccttgatcctgcttcaggcaaggaccgtttagaaatatagtggtgtcttctgtgaatttgaaggaccattggaaagttgcatgttcactattcatgtgccctgtcaggcacatctaacgtccttgtaatatttggctgtattagtactactccgttcagcatattagctggaacaatctgcacgtccttttgatctgtaagaaatggagagctcttaactgggatgcgatgcaactgatagtctgcagaactgaaagcttgcccaggttggcttgacagaaatacaaggttgtttgctt

SEQ ID NO: 1422 - DNA, 1213 bp, Festuca arundinacea
  misc_feature (10)..(11): n is a, c, g, or t
  misc_feature (13)..(15): n is a, c, g, or t
  misc_feature (18)..(18): n is a, c, g, or t
  misc_feature (20)..(23): n is a, c, g, or t
  misc_feature (33)..(33): n is a, c, g, or t
  misc_feature (35)..(36): n is a, c, g, or t
  misc_feature (49)..(49): n is a, c, g, or t
  misc_feature (63)..(64): n is a, c, g, or t
  misc_feature (78)..(78): n is a, c, g, or t
  misc_feature (768)..(768): n is a, c, g, or t
  misc_feature (774)..(774): n is a, c, g, or t
  misc_feature (780)..(780): n is a, c, g, or t
  misc_feature (818)..(818): n is a, c, g, or t
  misc_feature (903)..(903): n is a, c, g, or t
  misc_feature (906)..(906): n is a, c, g, or t
ggcacgaggnncnnngcncnnnngcccatcgcngnntccaaaaccctancctgagatcgcganntcccgatgtcggangtcaccgccgagtccacgccgcggcagcgcccgcccccgccctcgccgtcgctgtcccagcagcagtcgcgcgtccgtcagcagcccccgcccggctccgaccccctcgctctcggcctcatcatcttcctcggcctctgcttcctcctggtttcattctcagctccatccagcattgtacatcaagttcctgaaggacatgttggtgtatactggagaggaggtgctcttttgaaaacaatcactcctccaggttatcatctgaagctgcctttgatcacccagtttgagccaatacaggttacactccaaacagaccaggtcaaaggtattccttgtggaacaaaaggtggtgtcatgatcagctttgacaagatagaggttgtcaatcgtctaaataaagactttgtgtatgataccctactcaattatggtgtgcattatgataagacatggatttatgacaaaattcatcatgagataaaccagttctgcagtgcccacagtttgcagcaagtttacattgacatgtttgatcagattgatgagacaatgaaagatgctatccaaagggactgcacacgctatgctcctggaattgaaatcatcagtgttcgtgttacaaagccgaacatacctgttaatatcaggagaaattttgaacttatggaggaggagcgtacaaaggcnctgatngccatngaaaggcaaaaggttgcagagaaggaggcagaaactcngaagaagattgcactatctgaagcagaaaagaatgcactagtgagcaagatccttatgcaacagatgctgacggagaaagacagntcnaaaaggcagcagcagattgataatgaaatgtatcttgcccagcagagagccctggcagatgcaaactattacaggattacaaaggaagcagaggctaacaaactaaaacttactcctgaatatcttgagatgaggttcattgaatcaattgccaataacacaaagattttcttcggtgaaaagattccaaacatgatcatggatcaaaggttgattcggaaccaccttgattctactccgagcaaggaccgcttagaagtagagtagtgccttacatggatttgaagttggttggttggttttgtaa

SEQ ID NO: 1423 - DNA, 2007 bp, Sorghum bicolor
gagcagtgagaggaagcacacaagaaggttcagatttgagagacttgacttgacccaaacaaccgccacggcagaggggcacaccgcactcccagccatcgtcctcgctcctcgccgtcgcccccggccaccccgtcggccgtcgccccccaccctgatccgacctcgcctagggcttccggccggggacccccgcccaccctcctcgcgatgtctgacgtcacctctgccgactcggcgccgaaccgccgctcgccgccgccgccgtcgccgtcgccgtcgatgccgcgcttccagcagcagccgagcgggcgccagccgcccccgcccggcgccgaccccttcgccttcggcgtcgtcgccttcatcggcatctgcttcgtgctgatttcactctcagccccatcaagtgttttacatcaagttcctgaaggacatgttggggtatactggagaggaggtgctcttctgaagacaatcactcctccagggtttcatctgaagctccctttgatcacccagtatgagccaatacaggttacacttcaaacagatcaggtcagagatattccttgtggaacaaaaggtggtgttatgatcagctttgacaagatagaggttgtgaaccgcctccgcaaagagtttgtgcatgaaaccctactcaactatggtgtgcactatgacaagacatggatatatgataaaattcatcatgagattaaccagttctgcagtgctcacagtttgcaacaagtttacattgacatgtttgatcagattgatgaaacaatgaaagaagctattcaaagagactgtacacgctatgctcctggaattgaaatcatcagtgttcgtgttacgaagccgaacatacctggtagtatcagaagaaattttgaacttatggaggaggagcgtaccaaggcactgatcgccattgagaagcaaaaggtagcagagaaggaggcagaaacacagaagaagattgcactgtctgaagcagagaagaacgcacaggtgagcaagatcctgatggagcaaaagctgatggagaaggacagttccaagagacaggagcaaattgataatgaaatgtaccttgcacgtgagaaagcactagcagatgcaaactactacaggatcttgaaggaagcagaggctaataggctcaaactgacacctgagtatcttgagctgaggttcattgaatcaatcgccaataactcaaagattttcttcggtgaaaagattcctagtatgatcatggatcaaaggttgctcaagaattaccttgatgctgttcctaggaaggaccattatgaaatgtagaagcgtttccgtttgttggaagcaagagacctttttttgtgtgtggtcccacgcagtaggtaggattcccacggagccgttcagtacatcagtaagctaggagtcatcaggatcctcttgaagatgaaattagcagttatgagatttttggcttgttttgtgtagtagatgcattagggcaactggagcattcgcatgtgaccgacagtgatgcaatgcaagcagtgcaaatcctgttgggtatatcttgctagtcttcaaaactgatggtcaaggctgctggggtaggcctgctacacaagctttgtaaccactgacccgtttgctagggctctagcacctaaaagaactccggctctggtttcttacgtggagttatgtggagtgacttctttgatgggagtttgaaggtgttttgaaaaatgtaagacaaaaagtacgtctagtgatagttctgcaataatttatattaggtttgtaaatggtcaaactgaagatcgtgattgatttagagcatctccaatagtctttctaaagcccacacttaaatcatcatttgaagtgccatttgtataaaaaattgtttttatcattttactctccaatattttttctatatctgtgtgaactctagagagttatatgctattttttcaataatataatgctatgacaatg

SEQ ID NO: 1424 - DNA, 1756 bp, Oryza sativa
ctcccctcttctttctcttctcgtcgcattcgacggcatcactcgccaaaagctcagcccaggatcccccgccgccgatgtcggacggcagcgtcgagtcgccgtcgctccaccgcacgccgcctccgccctccccgtcgccgtcactctcgctctcgcgctcccagcagcagaccccgcggggccgccagccgcccccgcccggcgccgaccccgtcgccttcgccgtcgtcgccttcgtcgccatctgcttcgtgctgatttcattttcggcaccgtcaagcattctacatcaagtccctgaaggacatgttggggtgtactggagaggaggtgctcttttggaaacaatcactccaccaggttttcatgtgaagctgccttggataacccaatttgagccaatacaggttactcttcaaacagaccaggcaaaaatattccttgtggaacaaaaggtggagtcatgatcagctttgataagatcgaggttgtcaaccgcctccataaagagtttgtgcacgaaaccttactcaattatggtgtgcattatgacaagacatggatctatgacaaaattcatcatgagataaaccagttctgtagtgcccacagtttgcagcaagtttacatcgacttgtttgatcagattgatgaaacgatgaaagaagctattcaaagagactgtacacgctatgctcctggtattgagataatcagtgttcgtgttacaaagccgaacatacctgatagcattaggagaaattttgaacttatggaggaggagcgtacaaaggcattgattgccattgagaagcaaaaggtagcagagaaggaagcagaaacgcagaagaaaattgcactatctgaagcagagaagaatgcacaggtgagcaagatcctcatggagcagaagcttatggaaaaggacagctccaagaggcagcaacagattgataatgaaatgttccttgcccgagagaaagctcttacagatgcgaactattacaggataacgaaggaagcagaggccaacaggcttaaacttacaccggagtaccttgagctgaggttcattgaatcaatcgccaataactcgaagatattctttggtgaaaagattccaaacatgatcatggatcaaaggatgcttaggaattacctcgacaatggttccaccaaggaccatttggaaatatagcagttgtctctgtgaattgcaaagaacattggctgtttttctgatcccacggggaaattaggattctcacggatctgctcactacttggtaaagccaaaaggactagacattagggccttttaaagatggaaattagtagtctactgtagtagcatagctggaggctggagtaatcgttttgcgtgcgtgcgtaggagctgggagttacgttagatcactagatgcgctatcttgtgcaatctgcagaactgatggacaggaacaaatgctatcaggagcactatgatttccaagttcagaaaaggttctacgagtacaaatgggaaagatcgggcattacttgatacagtagtctcagcgatcgacacagcactaactgtgtgaagctatatactcctatctggaattgaggtatagcatctgtctgcaaggaagatttctgagtatagcaggttcacatacatgttgcatgcatctatctgcaaacaaacctgtatcatgaatgtgaacaattggactagtaactaatgggtataggaaacaagcaggtgagt

SEQ ID NO: 1425 - DNA, 1712 bp, Zea mays
ttttatttttctgctttacacatgtattcatgtatttttactattcctgtgttcttcctaatccaaaaccgtattccaaaagaggcctacactttactcgctcgaaccaaaattacccaacacgggcaacactccacgccaggagtgggcgagtggcacaccgcacaccagccttcgtcttcctcgcggtttcgtccactcccgtcgcccgttccacctgtgacctgccaaggcaccaagcctgaccgacttcgcttacggttcccggtgacccccgcccaccctcctcgcgatgtctgacgtcacctccgactcggcgcagagacgccgctcgccgccgccgccgtcgccgtcgccgtcgatgccgcgtttccagcagcagccgagcgggcgccagccgcccccgcccggcgccgaccccttcgccttcggcatcgtggccttcatcggcatctgcttcgtcctggtttcactctcagtcccatcaagtgttctacatcaagttcctgaaggacatgttggggtgtactggagaggaggtgctcttctgaagacaatcactcctccagggtttcatctgaagctccctttgatcacccagtacgagccaatacaggttacacttcaaacagaccaggtcagagatattccttgtggaacaaaaggtggtgttatgatcagctttgacaagatagaggtcgtgaaccgccttcgcaaagagtttgtgcatgaaaccctactcaactatggtgtgcactatgacaagacatggatatatgataaaatccatcatgagattaatcagttctgcagtgctcacagtttgcagcaagtttacattgacatgttcgatcagattgatgaaacaatgaaagaagctattcaaagagactgtacacgctatgctcctggaattgaaatcatcagtgttcgtgttacgaagccaaatatacctggtagtatcagaagaaactttgaacttatggaggaggagcgtacaaaggcactgatcgccatggagaagcaaaaggtagcagagaaggaggcagaaacacagaagaagattgcgctatctgaagcagagaagaacgcacaggtgagcaagatcctgatggagcagaagctgatggaaaaggacagttccaagcgacaggagcagattgataatgacatgtacctcgcacgagagaaagcagtagcagatgcaaactactacaggatattgaaggaagcagaggccaataggctcaaactgacacctgagtatcttgagctgaggttcattgaatcaatcgccaataactcaaagattttcttcggtgaaaagattcctaacatgatcatggatcaaaggttgctcaagaactaccttgatgctgctcctaggaaggaccattatgagatgtagaagcgtgttccgtgagttggaagcaaaagacctttgtgtgtgtgatcccaccgtccacgcagtagataggattcccacgagccgttcagtacctcagtaagccagaaaagactcatcaggaccctcttgaagatttagatgcaaaaattttcttcgccaaaaatgtacagttttgctcactgacttaggacatgtttggagcatctatttttttagaaactggtttatgaaaactgaaatggtttcaaacatatctgattatatcccagtttatagaaactagattcctagtttcttaaaaact

SEQ ID NO: 1426 - DNA, 1711 bp, Zea mays
tttttttttctgctttacacatgtattcatgtatttttactattcctgtgttcttcctaatccaaaaccgtattccaaaagaggcctacactttactcgctcgaaccaaaattacccaacacgggcaacactccacgccaggagtgggcgagtggcacaccgcacaccagccttcgtcttcctcgcggtttcgtccactcccgtcgcccgttccacctgtgacctgccaaggcaccaagcctgaccgacttcgcttacggttcccggtgacccccgcccaccctcctcgcgatgtctgacgtcacctccgactcggcgcagagacgccgctcgccgccgccgccgtcgccgtcgccgtcgatgccgcgtttccagcagcagccgagcgggcgccagccgcccccgcccggcgccgaccccttcgccttcggcatcgtggccttcatcggcatctgcttcgtcctggtttcactctcagtcccatcaagtgttctacatcaagttcctgaaggacatgttggggtgtactggagaggaggtgctcttctgaagacaatcactcctccagggtttcatctgaagctccctttgatcacccagtacgagccaatacaggttacacttcaaacagaccaggtcagagatattccttgtggaacaaaaggtggtgttatgatcagctttgacaagatagaggtcgtgaaccgccttcgcaaagagtttgtgcatgaaaccctactcaactatggtgtgcactatgacaagacatggatatatgataaaatccatcatgagattaatcagttctgcagtgctcacagtttgcagcaagtttacattgacatgttcgatcagattgatgaaacaatgaaagaagctattcaaagagactgtacacgctatgctcctggaattgaaatcatcagtgttcgtgttacgaagccaaatatacctggtagtatcagaagaaactttgaacttatggaggaggagcgtacaaaggcactgatcgccatggagaagcaaaaggtagcagagaaggaggcagaaacacagaagaagattgcgctatctgaagcagagaagaacgcacaggtgagcaagatcctgatggagcagaagctgatggaaaaggacagttccaagcgacaggagcagattgataatgacatgtacctcgcacgagagaaagcagtagcagatgcaaactactacaggatattgaaggaagcagaggccaataggctcaaactgacacctgagtatcttgagctgaggttcattgaatcaatcgccaataactcaaagattttcttcggtgaaaagattcctaacatgatcatggatcaaaggttgctcaagaactaccttgatgctgctcctaggaaggaccattatgagatgtagaagcgtgttccgtgagttggaagcaaaagacctttgtgtgtgtgatcccaccgtccacgcagtagataggattcccacgagccgttcagtacctcagtaagccagaaaagactcatcaggaccctcttgaagatttagatgcaaaaattttcttcgccaaaaatgtacagttttgctcactgacttaggacatgtttggagcatctatttttttagaaactggtttatgaaaactgaaatggtttcaaacatatctgattatatcccagtttatagaaactagattcctagtttcttaaaaact

SEQ ID NO: 1427 - DNA, 1558 bp, Saccharum officinarum
cgcctagcggtttcggggtcccccgcccaccctcctcgtgatgtctgacgtcacctccgactcggcgcagagccgccgctcgccgccgccgccgtcgccgtcgccgtcgatgccgcgcttccagcagcagccgagcgggcgccagccgccgccgcccggcgccgaccccttcgccttcggcgtcgtcgccttcatcggcatctgcttcgtcctgatttcactctcagtcccatcaagtgttctacatcaagttcctgaaggacatgttggggtatactggagaggaggtgctcttctgaagacaaccactcctccaggttttcatctgaagctccctttgatcacccagtatgagccaatacaggttacacttcaaacagaccaggtcagagatattccttgtggaacaaaaggtggtgttatgatcagctttgacaaaatagaggtcgtgaaccgcctccgcaaagagtttgtgcatgaaaccctactcaactatggtgtgcactatgacaagacatggatatatgataaaattcatcatgagattaaccaattctgcagtgctcacagtttgcagcaagtttacattgacatgttcgatcagattgatgaaacaatgaaagaagctattcaaagagactgtacacgctatgctcctggaattgaaattatcggtgttcgtgttacgaagccaaatatacctggtagtatcagaagaaactttgaacttatggaggaggagcgtacaaaggcactgatcgccatcgagaagcaaaaggtagcagagaaggaggcagaaacacagaagaaaatcgcactatctgaagcagagaagaacgcacaggtgagcaagatcctgatggagcaaaagctgatggagaaggacagttccaagagacaggagcagattgacaatgaaatgtaccttgcacgagagaaagcactagcagatgcaaaccactacaggatcttgaaggaagcagaggctaataggctcaaactgacacctgagtatcttgagctgaggttcattgaatcaatcgccaataactcaaagattttcttcggtgaaaagattcctaacatgatcatggatcaaaggttgctcaagaattaccttgatgctgttcctaggaaggaccattatgaaatgtagaagcgtgttccgtgagttggaagcaaaagacctttttttggtgtgagaatcccacgcagtagataggattcccacggagccgttcagtacatcagttagccagaaaggagtcatcaggatcctctttaagatgaaaatgagatctttggcttgttttgtgtagtagtagcattagggcgactggagcattcgcatgtgaccgacagtgatgcaaccagtgcaaatcctggtgggtatatttcgtgctagtcttcaaaactgatggtcaagggcgctgggccccaaacccaagtagtttcttgaaaatgttatgggtacatgttactgaggggaagaacctttaggaaccctggttgattgcaaagtttttctgggcataaatgtgccaagatgcttcctggc

SEQ ID NO: 1428 - DNA, 1610 bp, Panicum virgatum
ggcacggccttcgtcctcgccgtttcgcccgccccccaccccctccctcccgcatcactcccaagccgatcgaaaccctaacccgacctccctcccctgggctgtaggttcccagggatcccctcgcgatgtcggacgtcaccgccgactcggcgcagagccgccgctcgccgcccccgccgtcgccggccccgtcgatggcgcgcttccagcagcagccgagcgggcgccagccgcccccgccgggcgccgaccccttcgcctttggcgtcgtcgccttcatcggcatctgcttcgtcctaatttcactctcagttccatcaagcgttctgcatcaagttcctgaaggacatgttggggtatactggagaggaggtgctcttctgaagacaatcactcctccagggtttcatctgaagctcccttggatcacccagtatgaggcaatacaggttacacttcaaacagaccaggtcagagatattccttgtggaacaaaaggtggtgttatgataagctttgacaagatagaggttgtaaaccgcctccgtaaagactatgtgcatgaaacactactcaactatggtgtgcactatgacaagacatggatatatgataaaattcatcatgagataaaccagttctgcagtgctcacagtttgcagcaagtttacattgatatgtttgatcggattgatgaaacaatgaaagaagctattcaaagagactgcacacgctatgctcctggaattgaaatcatcaatgttcgtgttacaaagccaaatatacctcctagcattaggagaaattttgaacttatggaggaggagcgtacaaaggcactgattgctattgagaagcaaaaggtagcagaaaaggaggcagaaacacagaagaagattgcgctatctgaagcagagaagaacgcacaggtgagcaagatcctgatggagcagaagctgatggagaaggacagttccaagaggcaggagcagattgacaacgaaatgtaccttgcacgagagaaagcactggcagatgcaaactactacaggatcttgaaggaagctgaggctaataggctcaaacttacaccagaatatcttgagctgaggttcattgaatccattgccaataactcaaagatcttctttggtgaaaagattccaaacatgatcatggatcaaaggttgcttaagaactaccttgatgatgtttcgaggaaggaccattccgaattatagaagctcctttccgtgaatcagaagcagcgcaggctatttttgtgaccccacgtggtagataggataggaatcccaggaagccgccaggagaccacagaaaaggaggggagaaatcaggagtcgcccctaaagattagaactggcagttggtgttatgcaagaaaacctttggtttattttttgtgtagtgttagcgttagcatagatggagcaatctgcaatcggctgacattgatgctaccatcagacattgttgggcttggacgtgtcctagacgggtggctaaggtcactcgtttctactccatctttgttattacgtaataagggaggcacgtgcggctggcagagttcgccttttgatgtt

SEQ ID NO: 1429 - DNA, 1711 bp, Zea mays
ttggagctcgacaccaataatgatggcgccgaggtaagagtctattttttaatgaaaatgaaaagtacgtatttgtgaaaataaacaaaaaaaactaaaatgtaaaaaagacggtcgcccgcaccacccgccaaggccccaagacctgaccgatctcgcctaggggttccggtgatccgcgcgcgccctcctcgagatgtctgacgtcacctctgactcggcgcagagccgccgctcgccgcccccgccgtcgccgtcgccgtcgatgccgcgcttccagcagcagccgagcggacgccagccgccccagcccggcgccgactccttcgtcttcggcgtcttcgccttcatcgccatctgcttcgtcttgatttcactctcagtcccatcaagtgttctacatcaagttcctgaaggacatgttggggtatactggagaggaggtgctcttctgaagacaatcacccctccagggtttcatctgaagctccctttaatcacacagtatgagccaatacaggttacacttcaaacagaccaggtcagagatattccttgcggaacaaaaggtggtgttatgatcagctttgacaagatagaggtcgtaaaccgcctccgcaaagagtttgtgcatgaaaccctactcaactatggtgtgcactatgacaagacatggatatatgacaaaattcatcatgagattaaccagttctgcagtgctcacagtttgcagcaagtttacattgacatgtttgatcagattgatgaaacaatgaaagaagctattcaaagagactgtacacgctatgctcctggaattgaaatcatcagtgttcgtgttacaaagccaaatatacctggtagtatcagaagaaactttgaacttatggaggaggagcgtacaaaggcactgatcgccatcgagaagcaaaaggtagcagagaaggaggcagaaacacagaagaagattgcgctatctgaagcagagaagaacgcgcaggtgagcaagatcctgatggagcaaaagctgatggagaaggacagttccaagagacaggagaagattgataatgaaatgtacctggcacgagagaaagcactagcagatgcaaactactacaggattttgaaggaagcagaggcaaataggctcaaactgacacctgagtatctggagctgaggttcattgaatcaattgccaacaactcaaagattttctttggtgaaaagattcctaacatgatcatggatcaaaggttgctcaagaattaccttgatgctgttcctaggaaggaccattatgaaatgtagccgcgggttccgtgggttggaagcagaagtctttcttttttgtgtgatcccacgcagtagataggattaccgtgtagccgtccagtatactagtaagccagaaaggagtcatcaggatcctcttgaagatgaaattagcagtcatgagatctttggcttgttttgtgtagtagcagcattagggcacctggagcattcgcatgtgaccgacagtgatgcaaccagtgcaaatcctgtagtcttcaaaactgatggtcaaggccgctggcctccaaacccaggtaatctcttgaaaaggatctgggttataatttttgactgatgggcagaacaatttgtagcactgctgatgccaaagttttctcgatcataaatgtgcaagtttgctccctgacttaa

SEQ ID NO: 1430 - DNA, 1700 bp, Pennisetum glaucum
gagactggacttgagacttgacccaaacccaactcgcaagtcacacccacacggttgtgtgtgtcactcgttcgtcgtcctcctcgccgtcctcacccactccctcccctcccgcatcacgattcacaccaggccggtcgaaaccggaaaccctaaccccatcctctcctagctcccaaggatccctcgcgatgtcggaagtcaccggcgactcggcgcagagccgccgctcgccgcccccgccgtcgccggcgccgtcgatgccgcgcttccagcagcagccgagcgggcgccagccgcccccgccgggcaccgaccccgtcgccttcggcgtcgtcgccttcatcggcatctgcttcgtgctgatttcactctcagttccatcaagtgttctgcatcaagttcctgaaggacatgttggggtatactggagaggaggtgctcttctgaagacgatcactcctccagggtttcatctgaaactcccttggatcacccagtatgagtcaatacaggttacacttcaaacagaccaggtcagagatattccctgtggaacaaaaggtggtgttatgatcagctttgacaagattgaggttgtgaaccgcctccgtaaggagtatgtgcatgacaccctactcaattatggtgtgcactatgacaagacatggatatatgataaaattcatcatgagataaaccagttctgcagtgctcacactttgcagcaagtttacattgacatgtttgatcagattgatgaaacaatgaaagaagctattcaaagagactgcacacgctatgctcctggaattgaaatcatcggcgttcgtgttacaaagccaaatattcctggtagcattaggagaaattttgaacttatggaagaggagcgtacaaaggcactgattgccattgagaagcaaaaggtagcagagaaggaggcagaaacacagaagaaaattgcgctatctgaggcagagaagaacgctcaggtgagcaagatcctgatggagcagaaactgatggagaaagacagttccaagaggcagcagcacattgacaatgaaatgtaccttgcacgagagaaagcactggcagatgcaaactactacaggatcttgaaggaagcagaggctaacaggctcaaacttacacctgcatatcttgagctgaggttcatcgaatcaattgccaataactcaaagattttctttggtgaaaagattccaaacatgatcatggatcaaaggttgcttaagaactaccttgaggatgttccgaggaaggactattcccaattatagagtctcctttccttgaatcagaagtgacacgggctaggctattattgtgacgctgcatggccatggtagatagggcaggatccccacaaagccgttcagtagaataacactagaagccgaacaagaaaaaagaggaggcatcaggagttgtcccgaaggatgagaactggccgttagtcttatgcaagaaaactttttggtttatttctgtgcagtagtattagtattagcactagatggagcaatttgcatgtagctgacattgatgctaccatcagaccccgttgggcttgcacatgtgctaaactggtggctaggtaacttgtttttaagatactagctgtgctggaagatacagaataatttttgtgggcatataattgacaagacaag

SEQ ID NO: 1431 - DNA, 1771 bp, Brachypodium distachyon
cactgactccaattccaaatatggggataaagaggccggggcgctgcaactgcgctaccgcggcggagttgttggcgcttcttcttatcatcctcggcgcgtcgtctctgacgggatgcattgcggcgagcggaggagcagggctcaccaggggcagcttccccaagggattcgtcttcggcaccgcctccgccgcgtaccagtacgagggggcggtgaaggcggacgggcgagggcagaccatctgggacaccttcgcgcacacctttggaaagatcactgacttcagcaatgccgatgttgccgtcgaccagtaccaccgttttgaggaggacatacagctgatggcagacatggggatggacgcgtatcggttctccattgcgtgggcaaggattctcccaaatggtgttggtcaagtgaaccaggccggcatcgaccactacaacaaactgatcaatgcactgctagctaaaggaatccagccatatgtgaccctgtaccactgggacctgccccaggccctggaagacaagtacaacggctggcttaacaggcagatagtagacgacttcgcgggttacgcggagacgtgcttcgcggcgttcggggaccgggtgaagcactggatcacggtgaacgagccgcacacggtgtccgtgcagggctacgacgccgggctgcaggcgcccggccgctgctccgtgctgctccacctctactgcaagtcgggcaactccggcaccgagccctacatcgtcgcccacaacttcatcctcgcccacgccaccgtctccagaatctaccggaacaagtacagggcgacgcagaaggggcagctggggatggcgttcgacgtgatgtggtacgagccgatgacgagcagagccgtggacgtggaggcggccaagagggcgcaggagttccagctcgggtggttcgcggatcctttcttcttcggggactacccggagacgatgcggaagcgggtcggggaacggctgccgcggttcacgccggaggaggcggagctcgtcaagggcgcgctggacttcgtggggatcaaccattacactacgtattataccaggcagaatgataccaacatcattgggaagctgttcaatgacaccctcgcagacaccgggaccatcagcctgccgttcaggaacgggaaagcgattggggacagggcgaattcgatatggctgtacatcgtgcccagagggatgaggagcctgatgaactacgtcaaggacaggtacaacagcccgccagtctacatcactgaaaatgggatggatgacggcaacagccccttcatttccctcaaggacgccctcaaggacagcaagaggatcaaataccacaacgactacctcaccaacctagctgcttccatcaaggaggacgggtgcgacgtgcgcgggtacttcgcgtggtctctgctggacaactgggagtgggcggccggatactcgtcaaggttcgggctctacttcgtggactacaatgacaatctcaagagataccccaagaactccgtgcagtggttcaagagcctcctcagttcgagttgataatcgagctaagctagcgcttgtttgctcattgatttcttcctgccagtaggttataccatacggtgccggcgtcgggggtttcagaattagatgttgtttttgctggaagtgtatagcttctagatgttatcattggacgatatcttcacatgtatacacacaaggaataaatttgtgaacaataaatc

SEQ ID NO: 1432 - DNA, 2012 bp, Zea mays
acacaaaaacctacgcgcacccggccgctctccagtgggcaggcagttggcctcctttcctcgccgcgctttggagcccacctcggtctcggtgcagtgtctcgctcgcgcgtgccggcgtgcgtgccctggtggcccatggggaggaggataatgaagagtgggcgacgcacgacgatgcagccgcggccggcgcttcttctcctcgtcctcgtcctcggcgtgtcgctgcgtggatgcattgcgcagggcgggggcggaggaggagggctcacgcgggggagcttccccaagggcttcgtcttcggcaccgccgccgccgcttaccagtacgagggagccgtgaagacggatggcagagggcaaacgatctgggacacgtttgcacacacttttggcaagatttcagacttcagcaacgcggatgttgcagttgaccagtaccaccgtttcgaggaggacgtgcagctcatggcggacatgggaatggatgcgtatcgcttctctattgcctggtcaagaattttgccaaatggtacgggccaagtcaatcaggccggcatcgaccactacaacaaagtgatcaatgcactactatcaaaaggaattcagccatatgtaaccctgtaccactgggacctcccccaggccctggaagacaggtacaacggatggctggacaggcagatagttaatgactttgcggcttatgctgagacatgcttcaaggcgttcggagaccgtgttaagcactggatcacgctcaacgagccgcacacggttgcagtccaaggctacgatgctgggcttcatgcgccagggcgttgctcggtgctgctccatctatactgcaggacagggaactctggcactgagccctacatcgttgctcacaacttcatcctagctcatgccaccgtttcagacatgtacaggaggaaatacaaggcagctcagaatggtgagcttgggatcgcatttgacgtcatctggtacgaaccaatgacaaacagcacgatcgacattgaagctaccaagagggcgcaggagtttcagctaggatggttcgcggacccgttcttcttcggagactacccggcgacgatgcgggctcgggttggagagaggctgcccaagttcaccgcagacgaggctgcccttgtcaagggggccctggacttcatgggcataaaccactacaccactttctacacgaggcataacgacaccaacatcatcggacggctgctgaacgacaccttggcggacaccggaaccatcagcctgcccttcgacaagaacgggaagcccattggagatcgggctaattcgatatggctgtacatcgtacccagcgggatcaggaagctgatgaactatgtcaaggagcggtacaatagcccaacggtttacatcactgaaaatgggatggacgacggcaacagccctttcacctccctccagaacgccctcaaggacagcaagaggatcaagtaccacaacggctacctcaacaacgttgctgcctccataaaggaggacgggtgtgacgtgcgtgggtacttcgcgtggtcgttgctggacaactgggaatgggccgccgggtacacctccagattcgggctctacttcgtggactacaaggataacctcaagaggcaccccaagaactcggtccagtggttcaagaccctgctgagctccagctgaaggcgtcacacgggctgtgattggactgaccatttacccgacaccatacccttatcctgttgtgtcaagcactcaagctccaatcaatgtaaaataatgttacccctctctctctctctctggtagaaaaacatgtcgtgtagggctacatttagttacacattaaaagggcatatcagtaacttcaaacttagttcgtttgaaagcataagttacacgtgtggatttgtattgaaatacactttgtaaaaaaaagtcatgtttgtaaataaattaaataatatagcctagaataaatcagc

SEQ ID NO: 1433 - DNA, 1732 bp, Sorghum bicolor
atgccgcccgtggtggtgcttcttcttcttctcgtcgtcctcggcgtgtcgctgcaaggacgatgcactgcgcagggcgggggagggctcacgcgggggagcttccccaagggcttcgtcttcggcaccgccgccgccgcttaccagtacgagggagccgtcacgacggatggcagaggacggacaatctgggacacgtttgcacacacttttggcaagatctcggacttcagcaatgcggatgttgcagttgatcagtaccaccgtttcgaggaggacgtgcagctcatggcggacatgggaatggatgcgtatcgcttctccattgcctggtcaagaattttgccaaatggtacgggccaagtcaatcaggctggcattgaccactacaacaaagtgatcaatgcactactatccaaaggaattcagccatatgtaacactgtaccactgggacctccctcaggcactggaagacaggtacaacggatggctggacaggcagatagttaatgactttgcggcgtatgctgagacatgcttcaaggcgtttggagaccgtgtgaaacactggatcacgctcaatgagccgcacacggttgccattcaaggctacgatgctgggcttcacgcgccagggcgttgttcggtgctgctccatctatactgcaagtcagggaactctggcactgagccctacatcgttgctcacaacttcatcttagctcatgccaccgtttcagacatctacaggagaaaatataaggcagctcagaatggtgaacttgggatcgcatttgacgtcatctggtacgaacctatgacaaacagcacgattgacattgaagctaccaaaagggcacaagagtttcagctaggatggttcgcggaaccgttcttcttcggagattacccggcgacgatgagaactcgggttggagaaagactgcccaagttcacggcagatgaagctactcttgtcaagggggctctggacttcatgggcataaaccactacaccactttctacacgaggcataacgaaaccaacatcatcggacgactgctgaatgacactttggcagacaccggaaccatcagccttccattcaggaacgggaaagccattggtgacagggccaattcgatatggctgtacattgtgcccaatgggatgaggagcctgatgaactacgtcaaggaaaggtacaacagcccaccagtttacatcacggaaaacgggatggatgacggcaacagccctttcacttccatcaaggacgcgctcaaggacagcaagaggatcaagtaccacaacgactacctcaccaacctggctgcctccataaaggaggatgggtgcgacgtgcgtggctacttcgcgtggtcgctgctggacaactgggagtggacggccggctactcatccagattcgggctctacttcgtggactacaaggacagcctcaagagataccccaagagctcggtgcagtggttcaagaacctgttaagctctagctgaaggctggaaatatagcttgctctgtttggcatttgtcattttttcttcagggcctgaccaagcggtcatctcaaatcatgcaaattgtgccgtgcccaggtccatgtgtacttgtgtaggaaggaccgaaggagcacgacgagctgagtgttaatgtttttagaaccttttctgggttattaagcatttcaattcagtgacaaaattt

SEQ ID NO: 1434 - DNA, 1652 bp, Pennisetum glaucum
cttggaaggtactggtgatgatgaagtcggcgtgtcgcttcaaggtcgtcggtgcattattgcgcaggccgccgggggaggagggctcacgcgggggagcttccccaaggggttcgtcttcggcaccgccgccgccgcctaccagtacgagggagccgtgaaggtggatggcagaggacagacgatctgggacacgtttgctcacactttcggcaagatttctgacttcagcaacgccgacgttgcagtcgatcagtaccaccgttttcaggaggatgtacagctcatggcagacatgggaatggatgcttaccggttttcgattgcatggtcgaggatcttgccagatggtaccggccaagtcaatcaggctggcattgaccactacaacaaagtgatcgatgcactactatcgaaaggaattcagccctatgtaaccctctaccattgggacctacctcaggccctggaagaccggtacaagggatggctggacaggcagatagttaatgattttgcggcctacgctgagacatgcttcaaggcatttggggatcgtgtgaagcactggatcacgatcaacgagccccataccgttgccgttcagggctatgacgctgggcttcacgcgccaggacgttgttcagtgctgatgcatttgtactgcaggtcagggaattcagccactgagccctacattgttgctcacaacttcatcttagctcatgccaccgtttcagacatttacaggaggaaatacaaggcaaatcagaatggccaggttgggattgcatttgacgtcatctggtacgaaccgatgacaaatagcacaattgacattgaagccaccaaaagggcacaagagtttcagctaggatggttcgcggatccgttcttctttggtgattacccagcgacgatgagaacccgggttgcagaaagactgcccaagttcacggcggaggagtctgcccttgtcaagggggctctggactttgtgggcataaaccactacaccactttctacacgaggcataacgatactaacatcatcggattactgctgaataacaccttggctgacactggaaccatcagccttccattcgacaagaacgggaagccgatcggagatagggccaattcgatctggctgtacattgtacccagcgggatgaggaagctgatgaactacgtgaaggagaggtacaataccccaacggtttacatcactgaaaatgggatggatgacggcaacagccctttcacgtccatcaaggacgcgctcaaggacagcaagaggatcaagtaccacaacgactacctcaccaaccttgctgcctccatcaaggaggacgggtgcgacgtgcgcgggtacttcgcgtggtcgctgctggacaactgggagtgggctgccggatacacctcgagattcgggctccacttcgtggactacaaggataacctcaagagataccccaagaactcggtgcagtggttcaaatcccttctcagctccagttagttgaagacggcaccatatacaggatatcgtaattggcctggcctacctgattccatgtatacttagctgttgtgttaaacatgcacaaaggattaaaaaagaaagaaagagcgtcaagcttcactcc

SEQ ID NO: 1435 - DNA, 2068 bp, Zea mays
ggccgctctccagtgggcaggcagttggcctcctttcctcgccgcgctttggagcccacctcggtctcggtgcagtgtctcgctcgcgcgtgccggcgtgcgtgccctggtggcccatggggaggaggataatgaagagtgggcgacgcacgacgatgcagccgcggccggcgcttcttctcctcgtcctcgtcctcggcgtgtcgctgcgtggatgcattgcgcagggcgggggcggaggaggagggctcacgcgggggagcttccccaagggcttcgtcttcggcaccgccgccgccgcttaccaggtcggtggtttctgtcgccttctctctctctctccctcttctgttccacggccggcccaaggaatgtggggtttgttgtacgagggagccgtgaagacggatggcagagggcaaacgatctgggacacgtttgcacacacttttggcaagatttcagacttcagcaacgcggatgttgcagttgaccagtaccaccgtttcgaggaggacgtgcagctcatggcggacatgggaatggatgcgtatcgcttctctattgcctggtcaagaattttgccaaatggtacgggccaagtcaatcaggccggcatcgaccactacaacaaagtgatcaatgcactactatcaaaaggaattcagccatatgtaaccctgtaccactgggacctcccccaggccctggaagacaggtacaacggatggctggacaggcagatagttaatgactttgcggcttatgctgagacatgcttcaaggcgttcggagaccgtgttaagcactggatcacgctcaacgagccgcacacggttgcagtccaaggctacgatgctgggcttcatgcgccagggcgttgctcggtgctgctccatctatactgcaggacagggaactctggcactgagccctacatcgttgctcacaacttcatcctagctcatgccaccgtttcagacatgtacaggaggaaatacaaggcagctcagaatggtgagcttgggatcgcatttgacgtcatctggtacgaaccaatgacaaacagcacgatcgacattgaagctaccaagagggcgcaggagtttcagctaggatggttcgcggacccgttcttcttcggagactacccggcgacgatgcgggctcgggttggagagaggctgcccaagttcaccgcagacgaggctgcccttgtcaagggggccctggacttcatgggcataaaccactacaccactttctacacgaggcataacgacaccaacatcatcggacggctgctgaacgacactttggcggacaccggaaccatcagcctgcccttcgacaaaaacgggaagcccattggagatcgggctaattcgatatggctgtacatcgtacccagcgggatcaggaagctgatgaactatgtcaaggagcggtacaatagcccaacggtttacatcactgaaaatgggatggacgacggcaacagccctttcacctccatccaggacgccctcaaggacagcaagaggatcaagtaccacaacggctacctcaacaacgttgctgcctccataaaggaggacgggtgtgacgtgcgtgggtacttcgcgtggtcgttgctggacaactgggaatgggccgccgggtacacctccagattcgggctctacttcgtggactacaaggataacctcaagaggcaccccaagaactcggtccagtggttcaagaccctgctgagctccagctgaaggcgtcacacgggctgtgatttgactgaccatttacccgacaccatacccttatcctgttgtgtcaagaactcaagctccaatcaatgtaaaataatgttacccctctctctctctctctggtagaaaaacatgtcgtgtagggctacatttagttacacattaaaagggcatatcagtaacttcaaacttagttcgtttgaaagcataagttacacgtgtggatttgtattgaaatacactttgtaaaaaaaagtcatgtttgtaaataaattaaataatatagcctagaataaatcagc

SEQ ID NO: 1436 - DNA, 1065 bp, Zea mays
gtcagctcttgcgggaagcactcaattgtaatactgtgaagtctgaaccggctggcctggccgttgctgagggagaggataaagaacaccgaaatgccactcctgctgctcccaccaccggcgtgcaccacggcagcgacgtcgctcgctttctcgcggccccggccttcgcgggcgcgttgggccaacctctcttacgcgttcccccgcctgaggaaatacgggcgtcgccaccgcgagcccgtggccggccccagcctcgatgatgacggcggcgaggaggatgagacggaggcagaggactgggagtccgacgatggcgatgaagagatggagatagacgaggaggagtttctgacgatgcggcccaaaccggcgggatttggcgaggggaaaacatattccactgacattgaggagcagcttctccgggagatgggctttggcgggggcgcggcgcggcgaggagaggcggccccggccaatcgccgcgccggggatagttccaccaaagtagctgccgcagatgtcagtgatgatggtgttcaagttcgtgtttggaacctcccaaaaaagaaaaacatacacaaggacctgaagcaagcttttaaagggtttcatggccttttatccattgatccagcagtttccgcaaataagaaaacccgtgatcctatttgtaagggttttgcatatctcaaactagagtctgctgaagctgcaacaaggttcgtggagatatactctcatcaaactgtgtcatttggcaagattcagaagccaatcagttgctgtatcatcgataaacgcagctctgttgagcattcaaataagcatccactagtcaggcaatccctcaattaatgtccaagcaccaaaacttggtagcggcaagttgagtaacacatatctgccatctagcacaagtaatcacgcacttctaggggtctcaagttttatgaaaaagctttgataaacagatagattagacagttctctgtattccaaataactgtttgtatcaagcaatttggtcttgtttttttaggggaagcaatttggtct

SEQ ID NO: 1437 - DNA, 1066 bp, Zea mays
gtcagctcttgcgagaagcacccaaattggagtactgtgaagtctgaaccggctggcctggccgttgctgagggagaggataaagaacaccgaaatgccactcctgctgctcccaccaccggcgtgcaccacggcagcgacgtcgctcgctttctcgcggccccggccttcgcgggcgcgttgggccaacctctcttacgcgttcccccgcctgaggaaatacgggcgtcgccaccgcgagcccgtggccggccccagcctcgatgatgacggcggcgaggaggatgagacggaggcagaggactgggagtccgacgatggcgatgaagagatggagatagacgaggaggagtttctgacgatgcggcccaaaccggcgggatttggcgaggggaaaacatattccactgacattgaggagcagcttctccgggagatgggctttggcgggggcgcggcgcggcgaggagaggcggccccggccaatcgccgcgccggggatagttccaccaaagtagctgccgcagatgtcagtgatgatggtgttcaagttcgtgtttggaacctcccaaaaaagaaaaacatacacaaggacctgaagcaagcttttaaagggtttcatggccttttatccattgatccagcagtttccgcaaataagaaaacccgtgatcctatttgtaagggttttgcatatctcaaactagagtctgctgaagctgcaacaaggttcgtggagatatactctcatcaaactgtgtcatttggcaagattcagaagccaatcagttgctgtatcatcgataaacgcagctctgttgagcattcaaataagcatccactagtcaggcaatccctcaattaatgtccaagcaccaaaacttggtagcggcaagttgagtaacacatatctgccatctagcacaagtaatcacgcacttctaggggtctcaagttttatgaaaaagctttgataaacagatagattagacagttctctgtattccaaataactgtttgtatcaagcaatttggtcttgtttttttaggggaagcaatttggtct

SEQ ID NO: 1438 - DNA, 845 bp, Zea mays
cgcgcgcgctctctatctgctattctgcttttcgtgcagacgggaggggagagctgcactgcactgcacacagaatcacagatcacagatgtgggcgccgggctcgccggggaggctgccggcgatggaggagtgcggcgaggacgaggagacggacgtggacgcgtaccacggggcgatggcctcctcctgttggggccgtctcggcgccgccgcgctgtggcacaggctacggcagcatctcagcctcgtgcgccgccgccgccgccagcgcggccgctccctcctcggcgccggtgggctcaactacgacccgctcagctacgcgcagaacttcgacgacggctgcctctgcctggaagagcgcgagccggacttcagcgccaggttcgcgcccgcgcggcacgccgccggctccccgcggcccacggccgcggcgcgtgacgtcgcgaccgcttgacggcgtagcacatgcagtagcctttaccacgtaccgctcgccgcagccgcgcgcctttggaagagtggcaaactggtaactgctccacacggcttttttagttggtaaatgtacatacgtggtacacggctacacgccgtagtagacgacgcgcgtggatggatgtaagtaggtttgttatagcgtaatctagatcttcgcatcgcatcaagcgaaaaaaggtctctttgccgatttgctgccttcagctgcagcgttcttgcagttgcagggattattcttgggagtttttgctcgtattattgtacatgtacacttgccatttggctgggcttctgcacatcactttgtcctgaataagcctacctcgttctcgttcttgtgg

SEQ ID NO: 1439 - DNA, 824 bp, Zea mays
cgcgcgctctctctatctgctattctgcttttcgtgcagacgggaggggagagctgcactgcactgcacacagaatcacagatcacagatgtgggcgccgggctcgccagggaggctgccggcaatggaggagtgcggcgaggacgaggagacggacgtggacgcgtaccacggggcgatggcctcctcctgctggggccgtctcggcgccgcctcgctgtggcgcaggctacggcagcatctcagcctcgtgcgccgccgccgccgccgccagcgcggccgctccctcctcggcgccggtgggctcaactacgacccgctcagctacgcgcagaacttcgacgacggctgcctctgcctggaggagcgcgagccggacttcagcgccaggttcgcgcccgcgcggcacgccgccggctccccgcggcccacggccgcggcgcgtgacgtcgcggccgcttgacggcgtagcacatgcagtagcctttaccgcgtaccgctcgccggctcgccgccgccgcgcgcctttggaagagtggcaaactggtaactgctccacacggcttttttagttggtaaatgtacatacgtggtacacgccgtagacgacgcgcgtggatggatgtaagtaggttcgttatagcgtaatccaggtcttcgcatcgcattagtcttggcgaaaaaaagtctctttgccgatttgctgccttcagctgcagcctgcagcgttcttgcagggattattattcttgggagtttttgctcgtattattgtacatgtacacttgccatttggctgggcttctgcacatcactttgtcctg

SEQ ID NO: 1440 - DNA, 779 bp, Zea mays
ttttttttttcgatcctaaggtccccggcggcccggccggaacaaaacccgttcgatgcgtctccgccgtttcaggacacaatcaagggctagaagccactacaggcccaaattcagcccatacccactctcccatccacgagaccacaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagaccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttcccttcccctctctctctatctccctgcctgatggctatcttcaggtttcaatttgatgatggaataaggaaaggtacttgtcctattaccg

SEQ ID NO: 1441 - DNA, 804 bp, Setaria italica
cagctcagcccaaacccaagcccccaaatccaaagcgaccgatctcgcccgaccacacgccgcaccaaacccgcagcgcccatccatcgacggaacgacctcgccggcgagagagaggggaagaaagtgacagatggaggcggcggcggctgcggccggcgtgcagctcggctcctcgaagccccagatcgccacgcaggcggagatggcggaggcccgggtgccgctcgcctaccgcgaccagtgcgcccacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggaagccaaggtcaagggcggcgcctccattggcctcatcccggccaccgccaagctcgcctgatccggccccggttcgatccggttgatttaggtctgctggttatcacagcgtgcagaggcattgtgcaaggatcctgaatgtttgttgtatgaacaagcatctgttgaatttggcataaagttaactgttgtcttgttcgcttcccccttttctcctttatagccatcttcaagtttcaatttgatggaataaggaaacctgccgtcttattacacttgctgactgaatgactccttgaagttttgaatgcaattcgtggaccctgcatatgtagacaggcctcttttgtgccgtagttcatgttataacagacgttttagctgtgcagcaattttgagatcgga

SEQ ID NO: 1442 - DNA, 707 bp, Saccharum officinarum
cccgcccgtccacaagccacatcaaacccgcctctgtgcctcacccattcatcgacgggacgacctcgccggcgagagagtgacagatggaggcggcggcagcggcggccggcgtggagctcggctcctcgaagccccagatcgcgacgcaggcggagatggcggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgcgagtacgagctcgtcatggagcggatgctcaagatgcagaagatccgcgaggcgcaggaggccaaggtcaagggcggcgcctccattggcctcatccctgccaccgcaaagctcgcctgatgcggccccggcccgatccgtttgatttaggtccctggttattgcagaggcattgtgctgtgcaaggatcccggatgtttgttgtgtgaacaaacatgtgtttgaatttggcataaagttaactgttgtcttcttcccttccccctctcccccctgacgggcatcttcaagtttcaatttgatgatggaataaggaaacattcttgtcctgtaaccgatgaccgaacgacgccttgaagtttttaattaccattccggttgtggaaaaaggagatcttcttttacgtagagcaa

SEQ ID NO: 1443 - DNA, 820 bp, Panicum virgatum
acaagccgcaccaaacccgcagcgcccaaccatcgacgagacgacgacgtcgccggcgagagagaaggggagacagttgacagatggaggcggcggcggcagcggccggcgtgcagctcggctcctccaagccccagatcgccacgcaggcggagatggcggaggcccgggtgccgctcccctaccgcgaccagtgcgcgcacctcctcatcccgctcaacaagtgccgcgtcgccgagttctacctcccatggaagtgcgagcccgagcgccacgcctacgagaagtgccagtacgagctcgtcatggagcggatgctccagatgcagaagatccgcgaggcgcaggaggccaaggtcaagggcggcgcctccattggcctcatcccggccaccgccaagctcgcctgatccttccccggtccgatccggttgatttaggtctgctggttatcacagcgtgcagaggcattgtgcaagaatcctgaatgtttgttgtatgaacaaacatctgttgaatttggcataaagttaactgttatcttctcctcatcccccttttctccttgatgggcatcttcaagtttcaatttgatggaataacgaaacctactgtcttacgcttgatgactgaatgacgccttgaagttttgaatgcaattcgtggacccttcatatgtagacagacctactttgtgctgtaggttatgtaatgacatagccgctttacctgggctgtggctgtgcagcaattttgtgttacgcgtgtcatcaactcatcatcatgtcatgttgcattaatgtatcgctccacttatgtc

SEQ ID NO: 1444 - DNA, 668 bp, Pennisetum glaucum
cggcacgaggggggaacgacctcgccggcgtgagagagaggggggaaaagtgacagatggaggcggcggcggcagcggccggcgtgcagctcggctcctcgaagccccagatcgccacgcaggaggagatggtggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggaggccaaggtcaagggcggcgcctccatcggcctcatcccggccaccgccaagctcgcctgatccggccggccccggtccgatccggttgctttaggtctgctggttatcactgcatgcagaggcattgtgcaaggatcctgaatgtctgtgtgtgaacaagcatctgttgaatttggcataaatttaactgttgtcttcttcccttccctctttaccccctgagaatagccatcttcaagtttcagtttgacggaataaggaaacatgctgtcattattacacttgctgactgaacgatgcctttgaagttttgaatgcgaatcgtgggcgggtctcatttgtgcc

SEQ ID NO: 1445 - DNA, 706 bp, Pennisetum glaucum
acccacccaattcgcagcgcccatccatcgacggggaacgacctcgccggcgtgagagagaggggggaaaagtgacagatggaggcggcggcggcagcggccggcgtgcagctcggctcctcgaagccccagatcgccacgcaggaggagatggtggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggaggccaaggtcaagggcggcgcctccatcggcctcatcccggccaccgccaagctcgcctgatccggccggccccggtccgatccggttgctttaggtctgctggttatcactgcgtgcagaggcattgtgcaaggatcctgaatgtttgtgtgtgaacaagcatctgttgaatttggcataaatttaactgttgtcttcttcccttccctctttaccccctgagaatagccatcttcaagtttcagtttgacggaataaggaaacatgctgtcatattacacttgctgactgaacgatgcctttgaagttttgaatgcgattcgtgggcgggtctcatttgtgccctagttcatgttaaaaa

SEQ ID NO: 1446 - DNA, 684 bp, Panicum virgatum
gcccgaccacaagccgcaccaaacccgcagcgcccgtccatcgacgagacgacgtcgccggcgagagagaaggggagacagtgacagatggaggcggcggcggcagcggcagcggccggcgtgcagctcggctcctccaagccccagatcgccacgcaggaggagatggcggaggcccgggtgccgctcgcctaccgcgaccagtgcgcgcacctcctcatcccgctcaacaagtgccgcgtctccgagttctacctcccatggaagtgcgagcccgagcgccacgcctacgagaagtgccagtacgagctcgtcatggagcggatgctccagatgcagaggatccgcgaggcgcaggaggccaaggtcaagggcggcgcctccataggcctcatcccggccaccgccaagctcgcctgatccggccccgctccgatccggttgatttaggtctgctggttatcacagcgtgcagaggcattgtgcaagaatcctgaatgtttgttgtatgaacaaacatctgttgaatttggcataaagttaactgttgtcttctccccctccaccttttctccttgatgggcatcttcaagtttcatttgatggaataacgaaacctactgtcttacgcttgatgactgaatgacgccttgaagttttgaatgcaattcgtggacccttgat

SEQ ID NO: 1447 - DNA, 614 bp, Cenchrus ciliaris
  misc_feature (457)..(457): n is a, c, g, or t
cgccggcgtgagagaggggaagaaagtgacagatggaggcggccccggcggcggctggcgtgcagctcggctcctctaagccccagatcgccacgcacccccctatgagggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggaggcaaaggtcaagggcggcgcctccatcggcctcatcccggccacagccaagctcgcctgaggcggccccggtcctttttttttgttttcccccccccgtctatcacagcgtgcaaaaaaaaaggagggggggtgctgaatgtttgttgtatgaacaancatctgttgaatttggcatatagttaactgttgtctacttcccttccctctttactccctgatagccatcttcaagtttcagtttgatggaataaggaaacttgctgtcttattacacttgctcactgaatgacgccttgaagttttgaatgcaatt

SEQ ID NO: 1448 - DNA, 538 bp, Festuca arundinacea
  misc_feature (502)..(502): n is a, c, g, or t
ggcacgagggcgcaaccacaaaccgcaccaaacccgcacagcccatcggcgacctcgccggagcgacagaaggtgagagatggaggcggcggcggcagcggccggcgtgcagctgggcacctcgaagccgcagatcgcgacccaggcggagatggcagaggcgcgcgtgccgattgcctaccgcgaccagtgcgctcacctcctcatcccgctcaacaagtgccgcgtctccgagttctacctcccctggaagtgcgagcccgagcgccacgcctacgagaagtgcgagtacgagctcgtcatggagcggatgctcaagatgcagaagatccgcgaggcgcaggcggcaggcaaggtcaagggcggcgccaccatcggcgtgcccctcatcccgtccaccgccaagctcggctgatccgggtctgcccgatctgcccgattcagtcaggtttggcactaaggcatgaagggcagctgcaacgatcatggatgatagttccgngaacaaaacacatgtttgtattttgcataagttaac

SEQ ID NO: 1449 - DNA, 727 bp, Avena sativa
ccacagtccaaactccagagcgacggaacccaccccactcgcgcaaccacacaccgcaccgaacccgcacagcccatcggcgacctcgccggagcaacagaaggtgagagatggaggcagcagcggcggcggccggcgtggagctgggctcctcgaagccgcagatcgcgacccagtcggagatggcggaggagcgggtgccgattgcctaccgcgaccagtgcgcccacctcctcatcccgctcaacaaatgccgcgtctccgagttctacctcccctggaagtgcgagcccgagcgccacgcctacgagaagtgcgagtacgagctcgtcatggagcggatgctcaagatgaagaagatccgcgaggcgcaggcggcaggcaaggtcaagggcggcgccaccattggcctcatccccgccaagctcgcctgatctggccctccccgccgatctggccgattcaggtttggcgctaggggcaccgtgcaaggatcatgaatgttagttctgtgaacggaaacacctgtttgaatttggcataatgttaactcttgtcttcttccctgccgcctttttctccttacaattgttggaataagaagagttgtctatactcgatgagtgaaatgacaccttgaagttttgaaatgcaatgcctggactctgcttatgtagcaatggtaatgctgtagagcctatttttatactaccttgtgagagaccaa

SEQ ID NO: 1450 - DNA, 783 bp, Brachypodium distachyon
aagcgaccgaacccacaacactcgccccaaccacacaccgcaccagacccggacaacccatcgtcgacctcgccggcgacagacaaggcgaaacatggaggaggcggcggcggcggccggcgtgcagctgggcacctcgaagccgcagatcgcgacccaggcggagatggcggaggcgcgcatcccgatcccgtaccgcgaccagtgcgcccacctcctcatcccgctcaacaagtgccgcgtcgccgagttctacctcccctggaagtgcgagcccgagcgccactcgtacgagaagtgccagtacgagctcgtcatggaacggatgctgcagatgcagaagatccgcgaggcgcaggggggcgccaaggtcaagggcggcgccaccattggcgtgcccctcatcccttccaccgcaaagctcgcctgatccggtccctgcccgatctggatgattcaggtttggtgactagagcatgatgggcaccatgccaggatcatgaatgttagttctatgaacaaatcatctgtttgaatttggcataaagttaactcctgtcttctacccctctcactttcctcctttggtgagtaccttcagttttaatttgttggaataaggaatcagctgtctatgctcgatgagtgaaatgacgcctcgaagttttgaatgcaattcatgaactctgcttgtgtagatctacttttatgcagtagacggtttatagcataaatatctggtctcaagctattaaaccttgtgagactactgttggttgtgga

SEQ ID NO: 1451 - DNA, 843 bp, Oryza sativa
gccggccggcggcggcgcagccgcgtggggggaggcggcggcgggcaggaggccggcggcggtgggcaggcgggcggccgagcgctgctggagcccgaacccgagcccaaagcgaccgatccaaccacccgcatccacacaccgcaccaccaaccatcgaccgcctcgccggagaggagagagaaaggaagagcgcgagatggaggcggcggcggcggccggcgtgcagctgggcacctcgaagccgcagatcgcgacccaggcggagatgtcggaggcgcgcctcccactgccctaccgcgaccagtgcgcccacctcctcatccccctcaacaagtgccgcgtcgccgagtactacctcccctggaagtgcgagcccgagcgccacgcctacgagaagtgccagtacgagctcgtcatggagcggatgatccagatgcagaagatccgcgaggcgcaggaggccaagtccaagggcgccgccaccattggcgtccccctcatcccttccaccgccaagctctcctgatccccgctccgcttcgatctgctctattcagggctggttatgacagcacgaaggacattgtgcaaggatcgtggatgctagttctatgaaccaaacatctgtttgaatttagcataaagttaactgttgtcttcttctctccgcctttactccgttggtgagcatcttcgagtttcaatatgaaataaggaactacctgtttatactcaatgactgaaatgacgccttaaagttttgaatgcaatgcgtggactctgcatatgaagagctactttaattcagtagaacaacccagttactcccagtctcccagt

SEQ ID NO: 1452 - DNA, 751 bp, Triticum aestivum
gcacgaggacactgacatggactgaaggagtagaaaaccactctctcgcccgaaccacgcgccgcaccgagcccgcacccgcacagcccatcggcgacctcgccggagaagagagaagaaggtgagagatggaggcggcggcggcggcggccggcgtgcagctgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgcccctcgccccctccacagccaagctcgcctgatccgtctgattcaggactggttggtgactagagcttgaagggcgctgtgctcgcaaggatcatgaatgttgttcttgtatgaacgaaacatctgtttgaattcggcataaagttaactctttctttcttggtcttgttcccctccgccttccctcctttggttcaagtttaagtttgatggaataaggaaccagctgtcttcctatactcagacgagtgaaatggcaagcttgaagttttgaaaaaaaaaaaaaaaggcggccgctctagatatccctcaacacccc

SEQ ID NO: 1453 - DNA, 857 bp, Hordeum vulgare
cagccacaggccccgactcgagcccgcccgaacccagacaacaccacccgcagtccaaaactcgagagcgaccggaacccaccaccactctctcgcccggaccacgcgccgcaccaaacccgcacagcccatcggcgacctcgccggagaagagagaagaaggtgagagatggaagcggcggcggcggcggccggcgtgcagctgggctcctcgaagccgcagatcgcgacccaggcggagatggcggaggcgcgcctgccgatcccctaccgcgaccagtgcgcccacctcctcatcccgctcaataagtgccgcgtctccgagttctacctcccctggaagtgcgagcccgagcgccactcctacgagaagtgccagtacgagctcgtcatggagcggatgctccagatgcagaagatccgcgaggcgcaggggggcgccaaggtcaagggcagcgtcaccatcggcgtgcccctcgccccttccaccgccaagctcgcctgatccgtcagattcaggatgggttggtcactagagctcgaagggcgctgtgcttgcaaggatcatgaatgttgttcttgtatgaacaaaacatctgtttgaattaactcctgtcttgttcccctccttcctttttctttttcggtgcgagcacctaccgtttttttaaagtttgatgatggaataagggactagatgtctatactcgatgagcgaaatgacaccttggagttttgaaatgcattgcatggatctctgcttatgtagctagatacgttgatgtagtagcgcctcttttataagataccagtatctttgcttatactccgctaaaccttgtgaggtaattgtggcc

SEQ ID NO: 1454 - DNA, 857 bp, Hordeum vulgare
cagccacaggccccgactcgagcccgcccgaacccagacaacaccacccgcagtccaaaactcgagagcgaccggaacccaccaccactctctcgcccggaccacgcgccgcaccaaacccgcacagcccatcggcgacctcgccggagaagagagaagaaggtgagagatggaagcggcggcggcggcggccggcgtgcagctgggctcctcgaagccgcagatcgcgacccaggcggagatggcggaggcgcgcctgccgatcccctaccgcgaccagtgcgcccacctcctcatcccgctcaataagtgccgcgtctccgagttctacctcccctggaagtgcgagcccgagcgccactcctacgagaagtgccagtacgagctcgtcatggagcggatgctccagatgcagaagatccgcgaggcgcaggggggcgccaaggtcaagggcagcgtcaccatcggcgtgcccctcgccccttccaccgccaagctcgcctgatccgtcagattcaggatgggttggtcactagagctcgaagggcgctgtgcttgcaaggatcatgaatgttgttcttgtatgaacaaaacatctgtttgaattaactcctgtcttgttcccctccttcctttttctttttcggtgcgagcacctaccgtttttttaaagtttgatgatggaataagggactagatgtctatactcgatgagcgaaatgacaccttgaagttttgaaatgcattgcatggatctctgcttatgtagctagatacgttgatgtagtagcgcctcttttataagataccagtatctttgcttatactccgctaaaccttgtgaggtaattgtggcc

SEQ ID NO: 1455 - DNA, 626 bp, Pseudoroegneria spicata
caatcccgcacagcccatcggcgacatcgccggagaagagagaaggtgagagatggaagaggcggcggcggcggccggcgtgcagctgggatcctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggggggcgccaaggtcaagggcagcgtcaccatcggcgtgcccctcgccccctccaccgccaagctcgcctgatccgtcagattcaggatgggttggtggctagagctcgaagggcgctgtgcttgcaaggatcatgaatgttgttcttgtatgaacaaaacatctgtttgaattaactcttgtcttgttcccccctgccttttttctcttttggtgcgagcacctaccagttttttaagtttgatgatggaataaggaactagatgtctatactcgatgagtgaaatgacaccttgaagttttgaatgca

SEQ ID NO: 1456 - DNA, 710 bp, Triticum aestivum
  misc_feature (693)..(693): n is a, c, g, or t
accagacgccgcaccgcacccgcacccgcacagcccatcggcgacctcgcccggagaagagagaagaaggtgagagatggaggcggcggcggcggcggccggcgtgcagctgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgccccttgccccctccaccgccaagctcgcctgatccgtcagattcaggatgggttggtcatgggagctcgaaagggcgcggtgcttgcaaggatcatcaatgttgttcttgtatgaacaaaacatgtgttcctgtttgaattaactcccgtcttgtttcctccctgccttttttctccttttggtgcgagcacctaccagttttcttcttgttaagtgtgatgatgcaataaggaactagatgtttatactcgttgagtgaaatgacaccttgaagttttgaatgcatgcatggatgtccgcttatgttcccangggggggccggtaccaa

SEQ ID NO: 1457 - DNA, 770 bp, Triticum aestivum
ccaccactctctcgcccgaaccagacgccgcaccaatcccgcacccgcacagcccatcggcgacctcgccgggagaagagaggagaaggtgagagatggaggcggcggcggcggcggccggcgtgcaactgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgcccctcgccccctccacagccaagctcgcctgatccgtctgattcaggactggttggtgactagagcttgaagggcgctgtgctcgcaaggatcatgaatgttgttcttgtatgaacgaaacatctgtttgaattcggcataaagttaactcttttcttttcttgtacccctctgccttccctccttcggttcaagtttaagtttgatggaataaggaaccagctgtcgtcctatactcgacgagtgaaatgacaagcttgaagttttgaatgcagtgcttggactctgcttatgcatctgccttgatgtagtaggagcctattttacaacatgaatatctctccttacgatctgctgctatattaaccttg

SEQ ID NO: 1458 - DNA, 1158 bp, Triticum aestivum
ctcccagtcgcaggccccgactcgagcccgcccgaacccagaccaacacccacagtccaaaagctccagagcgacgggaacccaccaccactctctcgcccgaaccacgcgccgcaccgagcccgcacccgcacagcccatcggcgacctcgccggagcggagaagagagaagaaggtgagtgatggaagaggcggcggcggcggccggcgtgcagctgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgcccctcgccccctccaccgccaagctcgcctgatccgtcagattcaggaggggttggtggctagagctcgaagggcgctgtgctcgcaaggatcatgaatgttgttcttgtatgaacgaaacatctgtttgaattcggcataaagttaactctttctttcttggtcttgttcccctccgccttccctcctttggttcaagtttaagtttgatggaataaggaaccagctgtcttcctatactctgacgagtgaaatggcaagcttgaagttttgaatgcagtgcatggcctctgcttttgcatctgccttgatgtagtaggagcctattttacaacatgaatatctctccttacgatctgttgctatattaaccttgtgagattactggttattgtggtcacaggttcttccgttcgagccttgtcagcaatgcatcctacgtactgtgggagttgcgattactcgtattgggcggaacagatctaataattcttttattccacttattaagagggatctttaactaagaaatagacctaccagctaaaagagggtatcctgagcaattacaaaaatggggttcattgatattctcgtatagtagatgctatcacatgtacagtcatactcaattcgaggaggatcttttatagtttcacacataagaggat

SEQ ID NO: 1459 - DNA, 1691 bp, Panicum virgatum
tagacacccctgtatcccctttgcctgttggttccagatctggcgacacgctgctgctcatggtcgctagcagcatgccaatatcataagcataatcccaagctgcatccaggttgcagctgccgcctccaccaagcagaagggtaaaagcagctcgttccataggccagtaaaggtaaagctactacccggtggttggcacgtcgcagttgataccgaggtgtaggccgctgcccgccgcacggcgcttctcccccacgtcgccggctccggttccctgacgcggggaatgttggagatggggcgcgcgtccgccgtcgcgctgctcgtcgcgctcgccgtcctcgcgccggcggcgacggcgcagacctgcggggacgagctgccgccagagctcgtcggcaactactcggggctcgcctgcgcccccgtctggaacaacttcgtgctccggtacgcgcagggcaaggacaacgtgctgcgggtggtgctgtcgaccatgtacagcacggggtgggtggggatggggttctccaaggacggcctcatggtgggctcgagcgccatggtggggtggatgggcaagacgggggtcgcccacatcaagcagttctcgctgcagggcaaggtcccctcgcaggtggtcgtggacaagggctccctcgtctccaacgaccacgaccacaccgtgctcgtgcagcaggccaagatctacctcgccttccagctcaggttccccgcgccgctcaagcgccagaacgtgctcctcgccatcggctccgccatccccgtcaacgaccgcctctccgagcaccagagcaagacctccatcaccttcgatttcaccacaggcagctcttcaagcgcttcatccttcccggaaggtctgaaaaggactcatggggcgctcaacttgttcgcgtggggtgtgctcctgccaattggcgccatcgttgcaaggtactgcaggagatgggaccctctgtggttctacctccatgccggcatccagtttgtgggattcatcctgggtctggccggcattgtggctggagtatcattgtacaacaagatccaagccaacgtcccctcgcacaggggcctcggcatatttgtgcttgtgctaggcatcttgcagatcctagcaatcttcctgaggcccaacaaggactccaagtaccgcaaattctggaactggtaccaccactgggtaggccggcttgcgctcttctttgcggcgattaacatcgtcatcgggatcaaggttggcaccgctggcaactcgtggaagatcggctacggtttcaaccttgccatcctcctgatcaccatcatcgccctggaagtcctgctgtggacgaggtggagaaacaacagcggttctacgggggcgtattaaggacgatcagttaggttcttgtgtcatggtataactgaaggaggttcatattctttcgatgtttctgcgtgctatgctgttgctgtagcgttcgtgcgtgctgcggggtcttttgcagcagcaaagatctgcaagatcaatagcctatatgatgactttttttgcccttttggcgtgtaaaagcatgagatggtcagcggacttgtctgtgctcaggcttgccgttccggtgcttttgggatttaggagtgctcgaaatggaaaatgggatggttgcatttccctttgtgtg

SEQ ID NO: 1460 - DNA, 1792 bp, Setaria italica
caccacctccacctccaactcttcagagccaagcacaatcccagaaagctccaaagtagcgcgtgcgcacacatggatcccctttgcctgttggttctagatctagcgacacttgcacgcgggagatgctcgcaaacaccagctcatcgccactagcaacatgccagtatcataagcgtaatcgcaagctgcatccagattgcaggtttgcagccaccacctccaccagcagaccaacccgtagccaactcccaagctaaaggagctcgttccagaggtcactaaagctaacagcggtggttggcacgtcgcagttgatacggaggcgtaggctgcacttctcccacgtcgccgccggctcaggctccctgacgctggagatgggaacggggcgcgcgtccgtcgtcggcgcgctgctcgtggcgctcgccgtcctcgcgccggcggtgacggcgcagacctgcaacgacgagctgccgtcccagcttgtccgcaactactcggggctcgcctgcgcccccgtctggaacagcttcgtgctccggtacgcgcaggacaaggacaatgtgctgcgggtggtgctgtcgaccatgtacagcacggggtgggtggggatggggttctccaagaacggcctcatggtgggctcgagcgccatggttgggtggatgggcaagacgggggtcgcccacatcaagcagttctcgctgcagggcaagaccccctcgcaggtggtcgtggataagggcctcctcgtctccaacgaccacgaccacaccgtgctcgtgcagcaggccaagatctacctcgccttccagctcaggttcaacgagccgctcaagcgccagaacgtcctcctagccttcggctccgccatccccgtcaacgaccgcctctccgagcaccaggacaagacctccatcaccttcgatttcaccacaggcagctcttcaagcgcgtcatccttcccggaaggtctgaaaaggactcacggggcgctcaacttgttcgcgtggggtgtgctcctgccaattggggccatcgtcgcaaggtactgcaggagatgggaccctctgtggttctacctccatgccggcatccagtttgtgggattcatcctgggtctggccggcattgtcgccggagtatcattgtacagcaagatccaagccaacgtcccggcgcacaggggcctcggcatatttgtgcttgtgctaggcatcttgcagattctagcgatcttcctgaggcccaacaaggactccaagtaccgcaaattctggaactggtaccaccactgggtaggccggctggcgctcttctttgctgcgatcaacattgtcctcgggatcaaggtcggcggcgccggcaactcgtggaagatcggctacggtttcaacctggccgtcctcctgatcaccatcatcactatggaagtcctgctgtggacgaggtggagaaacaatagcagttctacggcggcatattagggacgatcggttaggttcttgtgccgtggtaactgcaggaggttcatattctttagatatttttgcgtgctatgctgttgttgtagtgttcgtgcgtgctgcagggtcttttgcagcagctaagatctgccaaggctagtagccttatgatgaccttttggcgtgcaagaccgcaaaatatcatgagacggtctgcgcctctgcggaacttgtatgtgttcaactgttcgtgcttgccgttccggtgcttttgggaattgggaatttgggattgctcaaaatggaatggtgctttgcgcaaa

SEQ ID NO: 1461 - DNA, 945 bp, Saccharum officinarum
cgctctttgccatggcgatggcgacctccactttctccccgcgtccggccactctcaacaagcccctgcgggcgggcgccaagcccgccggcctccacctcatgcccttcccgcgcctccgcgccggccgcctcgtctgcgccaccgccgccggggaggcgccgcccgtcgaggttgagcagcgggacgaggcggagccggcccccgccgcggcctccaacggggccgccgtcaaggacgaggcgcccgccccgaaggccgtgcaggctgaggccccgccggcgccggtcccggccttccgcgacgccaggtgggtcaacggcacctgggacctcaccaagttcgacaagggaggcgtcgtcgactgggacgccgtcatggacgccgaggccaggaggaggaaatggcttgaagattatccagaggcgactagcacagatgaggccgtcgtcttcgacacttcaattattccatggtgggcatggatgaagcgattccaccttcctgaagccgagaagctaaatggtcgcgctgccatggttggcttcttcatggcgtactttgtggatagcttgacgggcgtgggccttgtcgaccaaatgggcaacttcttctgcaaaacgctgctatttgttgctgtcgctggtgtactgctaatcaggaaaaatgaggacattgaatcactgaagaagcttatcgatgagactacgttctatgacaagcaatggcagggaacctggcaagatgattccactaggggaccaaagaattagttcaggttcagcgttggaatacaaatgcagaatgcttcttgtgatgtgttttgtctctttcgtcgggcttttgttttcccgtctagtgaggcttggaggaacattttggacaaaggaataatccggcatcttgaaaatagtatggactcacttttgggctaaagataattac

SEQ ID NO: 1462 - DNA, 3273 bp, Zea mays
cgccagagctctctttcaaaaactagcaaagatggtacaatgtactcaacctcctccccagttaaagctcccagagagtaagatcacagaaccgacagatgatgagaaccaagatttgccaccaaaacctgagaaaaggactaggatgcaccacattgagaggcacagatcttgtgttgtgaccttatctgacatagaacttaatggtctgcaacctcgtcatctgcaccaacccattgagatcagcccaggaggatcacagtgttcgctccatgaagaaacacctacagatactaatgcatcacacaggcatgcaattgcagatgctgcttgggaagccctcaaaaggtcaatggtttacttcagaggccaaccaattggaactgttgccgcaatagacaagtctcagggggcagcactgaactatgaccaggttttcatgagggatttcattcctagcgcattggcttttcttatgaaaggagagcacttgattgtgaagaactttctggtagaaactgcacgccttcagtcaagggagaagatggttgaccttttcaagcttggtcagggtgtgatgcctgcaagctttaaggtgcatcatcgcaaccctactcagaagacagaaagcttactggctgattttggtgaaactgccattgggagggttgctcctgtagattctggcttatggtggattattctccttcgtgcttacaccaaatggacaggggacaattctctggctgaaagtactaactgccaaagggccatgcaccttattctcaggttgtgtctctcagaggggtgtgatacttctccagccttgctttgtgctgatggatgctccatgatagaccgaagaatgggcatatatggctacccaattgaaatccaggctctctttttcatggctatgagatgcgccctgagtctgttgaaacaagagtccgatgctgacttcgtgaaccacatcacaaaaagaatccaagctctgagctaccacttgcacagttactactggttggacttccagagacttaatgacatataccgctacaagaccgaagagtactcacagacagctctgaacaagttcaacgtgatgcccgaatcgatacctgactggatatttgacttcatgcctagccgtggtgggtacttcattggcaacgttagtcccgcgaggatggatttccgctggttctgcctaggcaacttcatcgcgattctgtcgtcgttggctaccggagagcaggctgaagcgatactggatcttgtggaggagcgctggcaagaactcatcggtgagatgccgctcaagatctgttaccctgcgatggaaaatcaggaatggcagatagtcactggatgcgacccgaagaacaccaggtggagctatcacaacggaggctcgtggccagtgctgctgtggctgctggtggcggtgagcgtgaagctggggcggccgcacctggcgcggagagccgtggagctgatggagcagcggctggccaaggacgacttccccgagtactacgacggcaaggccgggcggtacgtggggaagcaggcgcgcaagttccagacgtggtccgtggccggctacctggtggccaagatgctcctggacgacccctctcacctgcgaatcgtggcgctggagggcgacagccactccagggcccccttcctcaagcgctccaactcgtgcccatgacccccaggccccagcacagcacaggccgcatgcattacctttccacgcaccagtttgcccacaccgagactacgagagtaaaaagtttcgtttcgatgcagtgcattcttcttactacataagtatgtataatcaagcggtagtagtgtgatgtgctaccaagaggaggatgacagggacaggataccgagtatgtatgtactgtctccatttgccagatcagatgccactaaactggttaacattttggaatgtcaggggctcacggctagcaatgcgtctggtagctgaggaaatgtaaaaactccatgtgctgatatactgtttcttagacctgacggcatgcggtcctggtgctgataaaaagctattgatattcaccatcttcatgttagcttctgtagctgctggagaagtacacgctggacaggaccggccctgccgccctggtggctacttctccagctggaccccggcctggccctgctggccacacgctatcggctatcctctcccctctatccttttcttcactccccccacacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggtggagccggcctctgccgcggcatccaacgggactgccgttaaggtcgaggcgtccgccgcgaagcccgagtccccgcccgcgcccgcgccggtcccggccttccgcgacgccaggtgggtcaacggcacctgggacctcaccaagttcgacaagggcggcggcgtcgactgggacgccgtcatcgacgccgaggccaggagaaggaaatggctcgaagactacccggaggcgacgagcacagacgatgccgtcgtcttcgacacctccattatcccgtggtgggcatggatgaagcggttccaccttcctgaagccgagaagctaaacggtcgggccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttctacgacaggcagtggcaggctacctggcaagatgacccaaccgaggggccaaagaattagttcggcgttgggggtgcaaacgcagaatgctcgcttcttgtggtgtgtctttgcctctttcttcggcccctttttgtttcaccgtttagtcaggcttggaggaactttttgatgaacgtcataatctatctacgtgatcttgtgcaaaaacaaaaggtatgggagtactttctgtgctagagataataatcatgttgcagtttcactggtttatgctttc

SEQ ID NO: 1463 - DNA, 1038 bp, Zea mays
ggcctggccgcacactctcctctcctgtctatccactttccactccttcactgccctccgtccccccctttgctcgccatggccatggcgacctccaccttctccccgcgtcccgccagcctcaggcccctgcgggcgggcggaaagcccgtcggactcctccccttcccgcgccgcctcgcctgcgccaccgcctccggggaggcgccgcccgtggagcagcgggacgaggcggagccggcccttgccgcggcctccaacggggccgccgtcaagtccgaggccccgccgccgccgcccgcgccagcgccggtcccggccttccgggacgccaggtgggtcaacggcacctgggacctcgccaagttcgacaagggcagcggcgtcgactgggacgccgtcatcgacgccgaggccaggagaaggagatggctcgaagactatccggaggcgactaacacagacgaggctgtcgtcttcgccacttccattattccatggtgggcttggatgaaacgcttccaccttcccgaagccgagaagctaaatggtcgcgccgccatggtcggcttcttcatggcctatttcgtggacagcttgacgggcgcgggcctcgtcgaccagatgggcaacttcttctgcaagacgctgctgttcgccgccgtcgccggcgtgctgctggtcaggaaaaacgaggacgtcgagtcgctgaagaagctcgtcgacgagaccacgttctatgacaggcagtggcaggcgacctggcaagatgactccgctgggggaccaaacaactagttcagcgttgtggtacaaaaaaaatgcaaaacgctttcttgttacgtagcttatctatttcctcggccttcttgttttccctgtgtagtgagaatttttttgtttttgtttttgacaaacgcaatgatctacgtcatgttgtaaaattgtatggaaaataattctgcagtttcagttttttttaaaaaaaaaccgataatattcagacatggaaattgattcacatatcgaccaaagaaa

SEQ ID NO: 1464 - DNA, 1009 bp, Pseudoroegneria spicata
  misc_feature (888)..(888): n is a, c, g, or t
  misc_feature (950)..(950): n is a, c, g, or t
cctccttccgccaatcgatcgtccctctatatcatatcgccgccgcgctgggtggggacgtatcgaaacgatggaggacttcgtgctgagctacgtggtgaccgggctggccttctggtcgacggcgttcctggtgatgcgggcgctgatgccgaagcggtcctacgagttctgcaaccgcgccgtctccaccatgcacgccgtcgccgccgtctgcatggcctgcctctccgtccaggactggtcctgccccgtctgccccctcaacgccccctcctcgccgcgccagatgaagtctctggcggtgacgctgtcgtacatgatctacgacgcggcgtgctgccacctcaacggcgacgtgcggctcgacaacaccgtgcaccacctggtcagcatcgtcggcatcggcgccggcctggcctaccagaggtgcggcacggagatgatggcgtgcatgttcatcacggagatctccagcccgctgctgcacctccgggagatgctcaaggagctcggcgtcaaggacacagacctcaacctcctcgtcgatattctgtttgcggcgaccttttcggtgggacggatggttggtggaccgtacctcacctacgtaaccttgacaacagactaccccatcctcatcaaggcgatggctgcgggtttgcaactggtgagcgcctactggttcttgaggatcctcaggatggtcaggtacaagctcgggaagaagaggccggcggcggcggccaagctcaatgccaagtgatccatccatgtacatacatatcttgcttgcaaccttgagcaaattacttgctttctggcgggatgagatcgatcgatcgtttgtatgtacaaacccgccgtgtttgcgcgattctggctaanagaaaaggatcattcatgtagcattggtaagcatctttcgaacaaaggatgcatatacacgnactgtagcaattcaatttgactcttgtgcagaaacactttccgattactaaaaaaaaaa

SEQ ID NO: 1465 - DNA, 875 bp, Brachypodium distachyon
acacgatggaggagttcgtggtgcggtgggtggcgagcgggttcgcggtgtggtcgacggcgttcgtggcggcgcgggcgctgatgcctcaccgctcctacgagttctgcaaccgggccgtgtcgacggcgcacgccgtgacggcggtgtgcatggcgtgcctctgcgtggaggactggtcctgccccgtgtgcccgctcaacgcgccgtcgacgccgcggcagatgagggcgctggccgtgacgctgtcctacatgatctacgacgccgcctgctgccagctcaacggcgacgtgcggctcgacaacacgctgcaccacctcgtcagcatcgtcggcatcggcgccggcctcgcctaccagaggtgcgggacggagatggtggcgtgcatggtggtcacggagatctccagcccgctgctgcacctccgggagatgctcaaggagctcggcgtcaaggacaccgacctcaacctcctcgtcgacattctgttcgcggtgaccttctcggtggcacggatggtcggtgggccgtacctcacctacgtcaccctcacggccgactacccgttcctcatcaaggcgatggctgctggtctgcaactggtgagcgcctactggttcttgaggatcctcaggatggtcaggtacaagctcgccaagaagaggccggcaccaccggccacgtccaagctcgtcgacggcaagagtagttaactgatcgatgtatgcgtgtgctattctctctaagagagagaagatcatgttgtagtagcgtattgattgtttcacctgccaaggattaattaatttctaaaagggatgcacgtacatactgtggcgattcaatttgattgttgtgcagaaacagtttac

SEQ ID NO: 1466 - DNA, 1431 bp, Zea mays
ctctgaatcatccctctcgcactctcgcgctgcacgtgctctcctccacgggccaccaccacaaaccaaacgcgagcgcgacgcacgcgcgcaaaaagaagatccagcgcagcgagcgcgacgacataatggggcagagccaggggagagcgggcagagccaaaccagagacgcggcacgcgacgcgggagggcgagcagcagcggcggcgcggcgacatcgcgaggccagggccagaagcaacagccgaggaggggcagcagaggcgaccgccgagagtcccggccaccatggacaccttcttcctatcgcacggctcgcccacgctctccatcgacgacagtatcccggcgcggcacttcttcaagtcatgggtgccggcgaaggtcgcgggcgaccagcccccgcgcgccatcctcgtcgtctcgggacactgggagacggccacgccggcggtcaacgtcatccgcggcagcaacgacaccatctacgacttctatggctttcccaagcccatgtaccagctcaagtaccccgctccgggcgctccggacttggccctgcggaccgtagagctcctggagcaagccgggttcggccccgtgaagcaggaccacagccgcgggctcgaccacggcgcctgggtgccgctgatgctcatgtacccggacgccagcatccccgtgtgccagctctcggtgcagaccgaccgcgacggcacgtaccactacaacctcggcaaggcgctggcgcccctgcgggaggaaggcaccctcatcatcggctccggcagcgccacgcacaacctgcgcaagattagcccgtccgacgcgcccgtgccgcagtgggccgccgagttcgacacctggctcaaggactcgcttctcaacggaaggtacgaggacgtgaagcggtacgaggagaaggcgccgcacgcgagggtggcgcacccgtggccggaccacttctacccgctgcacgtcgcgctcggcgccgccggggacggcgcgaaagcggagcagatccaccagtgctggtccaacggcacgctctcctacgcgtcctacaggttcaccaccaacacctgacgcgctgctcgtggtgtcggtggaataccaccgtcccgcccggccagctgctgaattcgggggaagcatccatcgacgggtgtggcactggcagcattgcacatactgtatttctaataaacccccgtgtgcctgccgttccgttcgcggtagatatgcgtttgttattgttttgcattgtttggtgcagcagcttaggctgattgattgcctgcatggtggtgccgggttctcgctggcctagctgaagcgtgcattctatcgagaaacgttttgtttgttaatgtattctatcatcgtttttaagagttgaaggccttcatcaatcccccagtcgaagccc

SEQ ID NO: 1467 - DNA, 1371 bp, Zea mays
accaaacccaatgtttttgaggcgcccgtccaagcatcccatccattctctctcgctgctctgctccccacggaccacggggcaccaccacaaaccagacgcgacgcacgcgcgcaaaatcatccggcggagccagggcggaggcaagccagagacgcggcacgcgacgcgtgagggcgaggagcagcggcagcgcgggcgcggcgacaccgcgaggacagagcgagacgcagcggcggaggaggggcagaggcgagcgccgcctagagtccctgctaccatggacactttcttcctgtcgcacggctcgcccacgctctccatcgacgacaacatcccggcgcggcacttcttcaagtcgtgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccaagcccatgtacaagctcaagtaccccgctccgggcgccccggacctggccctgcggaccaaagggctcctggagcaagccgggttcggccccgtgaaggaggaccacagccgcgggctggaccacggcgcctgggtgccgctgatgctcatgtacccggacgccgacatccccgtgtgccagctgtcggtgcagagcgaccgggacggcgcgtaccactacagcctcggcagggcgctggcgccgctgcgggaggagggcgtcctcgtcctcggctccggcagcgccacgcacaacctgcgcaagatggggccgttcgacgcgcccgtgccgcagtgggccgccgagttcgacgcctggctcaaggactcgctcctcgacggaaggtacgaggacgtgaaccggttcgaggagaaagcgccgcatgggagggtggcgcacccgtggccggaccacttctacccgctgcacgtggcgctcggcgccgccggggacggcgcaaaggcggagcagatccaccagtgctggaccaacgccacgctctcctacgcgtcctacaggttcaccaccaagagctgacgcgcccgtgcagctgtcgggtggaggaccgccacccccctcccccccggggccagctgctgaattcgtgggaagcacatccgtcgacgtgcgcgacagcattcatatacacgcaccgcatgtagaaatgtgtttttctcaataaactcccgagtgccgatcgcggtagatatgtcttgcattgttcaacgcagcagcttgtttcgagaagcattctgttgttaaatctcattccatcatcattgtcttcaagtggtgcatattacggagtacgtgtctttttgcccttctca

SEQ ID NO: 1468 - DNA, 1370 bp, Zea mays
accaaacccaatgtttttgaggcgcccgtccaagcatcccatccattctctctcgctgctctgctccccacggaccacggggcaccaccacaaaccagacgcgacgcacgcgcgcaaaatcatccggcggagccagggcggaggcaagccagagacgcggcacgcgacgcgtgagggcgaggagcagcggcagcgcgggcgcggcgacaccgcgaggacagagcgagacgcagcggcggaggaggggcagaggcgagcgccgcctagagtccctgctaccatggacactttcttcctgtcgcacggctcgcccacgctctccatcgacgacaacatcccggcgcggcacttcttcaagtcgtgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccaagcccatgtacaagctcaagtaccccgctccgggcgccccggacctggccctgcggaccaaagggctcctggagcaagccgggttcggccccgtgaaggaggaccacagccgcgggctggaccacggcgcctgggtgccgctgatgctcatgtacccggacgccgacatccccgtgtgccagctgtcggtgcagagcgaccgggacggcgcgtaccactacagcctcggcagggcgctggcgccgctgcgggaggagggcgtcctcgtcctcggctccggcagcgccacgcacaacctgcgcaagatggggccgttcgacgcgcccgtgccgcagtgggccgccgagttcgacgcctggctcaaggactcgctcctcgacggaaggtacgaggacgtgaaccggttcgaggagaaagcgccgcatgggagggtggcgcacccgtggccggaccacttctacccgctgcacgtggcgctcggcgccgccggggacggcgcaaaggcggagcagatccaccagtgctggaccaacgccacgctctcctacgcgtcctacaggttcaccaccaagagctgacgcgcccgtgcagctgtcgggtggaggaccgccacccccctcccccccggggccagctgctgaattcgtgggaagcacatccgtcgacgtgcgcgacagcattcatatacacgcaccgcatgtagaaatgtgtttttctcaataaactcccgagtgccgatcgcggtagatatgtcttgcattgttcaacgcagcagcttgtttcgagaagcattctgttgttaaatctcattccatcatcattgtcttcaagtggtgcatattacggagtacgtgtctttttgcccttctc

SEQ ID NO: 1469 - DNA, 1104 bp, Panicum virgatum
gattaatggggcagagccaggcccgagctggcagaggcagacccaaaccagacgcgcggcaagcgacgcgggaggaggagaggcagcagcggcgcggcgacatcgcgaggccagacgcaggcgccgaggaggaggagttgcggagaccagcgcacggcccggccatggacaccttcttcctgtcgcacggctcgccgacgctctccatcgacgaggcgatcccggcgcggcacttcttcaagtcgtggctgccggcgcgggtcgcgggggaccggccgccgcgcgccatcctcgtcgtctcgggccactgggagacggccacgccggcggtcaacgtcatccgcggcaccaacgacaccatccacgacttctacggcttccccaagcacatgtaccagctcaagtaccccgcccccggcgccccggacttagccctgcggaccaaggagctcctggagcaagccgggttcggccccgtgaaggaggaccacagccgcgggctggaccacggcgcgtgggtgccgctgatgctcatgtacccggacgccgacatccccgtgtgccagctctcggtgcagaccgaccgcgacggcgcgtaccactacaacctcgggcgggcgctggcgccgctgcgggaggagggcgtcctcgtcctcggctccggcagcgccacgcacaacctgcgcaagatggggcccatggacgcgcccgtgccgcagtgggcggccgagttcgacacctggctcaaggacgcgctcctcagcggaaggtacgatgacgtgaaccggtacgaggagaaggcgccgcacgcgaaggtggcgcacccgtggccggaccacttctacccgctgcacgtcgcgctgggcgccgccggggacagcgtgaaggcagagcagatccaccagagctggaccaacgccacggtctcctacgcttgttacaggttctccacaaataactgacgcccgatcgtgccgttggtagccactaattgctgaatgattgtaaagtgtgaaccatatctatccgtattcatggtatagtataaccaacgcttgtaattgtatacatctgtgtgcaccagacataatgtttgattgtatc

SEQ ID NO: 1470 - DNA, 1353 bp, Saccharum officinarum
cagagacgcggcacgcaacgcgggagggcgaggagggcgaggagcagcggcggcgcggcgacatcgcgaggccagggccagacgcaacggccgaggaggggcagaggcgaccgccgagagtcccggccaccatggacaccttcttcctatcgcacggctcgcccacgctctccatcgacgacaagatcccggcgcggcacttcttcaagtcgtgggtgccggcgaaggtcgcgggcgaccagcccccgcgcgccatcctcgtcgtgtcggggcactgggagacggccacgccggcggtcaacgttatccgcggcagcaacgacaccatctacgacttctatggctttcccaagcccatgtaccagctcaagtaccccgctccaggcgccccggacttggcgctgcggaccaaagagctcctggagcaagccgggtttggccccgtgaaggaggaccacagccgcgggctggaccacggcgcctgggtgccgctgatgctcatgtacccggacgccaacatcccggtgtgccagctgtcggtgcagaccgaccgcgacggcacgtaccactacaacctcggcaaggcgctggcgcccctgcgggaggagggcatcctcatcctcggctccggcagcgccacgcacaacctgcgcaagatgggcccgttcgacgcgcccgtgccgcagtgggtcgccgagttcgacacctggctcaaggactcgcttcttggcggaaggtacgacgacgtgaaccggtacaaagagaaggcaccgtacgggagggtggatcacccgtggccggaccacttttaccctctagacggaagcgctcgggcgccgacggggactcctctgaatgggcgagcacatcgcacctatggtggagcccaacgccaccccgtttacatacgcttgtctgccgggtacaaacggccatcctgtttaaccctccttcttgtttgatgcctggaacctccccctgtcctattattttatattttacggtggaaaacattaagggcacttggtggtgaaataaatattgtttactcccgagtctgtgtggtaccaatgtttcttgatataaaaaaccaactgtttggtggcgattgcacctccccaacgagtaagttgttaattggtatcattatattctccatgcaatcagctaaatccgttttttttcttttagaagtgatatctgagcgtagacgagctttgctatcaatggagggttaattgctgcaagtcgaatgatattatatggattatgcatcacgcataattagggatactctatactgagggatttggtgcaatgtgggtatgaagatagtcgtaacctcctctttcg

SEQ ID NO: 1471 - DNA, 1072 bp, Zea mays
ttctctctcgctgctctgctccccacggaccacggggcaccaccacaaaccagacgcgacgcacgcgcgcaaaatcatccggcggagccagggcggaggcaagccagagacgcggcacgcgacgcgtgagggcgaggagcagcggcagcgcgggcgcggcgacaccgcgaggacagagcgagacgcagcggcggaggaggggcagaggcgagcgccgcctagagtccctgctaccatggacactttcttcctgtcgcacggctcgcccacgctctccatcgacgacaacatcccggcgcggcacttcttcaagtcgtgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccaagcccatgtacaaggtccgctcgatgcctaccaaccaccatgctctggccctgcggaccaaagggctcctggagcaagccgggttcggccccgtgaaggaggaccacagccgcgggctggaccacggcgcctgggtgccgctgatgctcatgtacccggacgccgacatccccgtgtgccagctgtcggtgcagagcgaccgggacggcgcgtaccactacagcctcggcagggcgctggcgccgctgcgggaggagggcgtcctcgtcctcggctccggcagcgccacgcacaacctgcgcaagatggggccgttcgacgcgcccgtgccgcagtgggccgccgagttcgacgcctggctcaaggactcgctcctcgacggaaggtaaagaggacgtgaaccggttcgaggagaaagcgccgcatgggagggtggcgcacccgtggccggaccacttctacccgctgcacgtggcgctcggcgccgccggggacggcgcaaaggcggagcagatccaccagtgctggaccaacgccacgctctcctacgcgtcctacaggttcaccaccaagagctgacgcgcccgtgcagctgtcgggtggaggaccgccacccc

SEQ ID NO: 1472 - DNA, 1212 bp, Panicum virgatum
ccaaaacattttttcagaccaaacgcgacgcacgcgcgcgatagcaagcctagcgggattaatggggcagagccaggcccgagctggcagagggagacccaaaccagacgcgcggcacgcgacgcgggaggaggaggagaggcaggagcggcgcggcgacatcgcgaggccagacgcaggcgccgaggaggaggaggaggagagaccagcgcgcggcccggccatggacaccttcttcctgtcgcacggctcgccgacgctctccatcgacgaggcgatcccggcgcggcacttcttcaagtcgtggctgccggcgcgggtcgcgggggaccggccgccgcgcgccatcctcgtcgtctcgggccactgggagacggccacgccggcggtcaacgtcatccgcggcaccaacgacaccatccacgacttctacggcttccccaagcccatgtaccagctcaagtaccccgcccccggcgccccggacgtggccctgcggaccaaggagctcctggagcgcgccgggttcggccccgtgaaggaggaccacagccgcgggctggaccacggcgcgtgggtgccgctgatgctcatgtacccggccgccgacatccccgtgttccagctctcggtgcagaccgaccgcgacggcgcctaccactacaacctcgggcgggcgctggcgccgctgcgggaggagggcgtcctcgtcctcggctccggcagcgccacccacaacctccgcaagatggggcccatggacgcgcccgtggcacagtgggccgtcgaattcgacgcctggctcaaggacgcgctcctcagcggaaggcacgatgacgtgaaccggtacgaggagaaggcgccgcacgggagggtggcgcacccgtggccggaccacttctacccgctgcacgtcgcgctgggcgccgccggggagggcgcgagggcggagcagatccaccagagctggaccaacgtctcgctctcctacgcttcctacaggttctccgcaaacaactgacggccgggtcgtgccgttggtagctgccaattgctgaatgattgtgaagtgtgaaccatatctaccatccgtggtcgtgtacagtatacgcacgcttgtagcattgtatgcatcagagataatgtttgattgtatcattcagtgaggtggcttattatttcagaaaataagctctctggagtttggcatac

SEQ ID NO: 1473 - DNA, 642 bp, Solanum tuberosum
ctaaatatagtaagttatcaagtaagaaaaaaaaatgggattacaggcttttatacttctaagccttgttttggctatttttgcaattgtaacctcagatgttgctgctagggagttggctgagagctccactactactatggaaaatacaaagaaatctgagaagaaaaatgaggtaaatgatgctaaatatctggaggagattatggaggaggaggataccctggtggtggtcgcggaggttatggagggtatcctggtggtggggttatggagggtatcctggtggtggtggtggtcgtggaggttatggagggtaccctggtggtggtggtggtcgtggacgtggtggaggtggatactgctcctatggttgttgtgaaaggaattactatggtaatggttgcaataggtgttgttactccaaaagtgaagccatgaataaagtcacccaagctaagcctcacaactaaaattactaagttataagcaatatttataagtgtgtgttttagtagtatgtaaaatagttttaatttgttgtgggagtttgaataaaagtagcttccattcacttcatgtggatggatggtcaaatgttatcttttcatttgtacgtacttgctcttttcatatatatgt

SEQ ID NO: 1474 - DNA, 566 bp, Festuca arundinacea
  misc_feature (53)..(53): n is a, c, g, or t
gcacgaggcaatcataaagctagggtttaagcagcctcgccgcctccagatcnccaaaccctcgtcgccgctgcagaatccggagaaggaatcgagagcagagcttgcgagaagtcaacatgttcctaggcgcgctcccgaaaaagcccagcaaggaggcggcgtacaaggagctgcgcacgcacctctacatcatggccggttgtatcgtagccatccgcgcggccccctacatcctccacttcctcaaccgcgagcccgagatgacggagctcaagctcgagctctagggcagtcccgatgcccccgcccccctgaggtgcgactgggatgccccaaccattgccttagttcattgatcactctaaagttactctctggatcgggctttctacgtaccttatgaaacatgaactttttcctgttaggcatccatctttctatagcgtgagatttcagtgacagtgttcgcatgataaactctgttccttactattatcattacccaacaactctgtatttgacgatcaatggtgcatgtctttcatatttatttttgctgggct

SEQ ID NO: 1475 - DNA, 623 bp, Triticum aestivum
gccaccgcaatcgcatcgtgctagggtttaagaaagcagcgtcgccgccttcagatccccaacccaaaccctcgaatccggagaagcagagaggaactcgccgccgacgacagccaagatgtttctcggcgcgatgccccggaagccgagcaaggaggcggcgtacaaggagctgcgcttgcacctcagcatcatggcgggttgcatcgccgtcatccgcgccgccccctacatcctccactacctcacccgcgagcccggcatgacggagctcaagctcgagctctagggcgcttcccccgcccccgccccctgaggtgcgactgggatggtgaagttactctcaggatcaggctttgaagtaccttatgaaacatgaacttagttttccttgatagtgtttcttccttctgtagcgtgagaattcaatgacggtgtttgcataaactctgttggttacaattaccactgccctgacaactttgcggggttttaacagtcagcgatttgttgctttacatatgtatttattatcgctggggtgtgatttgtcgctgctatactgaatttgatccggttgtcctcttttgaagacgcatcagttggatctgtcaaaaaaaaaa

SEQ ID NO: 1476 - DNA, 551 bp, Triticum aestivum
tcgcatcgtcctagggtttaagcagcagcagcagccccgccgcatccagatccccaacccaaaccctcgaacccggagaactcgccgccgacgacagccaagatgtttctaggcgcgatgccccggaagccgagcaaggaggcggcgtacaaggagctgcgcttgcatctcagcatcatggcgggctgcatcgccgtcatccgcgccgccccctacatcctccactacctcacccgcgagcccggcatgacggagctcaagctcgagctctaggtgcgactgggatggtgaagttactctcaggagcagactttgaagtaccttgtcaaacatgaaattagttttccttgttagtatttcgtctttctatagtgtgagaattcaatgacagtgttcgcataaactctgttggttgtggttaccactgccactgccccagcaactttgtgggtttttaacaatcagtgatgcgtgcctcatatatttcattattgctgggatgtgatttgtcgttgctatactgaatgtgtttcggttgttcaaaaaaaaaa

SEQ ID NO: 1477 - DNA, 493 bp, Triticum aestivum
agcagcagcagcagccccgccgcatccagatccccaacccaaaccctcgaacccggagaactcgccgccgacgacagccaagatgtttctaggcgcgatgccccggaagccgagcaaggaggcggcgtacaaggagctgcgcttgcatctcagcatcatggcgggctgcatcgccgtcatccgcgccgccccctacatcctccactacctcacccgcgagcccggcatgacggagctcaagctcgagctctaggtgcgactgggatggtgaagttactctcaggagcagactttgaagtaccttgtcaaacatgaaattagttttccttgttagtatttcgtctttctatagtgtgagaattcaatgacagtgttcgcataaactctgttggttgtggttaccactgccactgccccagcaactttgtgggtttttaacaatcagtgatgcgtgcctcatatatttcattattgctgggatgtgatttgtcgt

SEQ ID NO: 1478 - DNA, 585 bp, Triticum aestivum
agcagcgtcgccgccttcagatccccaacccaaaccctcgaatccggagaagcagagaggaactcgccgccgacgacagccaagatgtttctcggcgcgatgccccggaagccgagcaaggaggcggcgtacaaggagctgcgcttgcacctcagcatcatggcgggttgcatcgccgtcatccgcgccgccccctacatcctccactacctcacccgcgagcccggcatgacggagctcaagctcgagctctagggcgcttcccccgcccccgccccctgaggtgcgactgggatggtgaagttactctcaggatcaggctttgaagtaccttatgaaacatgaacttagttttccttgatagtgtttcttccttctgtagcgtgagaattcaatgacggtgtttgcataaactctgttggttacaattaccactgccctgacaactttgcggggttttaacagtcagcgatttgttgctttacatatgtatttattatcgctggggtgtgatttgtcgctgctatactgaatttgatccggtttcctcttttgaagacgcatcagttggatcgtcaaaaaaaa

SEQ ID NO: 1479 - DNA, 634 bp, Triticum aestivum
agcagcagcagcagcctcgccgcctccagatccccaacccaaaccctcgaaccctcgaatccggagaggaactcgccgccgacgacagccaagatgtttctcggcgcgatgccccggaagccgagcaaggaggcggcgtacaaggagctgcgcttgcacctcagcatcatggcgggctgcatcgccgtcatccgcgccgccccctacatcctccactacctcacccgcgagcccggcatgacggagctcaagctcgagctctagggcggccccgctgcccccccgccccctgaggtgcgactgggatgttgaagttgctctcaggatcaggctttgaagtaccttgtgaaacatgaaattagttttcctttagtatttcgtctttctatagcgtgagaattcaatgacagtgtctgcataaactcggttggtaatgattaccactgccctggcaactttgtggatttttaacagcagcgatgtgtgtcttacatactccctctttatcaactatgactgtcaaaaaacgtcttatattttgatacggagggagtattttttatggctgggatgtgatttgtcgttgctatattgagtgtgctccagttgttccctcttgccactagtagccctg

SEQ ID NO: 1480 - DNA, 621 bp, Triticum aestivum
gcctcgtgccgattcggcactagggtttaagcagcagcagcagcagcctcgccgcctccagatccccaacccaaaccctcgaaccctcgaatccggagaggaactcgccgccgacgacagccaagatgtttctcggcgcgatgccccggaagccgagcaaggaggcggcgtacaaggagctgcgcttgcacctcagcatcatggcgggctgcatcgccgtcatccgcgccgccccctacatcctccactacctcacccgcgagcccggcatgacggagctcaagctcgagctctagggcggccccgctgcccccccgccccctgaggtgcgactgggatgttgaagttgctctcaggatcaggctttgaagtaccttgtgaaacatgaaattagttttcctttagtatttcgtctttctatagcgtgagaattcaatgacagtgtctgcataaactcggttggtaatgattaccactgccctggcaactttgtggatttttaacagcagcgatgtgtgtcttacatactccctctttatcaactatgactgtcaaaaaacgtcttatattttgatacggagggagtattttttatggctgggatgtgatttgtcgttgcta

SEQ ID NO: 1481 - DNA, 539 bp, Avena sativa
cgcaagcataaagctagggtttaagcagcctcgccgcctccagatctctaaaccctcgttcgccgcgggcatccggagaaggaatcgaaagcagagcttgcgaggagtcaacatgttcctaggcgcgctcccgcggaagccgagcaaggaggcggcgtacaaggagctgcgcgcgcacctctacatcatggccggttgcatcgcggccatccgcgccgccccctacgtcctccacttcctaaaccgcgaacccgagatgacggagctcaagttctagggcagtcccgatgcccaccgccccccctgaggtgtgactgggatggaccctagtttgttgatcactacaaagttactgccaggacctggcttctgtgtcccttatgaaacatgaatttagttttttgctgataggcatcaatctttcttttgcgtgaggattcaatgatagtgtttgcataataaactctgttccttgcaattatctttgcccgcaacaactatattggttttgtcgatcagtggtgcatgtctttcatatt

SEQ ID NO: 1482 - DNA, 584 bp, Avena sativa
gaagtttgcagagccatcgcaagcataaagctagggtttaagcagcctcgccgcctccagatctccaaaccctcgtcgccgcggcagaatccggagaaggaatcgaaagcagagcttgcgaggagtcaacatgttcctaggcgcgctcccgcggaagccgagcaaggaggcggcgtacaaggagctgcgcgcgcacctctacatcatggccggttgcatcgcggccatccgcgccgccccctacgtcctccacttcctcaaccgcgaacccgagatgacggagctcaagttctagggcagtcccgatgcccaccgccccccctgaggtgtgactgggatggccctagtttgttgatcactgcaaagttactgtcagggctgggcttctacgtcccttatgaaacatgaatttagttttcgctgataggcatcaatctttcttttgcgcgaggattcaatgatagtgtttgcataataaactctgttccttacaattatctttgccccaatgactatatgggttttgtcgatcagtggtgcgtgtctttcatattcaattttgcttggctatgttatggacttgt

SEQ ID NO: 1483 - DNA, 583 bp, Avena sativa
gaagtttgcagagccatcgcaagcataaagctagggtttaagcagcctcgccgcctccagatctccaaaccctcgtcgccgcggcagaatccggagaaggaatcgaaagcagagcttgcgaggagtcaacatgttcctaggcgcgctcccgcggaagccgagcaaggaggcggcgtacaaggagctgcgcgcgcacctctacatcatggccggttgcatcgcggccatccgcgccgcccctacgtcctccactttctcaaccgcgaacccgagatgacggagctcaagttctagggaagtcccgatgcccaccgccccccctgaggtgtgactgggatggccctagtttgttgatcactgcaaagttactgtcagggctgggcttctacgtcccttatgaaacatgaatttagttttcgctgataggcatcaatctttcttttgcgcgaggattcaatgatagtgtttgcataataaactctgttccttacaattatctttgccccaatgactatatgggttttgtcgatcagtggtgcgtgtctttcatattcaattttgcttggctatgttatggacttgt

SEQ ID NO: 1484 - DNA, 545 bp, Brachypodium distachyon
agggttgtaattgtaatcgatcccgtcctcctccttagccatagtccccaacctagggtttaagcagcctcgccgcctactgagatcgaaaccttcgttgcataggagagatttcggagacggaagcgagagaatcagagcaggagtcaagatgttcctaggcgcgatcccgcggaagccgagcaaggaggcagcgtacaaggagctgcgctcgcacctcatcgtcatggcctcctgcatcgtagccatccgcgccgccccttacatcctccacttcctcacccgcgacgccgacatcaaagagctcaagctcgagctctaggagcgtcccgacgtcctagccctcccccctgaggtttgactgggatggtccaaccatttctttagttccttgaagactgcaaagttaccctcaagattgcgtttctatgtaccttatgaaatatggatttaaatttccctaatggccattttatctttctagaatgtgagaacccaacagtgtacgaataactcaggtagttataattgccgttgccccagca

SEQ ID NO: 1485 - DNA, 498 bp, Secale cereale
cccaacccaaaccctcgaacccggaggggaactcgccgacgacagccaagatgtttctaggcgcgatgtcccggaagcccagcaaggaggcggcgtacaaggagctgcgcctgcacctcggcatcatggggacctgcatcgccctcatccgcgccgccccctacatcctccactacttcaccctcgagcccggcatgacggagctcaagctcgagctctagggcggccccccgcccccccgaggtgaggtgcgactgggatgttgaagttgctctcaggatcaggctttgaagtaccttgtgaaacatgaaattagttttccttgatagtatttcgtctttctaagtttctgtagcatgacaattcaatgacagtgttcccataaactcggttggttacgattaccactgatcttgcaactttgtggttttttaacaatcagcgatgcgtgtcctctgtatcaactatggcattggctataaaggtcttatatttgga

SEQ ID NO: 1486 - DNA, 1050 bp, Triticum aestivum
cgctagaaagatatcggtcgtgctagggtttaagcagcagcagtagcatcctcgccgtctccagatccccaacccaaaccctcgaaccctcgaatccggagaggaactcgccgccgacgacggccaatatgttactcggcgcgatgccccggaagccgagcaaggaggcggggtacaaggagctgcgcttgcacctcagcatcatggaggggtgcatcgccttcatccgcgggggcccctacatcctccactagctcacccgtgagcccggcatgacggagctcaagctcgagctctagggaggacccgctgcccccccgccccctgaggtgcgactgggatgttgaagttgctctcaagatcaggctttgaagtaccttgtgaaacatgacattggttaggctttggaatatcgtctggctatagcgtgagaattcaatgacagcgtctgcataaactcggtgggtagtgattaccagtgccctggcaacttggtgggtttccgggagctgggacgtgtgtctaacatagtcgctcttgatcgacaatgactgtcaggaaacgtctgatatagggatagggtgggagtattggatatggctgggatgtgattggtcctggctatatcgagtgtgatccaattgttccctattgcttcagtccatgttagtgtcctcgtggcccggggggggcgcctctaagttatccctttagggggcaaatcctaaccggtacccggctttcttggtagaaaggggtccgtatatggggtgcccctataaaggacggaagggcccgaccgttttaaaggggtggcactggggaaaacctgccggggtggggaatctttgaggaagggaaacctgggctccggggggggggggcattatttggggcgggccaacctacgcgggggttttgggcgtcctaggggggaattgtaagggttttttaaagggtgatttctggtgtttaaaaaaacctccacattggttacggcggtctttgcgaagcaatttgggcttccgggggggtgggggtattgacaac

SEQ ID NO: 1487 - DNA, 1201 bp, Brachypodium distachyon
cactctgtttctgcagttgcggctggcttcgctatcgcttgttatcccctcccaagtccgtcgcatcctcgtcggcattccggcaagcaccatgacgggcgtggcggtggcggttaccctcctccgccttcctctcgcccgcctgtcctcccatctccgtcccctcccttcccctcccgtcccgccccctcgcctccgtctctccgtcgcccaccgcctcatctcctcgctcctcggccccggccacggcctcgccgtagcagtcgtgtccgaagcggtggccgaggtggatgaagaagagttcgaagcgacggaagagccgcagctggaggcggcgcccccgtccttcgtgctcccgcggctgccgcgacctaagctggacgtgaaggagcggaaggagctggcctcgtacgcgcacggcctcggcaagaagctcaagtcgcagcaggttggtaagggcggcgtcactccctctctcgtatccgccttcagcgacaacctcgagtccaacgagctcctgaagctaaagattcacgggaactgccctggggaactacctgatgtgatattacaacttgaggagtcaactggatccattgctgttgaccaaatcggccgctcggttattctatataggccaagctccagcaagatgaaaaagagggaagaagttgctagaaagagggaagaatttgctagaaatagcacgagatttctcaaatctgaaggtggattcgaagaacatcccagaaacagcacaagcaggagatttgtgaaatctggatcaacatttaggactcaacagaagagaagatcaattgcatccaaggggtcgtcatacagccgaggaaattaatatatgtttttgttcttatctggagtaatcatctaaattttagactaactactcgtataatggatattagtgttaagtttccaccagtaaactatggatacacaggaacgcaccaagtggtggtgatcccttcaaatagaagttctgggttagtgacttagtggatattaacatcatatgccatatggtctacatgctaatctgaagcctgtaatgaaatttgatataactaaactgatgtgtgcatctcacctattccagcaagttaggtgattcatcataagcattcagcctctaatcctctcatctctttcatttggtccttcaaatagtagcatagtagca

SEQ ID NO: 1488 - DNA, 1012 bp, Avena sativa
cctcggcattccgtcgaacaccatgacgagcgtagcggcggcggtcagcctcctccgccttcctctcgcccgcctctcctctcacctcagatccgtcccataactctcccataccgccccctcgcttccgcctctccgcctcacgccgtgccctctcctccctcctcgcgcccgaccgcggcctcgccgtagcggccgtgtccgaggcggtgaccgcggaggacgaggaggagctccaagaggcggaagaacagaaggacgaggccccaacgtccttcgtgctgccgcggctgccacggccgaagctggacgtgaaggagcgcaaggagctggcctcgtacgcccacggcctcggcaagaagctaaagtcgcagcaggtcggcaagggcggggtcacgccctccctcgtcggcgctttctccgacaacctcgagtccaacgagctcctcaagctaaagattcacgggaactgccctggagaactacctgatgtgatactgcaacttgaggagtcaactggatccattgctgttgaccaaatcggccgatcagttattctatataggcctagctccagcaagatgaaaaagagggaagaagttgctagaaacagggaagagtttgcaagaaatagtgcaaggtttggaaaatctgaaaatgcattcggagaacgtcctagaagtagcacaagcaagagattcggaaaatctgggtcaacatttaggactcaacagaagagaggatctggagcatccaagggatcttcatacggacgagggtagcagcataaaaaataaagttgtagcttgttttcgtttattttctggagaaatcatgtaaattttagtccaactaattgcataatggacagtagtgttcagtttgtgccaggaaactatggttccaagcctcatcaaccacatagacaggctaacaccatttcagattgtcgcgattcccttttgttcaaatagaagttctggtttacccacaataaaatctgagatttagc

SEQ ID NO: 1489 - DNA, 1106 bp, Solanum phureja
tacttcaaatttcaaaacaaatgagaacaataatggctaaaaaccaacatgagtccttttctttttcaagaaggtacttcaatttcaagaaaaaagttgaagatgaagagtacgatgatgaagtttacttaaatgatttccactcttcctcgcttagaggcgaggaagagtattttgggatgcattctacagcgaatgcatccacagtaagcaagaaactgtcgcgttcgacagtttctaagcttcgttcggctcttacttttggtaagagccgaacacaaatagggcttgggagtaaagttgttggtactttatttggttatagaagaggacatgttcattttgcatttcaagaagatccaaaattgggcccagcattctttgtagaaatggccactcctacaagtcatttagttagagaaatggcttcaggattggttagaattgcattagaatcagataagaggacagggaaaaaaggggtgaaattgctagaagagccaatttggaggacatattgtaatggtagaaaatgtggctatgcaatgaaaagagaatgtgggcctgatgaatggaagattttgaactctattgggcctgtttcaatgggtgctggagttttaccaagtgatggtgatggaattgggttagaaggtgaattaatgtatatgagggctaaatttgaaagagttgttgggtcaaaagattctgaggccttttacatgatgaatcctgatggtcatggtggtcctgaacttagcctttatttgcttagggtttaaaccgtggcgtcctggtcaacttatgctatctcgactatttcactgagtacctgttatgttcgggttgaattatatatgtattagtatatgatcataagttcttatgaagacataagaagttagttttttatgatgagtttggaaggagggaatatggtataattatgtatttttggtttgttttaatgtacttttagggtatggggaaaacaaattaaagatatggaggggggtgtgaactatatatgtagagactatgtttttctagttttgttgaagtgaaagataatgaagtaaactttggtactctcttttttctataag

SEQ ID NO: 1490 - DNA, 1081 bp, Theobroma cacao
aataagcaaagataattggtgtccacaattattcggatatattccttgaagctcaaaaaattgtggagtaaagaaacaagaaaatggcaggaggatccaagtcaaatccaccgaagccaaggaagagagtggacgctgcttcaaccgctgcccctgcctcctctctcgtccgcgccaaagatggcagtgcttttgccaaatgtgaagagtgtaacaaaactgtaccagtggctcttattagtatgcatagctgtagccttgatgccaagatcaaaatgaatttggaggctcaagtcattgagaagcctgctgaagttaagaagaaacctgcagaaaggaagaagccagcatcaacagaatcaaatccaaaaaaaccgaagaagttgaagaagggcaaggatcccaatgccccaaaacgtcctcctaccgccttcttcttgttcatggatgacttcagaaaatcttataaggaagctaatccagatgcaaagggcgttacaggggttgcaaaggaagggggtgagaaatggaagtccatgtcagaagaagaaaagaagccttatgttgataaagctgctgagcttaaagcggagtatgagaaggcattggaggaggttaacgatgctgacaatgaaaatgaggatggggaaggaggtccagagaaggacacggctgctgctgaaaaggaagcagaagaagtattagatgattattaattggtggcataatttattcccaagaatttcttgttcatattttggtgggggtgttgtaaatttttgaatctcctttttgaggcgataaattctagtaggtgtctgcatatgttgagaatcatcttgcttcctatcttttctaatcatgttgtactgtcttcttccacatgtgaaggctgaggcaggttctttaaagtaaagttcatgacttagcagtagtaatgataacaaaaattgatctttagaggtggtccttaaattttcttgtgtctacatttctgaagacaagttttttctgagtactgaatttgtctccatggaatggttatgcaagctggtagtaaaaaaaaaagagaactttgctt

SEQ ID NO: 1491 - DNA, 1082 bp, Solanum phureja
aagcaaaatgatgtcgctgcgttgagcaaatgagtagtgtaatgttatcttcttcctcttcctccatggctctccatcgcctgctccgacccgctcccatcctttctttctccttccttaagcaatctctctctcttttcccccatcaaacgacgtcacttcatcccatcaccaacaattctccttccttcttcccctctcttcggacccatacatcaatcttccttcgttctagaactttctcgaaccttccaattagctgtacttctcaagctctcttggaatcttctgaggatgtggaagacgaggaaattgtaaaagaaaatgaagaagttactgcccccaggcctagtgagtctgagagaaaaatattaagggcgaaattgccgaacctgactgtgaaggagaagaaagaattggcatcgtatgcacatagtttagggaagaagctaaagagccaacaggttggcaaatctggtgttactgatactgtggtaatggctttagaggagactcttgaagctaatgagcttctcaagctcaaaatacatggtacctgtcccggaggagagctggatgatgttgtaaagcatttggaggaagcaactggctcagtggttgttggtcaaattggtaggactgtgattctctaccgtccaagcctgacaaaaatgaaagctgaagagaagaagaaacaggctcaaattctttttttgaaaaaacaaaaacaatatgcagagaggcgatcatttcaggataaaggaccggtacctagatcatatgctcgtagtcgccgaggaagtagcagggtttgatctttcattgtggctcatttattaatttcctttccgcagtagccaccacaatactcccatggctcattgtaagggaatagtggaccctattcatgggtccttgatgccttaattttttacagtctcgtaatcatagttctgactttttgtggtcactgcactgggcaaaccccatcattctatttatgtttgtttagttgatgtaactttagacgaatcacacgcttcaaagtaattatatgtcaaatactgcacagcttattaaca

SEQ ID NO: 1492 - DNA, 1078 bp, Capsicum annuum
tagtcataattatgattacgaatgtctaaatttaataataaaggattcagagtcaaaactgatttctttcttctagatcgtctgacatcccacgaaaattacaaaaggtacaaatgcaaacttctagactagactagatatttcatatgcagtctctttgtccctctgatcttcacaccttcagtgtgcatctgtctgagggaataattgcgaaattttaacccagacatgggagctctgtggtggttactgtagaaaggaaatgaagaaatggaccacaatgaaagatcaaaccctgctaattccttggcgaccacgagcatatggtcttggcacttgtcctttatcctgaaatgatcgtctctcagcgtattgcttttgttttttcatataaagactttgagcctgtttcttcttctcttcagctttcatttttgtcaggctcggacggtagagaatcacagtcctacctatttgaccaacaaccactgagccagttgcttcctctaaatgctttacaatatcatccagctctcctccaggacaagtaccatgtattttgagcttgagaagctcattagcttcaagagtctcatccaaagccattaccacagtgtcagtaacaccagattttccaacctgttgactctttagcttcttccctaaactgtgtgcatacgatgccaattccttcttctccttcatactcaggttcggcaacttcgctctcaatatttttctctcagattcactcggcctggaagcactctctcctccaatttcttctgcaatttcctcgtcatcgacagaggactccactagggcttgagaagtacagctaactggaaggttcgagaaagttctagaaggaaggaagatggatgtatgggtaggaagggaggggaatatgggatgaagcgacgtcgtttgatggggaggaaaagagagagattgtttaaggaaggagaaagagagaatgggcatgggtacgggtacgggtcggagcaggcgatggagagccatggaggaagaagataacattacagtatccattttgccctttcagattgcctcgtgc

SEQ ID NO: 1493 - DNA, 963 bp, Brachypodium distachyon
gatagcaatgagcaccggcggcgaggaggcgctgaggctgcagtacgtggtgggcgacgagatcgggcgcggccgcttcggcaccgtccgccgctgccactccgccgccacgggggaggccttcgccgtcaagtccacggccaaggcgcctctgctggacccgctagacctggcgctcgccgagcaggagcccaaggtgcacctcctggtctcctccccgccgtgcagccgccacgtggtcgcgctccacgccgccttcgaggacgcccacgccgtgcacctcgtgctcgacctctgcgcgggcggggacctcctctccctcctctccgcgcgcggcggccgcctcccggagcgcgaggcggcggggctcgccgcgcagctggccgcggcgctcgccgcctgccaccgccgcggggtcgcgcaccgcgacgtcaagccggacaacctcctcttcgacgcggccggcgcgctgaagctcgccgacttcgggtccgcggagtggttcggggacgggcgggccatgacggggctggtggggacgccctactacgtggcgcccgaggtggtggccgggagggagtacggcgagaaggtggacgtgtggagcgccggggtggtgctctacgtgatgctctccgggacggtgcccttctacggcgccacggcaccggagatcttcgagtccgtgctccggggcaacctgcgcttcccgccgcgcgccttcgcctccgtctcgcccgaggccaaagacctcatgcgccgcatgctctgcaaggacgtctccagaagattctccgccgaccaagtcctgaggcatccatggattgcgagccgtgggggggacgcggtggctgactgaagtcaatctgagacatggctgctgcatgcactcctccatccatctgtagatagatcttcttcagttccagttcagagacgacgacccttctgctgtcaaatcct

SEQ ID NO: 1494 - DNA, 956 bp, Hordeum vulgare
acccgcaccgcacatcacagccgcccccaacaacagaggccaggccagaccagaccagaccggaccatggtttacggcggagaggaggcgctgatgcggcagtactccattggcgacgagatcgggcgcagccgcttcgggacggtccgccgctgccactccaacgccacgggggaggcgctggccctgaagaccacgcccaaggcgccgctgcgtgacccgctcgacttggcgctcgcggagcaggagcccaagctgcacctcctcgcctcctccccgccctgcagcccgcacctggtcgcgctccacgccgccttcgacgacgcgaacgccgtccacctcgtcgtcgacctctgcgccggcggggacctcctctcgctcgtctccgcccgcggcggccgcctccccgagcgcgaggccgtcgggctggccgcgcagctcgcgtccgcgctcgccgcctgccaccgccgcggggtcgcgcaccgcgacgtcaagcccgacaacctcctcttcgacgccgccacgagcgtgctcaagctcgccgactttggctccgcggagtggttcggggacgggcggcccatgtcgggcctcgtcggcacgccatactacgtggcgcccgaggtggtcgcctggagggagtacggggagaaggtggacgtgtggagcgccggggtggtgctttacatgatgctctcgggggccgtgcccttctacggcgccaccgcgcccgagatcttcgaggccgtgctccgcggcaacctgcgcttcccgccgcgcgccttcgccggcgtctcgcccgaggccaaggacctgatgcgccgcatgctctgcaaggacgtctcccgcaggttctccaccgaacaagtccttaaggcatcccgtgggatcgcgagcctgttgccggggaatgcggtcttgcggggcttgaagcagaatcgattggaaccaaacat

SEQ ID NO: 1495 - DNA, 1324 bp, Oryza sativa
aggcgaggcggccgcggcgtcggagaccagcggagacagaagaaggggggagaagagaatcgcggagatagcatgagcagcggcggcgagctcgcgctgaggcaggagtacgtcatcggcgacgagatcgggcgcggccgcttcggcaccgtccgccgctgctacgccgtcgccacgggggaggcgttcgcggtcaagtccacgcccaaggcgccgctgcgggaggcggaggcggcggacgcgctcgacctcgcgctcgcggagcaggagcccaaggtgcacctcgtcgcgtcggcgccggggcccggggccagcccgcacgtcgtcgcgctccacgccgccttcgaggacgacgccgcggtgcacctcgtggtcgacctctgcgcgggcggggacctcctctccctcgtctcctcccgcggccgcctcccggagcacgaggccgcggacctcgtggcgcaactggcctccgcgctcgcgtcctgccaccgccgcggggtagcgcaccgcgacgtgaagcccgacaacctcctgttcgacggcggcggcgtgctcaagctcggcgacttcgggtcggcggggtggttcggggacgggaggccgatgacggggctggtcgggacgccctactacgtggcgccggaggtggtggccgggagggagtacggcgagaaggtggacgtgtggagcgccggggtggtgctctacatgatgctctccgggaccctgcccttctacggcgccaccgccgcggaggtcttccagtgcgtgctccgcggcaacctccgcttcccgccgcgcgcgttcgcctccgtctcgccggaggccaaggacctgatgcgccgcatgctctgcaaggacgtctccagaaggttctccgccgaccaagtcctgaggcatccttggatcgtgagccgtgggggagccgcggtgatgggctagttcgttcgatcgaggatgatgatgaactccatccatgtgtagatagcttttcttcaggcgaaggactcgtctgctagctgtgaattttggcttggattagtggcagggttcagtggtagtagcgtattattagtgtttgtgtccagtaggagttaggaccatgacgagctctggtgaattggctggaatttgggagctagctatatctttctacccgagtttgtccgatgtacatacagtgatcagttgatcaccttttggctgaactgaagaagagggtagtctctcttagtgcgtagcaggcttgttcagatgaaaattgaatccaaaaacatgagaaaatttctgtgaattgctgcagttcacctatgcatatttccat

SEQ ID NO: 1496 - DNA, 1621 bp, Zea mays
ggacccggcggctagcaggaggacggagtcgaacatcttgacgatgcgcgctcccggctggtggatgctgagcagcacggtgcgttcgcgcgcctcggccatggcgcggagcgcgccgacgatgtggagcgcggaggcgctgtcgaggccggaggtgggctcgtcgagggttgcgcaggaaggaagagaagaggagaaaagaacaacggctgctagtagagaggtaacggatgtagacgacgtgagtatccatggttttaatcaaagaggttaccaagtaatagagtgctcttgttcgttttagcgagtggtctattccctgctttttcatatcagctaatccctcgcctacgcctccaaaacgtcgaagccgcacgtgaggatctccataatagcaaatttctctagggggagcaggggctgagagagggctgcggagcaaggaatcaaggacgagccgccgagaggactagggtttagccatggcggccgaggaccagactccttgtaccaagctccgccccggcaaggcaaagacgcggaagaagacgaagagggacaagtggggccagcctatctccgccgccgccgccgatgaggagccgtcggtggagccggagcaagagcacccggcgggggtagttgaggcggcagtacaggtggagaaggaggaggaggaagaggcgactgcggcggcggaaggctatgagcccgggaaggtggtggcgagcggcttgccctacacgaccaccgaggcggacatccggaagctgttcgagttctacgggcccatccagtcgatgcagctctctcgcttcccggactccggcaacttccgcggccttgccttcctctgcttcgagtcagaagaagatgcaataaagtctcttgagcttgatggattcaaaattggcagcagatacatgagggttgaaaggtgcagggtgacggccacctcaaacaagaagaggaaggcagagttcgaaaccgaccccaagaagtccgaaggctgcctctcggcatatgttggcaacctctcatggaacgtggacgaaaacgacttgcgaggtttcttcgggccgtcgaagattgcatcggtaaggtttgccgtcgacaaaagaaccgggggttcccgtggcttctgccatgtcgaatttcaagacgacgagtcgctcgagaaggccatagcgatgaaccagtcgaaactgcagggcaggcctgtcaaagtggcgtattcagtcagcaaccggggctgaagagcgccgccccgtcgccagcggttatagtaccagtgaacttgtagtgttatggtttccgctccttcagtttcggttaggctttacggtgtggctaccagcagtaccagtgtgagcttgtagtgagacggtttcgctccctcagttttggcttaagcttttttttcgccgctttgaaacaaggtttttgagatcagttccatgacgccagttcttggcaccaaacatatggcaaaatgtaaacccctctgtaacgagtaccgagttgtcgttaagcctgtatcccagcccgtctcatggttttgtatcttgaatggatgtttccgtcaggtgtctcctcttgaaatggtcaggagcacatgaaa

SEQ ID NO: 1497 - DNA, 1228 bp, Zea mays
ataatagcaaatttctctagggggagcaggggctgagagagggctgcggagcaaggaatcaaggacgagccgccgagaggactagggtttagccatggcggccgaggaccagactccttgtaccaagctccgccccggcaaggcaaagacgcggaagaagacgaagagggacaagtggggccagcctatctccgccgccgccgccgatgaggagccgtcggtggagccggagcaagagcacccggcgggggtagttgaggcggcagtacaggtggagaaggaggaggaggaagaggcgactgcggcggcggaaggctatgagcccgggaaggtggtggcgagcggcttgccctacacgaccaccgaggcggacatccggaagctgttcgagttctacgggcccatccagtcgatgcagctctctcgcttcccggactccggcaacttccgcggccttgccttcctctgcttcgagtcagaagaagatgcaataaagtctcttgagcttgatggattcaaaattggcagcagatacatgagggttgaaaggtgcagggtgacggccacctcaaacaagaagaggaaggcagagttcgaaaccgaccccaagaagtccgaaggctgcctctcggcatatgttggcaacctctcatggaacgtggacgaaaacgacttgcgaggtttcttcgggccgtcgaagattgcatcggtaaggtttgccgtcgacaaaagaaccgggggttcccgtggcttctgccatgtcgaatttcaagacgacgagtcgctcgagaaggccatagcgatgaaccagtcgaaactgcagggcaggcctgtcaaagtggcgtattcagtcagcaaccggggctgaagagcgccgccccgtcgccagcggttatagtaccagtgaacttgtagtgttatggtttccgctccttcagtttcggttaggctttacggtgtggctaccagcagtaccagtgtgagcttgtagtgagacggtttcgctccctcagttttggcttaagcttttttttcgccgctttgaaacaaggtttttgagatcagttccatgacgccagttcttggcaccaaacatatggcaaaatgtaaacccctctgtaacgagtaccgagttgtcgttaagcctgtatcccagcccgtctcatggttttgtatcttgaatggatgtttccgtcaggtgtctcctcttgaaatggtcaggagcaca

SEQ ID NO: 1498 - DNA, 1231 bp, Setaria italica
tttgagaattggtagctcaacgctctgcctcgaagcggaaaaccctagttgcggctgcggcgtaaggcaaaagaaagggcgaagggacctagggtttagtcatggcggcggaggagcatgctccttgtaccaagccccgccccgataaggctatgaagcggaagaagcccaagaaggacaagtggggccagcctctctccgccgccgcggccgaggaagatccgtcggtggagccggagcaagagccaccggcggtaggcgcggaggagtcggcggcggcggcggcggcggcggcaggcgcggaggagtcggaggcggcggcggcagcggagggctatgagcccggcaaggtggtggcgagcggcatgccctacacgaccaccgaggtggacatccggaagctgttcgagttctacggccccctccggtcggtgcagctctctcgcttcccggattccggcaacttccgcggcctcgccttcgtctgcttcgagtcagacgaagatgcagtgaagtctattgagcttgatggattcaaaattggtaacagatatatgagggttgaaagatgcagggttactgctagctcaaataagaaaaggaaggcagagttccaaactgaccctgagaagtctgtgggctgcctgtccgcatatgttggcaatctctcatggaatgttacagaaaaggacttgcgagctttcttcaagtcatcgaagattgcgtcgatgcgatttgccattgataaaagaaccggcagttctcgtggcttctgccatgttgattttgaagatgatgagtcgcttgagaaagctgtagcaatgaatcagtctgaactgcaaggcagacctgtgaaagttgcatattcagtcagtaacaggggctgaggagtgaagagaacccatcgtcaaatttttgtactagtgagcttgtagtgttatagttttgctacctcggtgtggtaaagcttttcgttgattgatctaagattctggagtcaaacatgtggcaaatgtaatccttatgcaacaaatacttagcggttgtaccgacctctctcagttcgttggctttcttcttcatccgaagtactgaacaaatattgcactgcacaaggatgatgacagttgggaaactactgatataacagtatgggtttagcaagcttttgtccctgaatgaatgatttcgtaaggtgctgtgcttgtttgcaggacatattacttttctg

SEQ ID NO: 1499 - DNA, 1766 bp, Theobroma cacao
aagcagcaatccgaggagccaaaggtagcagcaaagaggcaaaaggcttcttttggcttttgccactctccaaaggatcatttatactaatcaaattcaccacatccttgtttctttcatgttcatttcttctttctctgaaacccctttaaatcactcagccgtacacacaagacaagcgaaaaaagcaagacccaacccctatttctcttcaccctcgctttctttgctcttctgaccatctctatctcatctcatcatggctcattctgctgtatcccaggtttctgtagctgttcccattggaagcgatatttctctaaggagatctgtatccaagaggaacagtataagctttggtgacaagtcatgggtttccaccttatctttggatttaaaatcacgaaatatacagaagagcaatcagtacatagtatgcatgtcagtgcaacaagccagcaaatccaaggttgcagtttcacctttagagttggaaaatgcaaaagagccccctctaaatttattcaagcccaaggaaccttacacagctaccattgtttctgtggagagacttgtcggtccaaaagctccgggtgagacttgccatattgtgattgaccatggtggaaatgtaccctactgggaagggcagagctacggtgttatccctcctggtgaaaatccgaagaaaccagggtctccccacaatgttcgtctgtattccattgcctcaaccaggtacggagattcttttgatgggaagacagccagtttgtgtgttcgtcgtgctgtctattatgaccctgagactggaaaggaggatcattcaaagaatggtgtatgtagcaatttcctatgcaacaccaagccaggagataaagttcagataactggtccctctggcaagataatgcttttgcctgaagataacccaaatgccaaccacataatgatagctactggcactggtgtagctccattcagaggctacctacggcgcatgttcatggaagatgttacattcaagttccgtggccttgcatggcttttccttggggtagccaacgctgacagtctcctttatgatgatgagtttaccaaataccttcaggacttcccagatcacttccgatatgatggagctcttagtagagagcagaagaacaagagtgggggcaagatgtatgttcaggataagatcgaggaatacagtgatgaaattttcaagctcttggatgatggagcccatatatatttctgtgggctcaagggaatgatgcccgggatccaagaaacactgaaaagagttgctgagaagagaggagagaattgggatgagaagctttcacaactcaagaagaagaaacaatggcacgtagaagtatattagttttgcaggactgtactcaagttatgccctgtctttaaagagatgcggcagtgtagccatggtagacaatttggcatttttcatttaatcggaccttggatttcgctgtcagcatacatttgtatgattaaataatcgagccagttgcgtgatttatacaaaattagaaaacctctccattgatgattgttgagtttcatttcatcttggctacttgtgtttgggttgtttcttcttttcattcttattgttgaatgccatccaaaaagggtccggtcagaactatctccttttggacttatggaatacaaccaggccgtgcttggtgaatgttatatatattgctagattggcttaataaattactggttaaatt

SEQ ID NO: 1500 - DNA, 1461 bp, Castanea mollissima
cagagtcacagctcaaagtgttgtcagcttataaaactactattgacaacacttctcattctcaaagtgttctctcagctttctctcaaacctctctaaattgatctcatcaatggctcaattggccgcatctcaggttgctgttactgttcctgttggaagcgatttgtccactaggagatctgtgtttaagactcatagcataagctttcatgataaatcatgggcgccttccttatcattggatttaaaaacgaagaatgcacggttgagaaatcgacccataatatgccaatcagtgcaacaaactagtgtacctaaagttaatgtttcccctttataccttgaaaatgctaaagagcccccactaaatatacacaagcctaaggaaccttatacagcaaccattgtttctgtggagaggattgttggccctaaagcccctggagagacttgccatattgtgattgatcatggtggcaatgttccatactgggaaggacagagttatggtataattcctcctggtgaaaacccaaagaaaccagggagtccacacaatgttcgtttgtactcaattgcctccactaggtatggagacacttttgatggcaaaacagccagcttttgcgttcgtcgtgctgtttattatgaccctgagactggaaaggaggatccttccaagaatggtgtatgcagcaattttttatgcaactcaaagcctggagatagagttagggtcacaggtccctctggcaagataatgcttttgcctgaagacaacccaaatgccacccacataatgattgctactggaactggcgttgctccatatagaggttatcttcgtcgtatgttcatggagtctgttcctacattcaagttcaatggtcttgcttggctgttccttggggttgccaattctgacagtctcctctacgatgatgaatttaaaaagtatcttaaggactatccaaataacttccgctatgacctggcccttagtagagagcaaaagagtaagagtggaggcaagatgtatgttcaggacaagattgaggaatacagtgatgaaattttcaaactgttggatactggtgcccacatttatttctgtggtcttaagggaatgatgcctgggatccaagaaacgcttaagagagttgcagaccaacgaggggagaattgggaagagaagctctcacagctcaaaaagaacaaacaatggcatgttgaggtctactaagcttgatgctatgacttcctgtttcatgaaaattgcatcagccttttgatgttaggtaactttttattttatttgatttttattgatcagttttttagatgaggagcttgaatggtagttatcatttttctgtgttattaaatgacaaataaggcaagtttgattcccttgtttaatacaaattaagaagccctttcaatgggattcttgcagaa

SEQ ID NO: 1501 - DNA, 1753 bp, Fragaria vesca
aatcataaaatctctattcatattataaatttttttcatataaaactttgagcagaaatatctgaatcaagtttttacatgtacagttgttagtttgtaattgtaactgcaacactaaaaccctccaaatgccaaggggtcactggctaaacagagaatcaattaaattaaatattattccaattggtcagctagacttccaagtctagagagagtcccaggagccaaacccaaatcaaaacccgtcctttcgaccactccgaaggatcactctcacacccatttcctcttctcagtcgattttgcatgatctaagtttccccaactcctcctatatttaactccctcttcatcacccaaaaaccattcttgatccaatcatgtctcacttgatggctctctctcaggtttcacttggtgctactgtttctgttggaagtgatgcatctcttagaagatctgtgttcaaggcacaaaacgtaaactttagtgacaaatcatgggcacctgttttaccattggacttgaaaacaaagagcgggaggctaagaaacaagagtgttgtatgcatgtcagtgcaacaagcaagtgcaccaaaagttgctgtgtctcccttagaacttgacaatgctacagaacccccgttgaacatatacaagcctaaggaaccttataccgcaaccattgtttctgttgagaggattgtaggcccgaaggctcctggagaaacttgccatatagtgattgatcatggtggtaatgttccctattgggagggacaaagttatggtgtaattcctcctggtgaaaacccaaagaaacctggggctccaaacaatgttcgtctttactccattgcatcaacaaggtatggggactattttgatggcaagacaactagtttgtgtgtccgtcgtgctgtttattatgacccagagaccgggaaggaggatccctccaaaaatggagtatgcagcaactatttatgcaactctaaacccggagacaaaattaagatcacaggtcctgctggcaagatcatgctcctgcctgaagacaacccaaatgccacccacattatgattgccaccggcactggtgttgctccatacagaggctaccttcgtcgtatgttcatggaagctgttcctacattcaaatttggtggccttgcatggctgtttcttggagtggccaataccgacagcctcctctatgatgaagaattcagcaagtatcttaaggactaccctgataatttccgatacgatatagcacttagtagagaacataagaacaagagaggaggaaagatgtatgttcaagataaaattgaagaatacagtgatgagatctttaaactcttggatggtggggcacatatctacttttgtgggctcaagggtatgatgcctggaattcaagaaaccttgaagagggttgcagaagaaagaggggaaagttgggaggagaagctttcacaactgaaaaagaacaagcagtggcatgttgaagtttactgatgaactggaactgcaatactcatttgtgcatctcaaggtcaccattttctgcagtcgagaaaggactcaactgaagtttaggggcataaacctgctagctaactcaccggccaattccaaatgaaaagtggcaaatgatctggaaaggaatatcataatgaccctttcccaaacagaagccaaagggggaggccattgattgctatgttacagatctgagacaattgtga

SEQ ID NO: 1502 - DNA, 1838 bp, Medicago truncatula
ttgcataataatcagattattggagttaagaattccaagttggcgaagactactacactccgagaagccaaagggaagaacaagaacccgacctttccctctctcgaaaggatcaatcaacaaaacaaactgtgatttgaattgtcttgtgttacctcgttactactgctatatattcatcaaccaacttctcttcctctttctctctattcaatcacttctcatcatcaatcatgtctcacttgtcagcttctcagatggctgttactgttcctgttagcaatgatttctccgccagaagatctgtgtttaaggcatctaacataaactttcgggataaatcatgggcacctgtgtttgctttggacatgaaagcaaagaactgtggttggaggagaaatcagaatgtgatttgcatgtcagtgcaacaagcaagtgtgcccaaagttgctgtctcccctttagaattggaaaatcctgctgagcctccattgaacctacacaagcctaaagaaccctatacggcaacaattgtttccgttgaaagattagtgggaccaaaggctcctggggaaacttgtcatgttgtgatcaatcatgatggaaatgttccctactgggagggacagagttatggtgttattccaccaggtgaaaatccaaaaaaaccgggagccccgcataatgttcgactatattcaattgcttccacaaggtatggagacttttttgatggaaaaacagccagcttgtgtgtgcgccgtgctgtttattatgatcccgaaacaggaaaggaagatccttccaagaatggtgtctgtagcaattttttgtgtgactcaaagcctggagacaaaattaagatcacaggcccctcagggaagataatgcttttgccagaggacgacccaaatgctacccatataatgattgccaccggcaccggtgttgctccatatagaggctatcttcgtcgaatgttcatggaatcagtccctacattcaagttcggaggactagcatggctcttcctcggtgttgcaaattccgatagtcttctctacgacgacgagttcaccaaataccttaaggattatccagagaacttccggtacgaccgagccctcagcagagaggagaagaacaggaatggcggcaaaatgtatgttcaggataagatcgaggaatatagcgatgaaatctttaagctcttggataatggagctcacatctatttctgtggtctgaaaggaatgatgcctgggatccaagaaacactgaaaagggttgctgagaacagaggagaaagttgggaagagaagctttcacaactcaagaagaacaaacaatggcatgttgaagtctactgatatgtgtttgttttgtcttgcagaagaaaaagacaaaattgttagcattttcattagaaattattttgattaataaactttcattaagcagcttgagtagctgtatctgttctgtattggtagattataatgatgtattgttttcttgatggatgcaacatttgaaaatttaagtcattagcagtgctagagacatatgtttggggtaatttttatttttttttaattaagggaagcaacatgttttctgttgccacatcttgaattatcttgttaaacaacaaggcttcttcttgtccagtagaatttgagcatgacctatagaatgatatcaaaaagtgtgaaattgcgaggcttgagaacctgaatgatgaaagcatgtttgagcttcttggtgatgttggacttgaagactattttctgtttctaagtcatccttttaaaaagattttctcagttactttttcc

SEQ ID NO: 1503 - DNA, 1385 bp, Pisum sativum
cccgggcaggtgatcacactccttttcaccatgtctcatttggctgtgtctcagatggctgtaactgttcctgtcagcagtgatttctccgtcagaagatctgcgtttaagtcgtcaaacttaaactttcgggataaatcatgggcaccagtatttacgttgggcatgaaagctaagaactgtggttggagaaatcacaatgtgatttgcatgtcagtgcaacaagcaagtgtgccgaaagttaccgtttcccctttggaattggaaaatccttctgaacctcccttgaacttacacaagcctaaagagccttatacagcaaccattgtttccgtcgaaagattagtaggaccaaaggctcctggggaaacttgtcatattgtgatcaatcatgatggaaatgttccttactgggagggacagagttacggtgttattccaccaggtgaaaatccaaaaaaacccgggtctccccataatgttcgactatattcaattgcttccacgaggtatggagacaattttgatggcaaaacagccagtttgtgtgtgcgtcgtgctgtttattatgatcccgtgacagggaaggaagatccttcaaagaatggtgtttgtagcaattttttgtgtgactcaaagcctggagacaaaattaagatcgcaggcccctcagggaagataatgcttttgccagaggacgacccaaatgctacccatataatgattgccactggcactggcgttgctccatatagaggctatcttcgtcgaatgttcatggaatcagttccaacattcaagtttggtgggctagcatggctcttccttggtgttgcaaatgtcgatagtctcctctacgacgacgagtttaccaaataccttaaggattacccggacaacttccggtacaaccgagcactcagcagagaggaaaagaacaagaacggcggcaaaatgtacgtgcaagataagattgaggaatatagcgatgaaatcttcaaactcttggataatggagcacacatctatttctgtggtctgagaggaatgatgcctgggatccaagaaacactgaaaagggttgctgagaagagaggagaaagttgggaagaaaagctttcacaactcaagaagaacaaacaatggcatgttgaagtttactgatattgtttttattctctaatgcaggatgcataatagtcttctaagaaaaagacagaagtgttagcaattttcattcttgtttctagaaattgttttgattaataatgttcattaagcagcttgagtagctgtatctgttctgaattagtagattataatgacgttttctcttgccatatcttgatgaattatcatgttaatcaataaggattattgttagt

SEQ ID NO: 1504 - DNA, 743 bp, Triticum aestivum
tagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaataaggaaccacactggttgtccacggatcaagaatgcccgtatctttactattctgtgtcgaaattcttgtaatctttacttggaaaaaaaaacgagctatgcactagatttcttgttctggctgtaaatggcaaggaataaagttgtaatcgtgttcagcagtcaa

SEQ ID NO: 1505 - DNA, 766 bp, Triticum aestivum
  misc_feature (19)..(19): n is a, c, g, or t
gcacgaggggacgttctanctagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaataaggaaccacactggttgtccacggatcaagaatgcccgtatctttactattctgtgtcgaaattcttgtaatctttacttggaaaaaaaaacgagctatgcactagatttcttgttctggctgtaaatggcaaggaataaagttgtaatcgtgttcagcagtcaatca

SEQ ID NO: 1506 - DNA, 839 bp, Saccharum officinarum
gcgtcccctctcgcgcgccgcgcgcgccattatagcacggcgcgcggcacgccttcggcctcccactcgctgcccagaggaggtctagctagctagcgacgtgacagcgaggaggaagaacggcagggatcgatatgtcgaggcccaacaggagcgacgcgcacctctccgccgaggacgaggcgacgctggaggccgaggtgcgggggtactacgacgaggcggcgcccaagcgccacaccaagccctcccgcagcgagcactccgccgtgtacgccgacgcgctcgtcccggacgccggcggcaacacccatccggagctcgacaagttccaagagctcgaagcacacaccgagaggttggcgtacgagggcggcaatgtcggagaggagttcgtggagacggagtactacaaggatctcggcggcgtcggcaagcagcaccacacgaccggaacgggcttcatcaagattgacaaagctaagggcgcctcgttcaaattgtctgaagaccccagcgcagaggagcgccatgcttcttgcaagggaaaccctgctaccaatgagtggatcccgtcagctgacacggtgtacccggcgtcagacaaaccgagcagaagcgacagctgagcaattgtatatctccagccatgagaattcagacgagtgctttccgccatcagaataaggaaccatactggttgtcaaggatcaaggatgcccgtatcttactattctgcgtcgaaatcttgtaattttaattggaaaaagcgtgctacgagtaagattctgtgtcttgctcttaatggcagggaataagttttattatggttaacagtc

SEQ ID NO: 1507 - DNA, 905 bp, Zea mays
tcgagatattttgcaatgccttcacaaatatctcgttggccccgcggcacggtgccatcagccatcgcgggcgaccgcgcgccattatagcacacggggcacggcacgccttcggcctcccactaactgcacagaggacgacgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggtttcatcaagatggacaaagctaaaggcgcccccttcaaactgtctgaagatcccaatgcagaggagcgacatgcttcttgcaggggaaaccctgctaccaacgagtggatcccgtcagctaacacggtgtacccggcgtcagacaagccaagcagaagcgacagctgagggactgtatatctccagccatgggaattcagacgagtgctttccgccattagaataagaaaccacactggttgtccaccgtatctttactgttctgcgtcgagattcttgtgattcttacgtggaacaaattaagcgtgctacgagttagacctctgtgttctggctgtaaatggcaaggaatgaagttctaatcgtggttcagcagtcaatcaattactctgtttctgat

SEQ ID NO: 1508 - DNA, 905 bp, Zea mays
tcgagatattttgcaatgccttcacaaatatctcgttggccccgcggcacggtgccatcagccatcgcgggcgaccgcgcgccattatagcacacggggcacggcacgccttcggcctcccactaactgcacagaggacgacgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggtttcatcaagatggacaaagctaaaggcgcccccttcaaactgtctgaagatcccaatgcagaggagcgacatgcttcttgcaggggaaaccctgctaccaacgagtggatcccgtcagctaacacggtgtacccggcgtcagacaagccaagcagaagcgacagctgagggactgtatatctccagccatgggaattcagacgagtgctttccgccattagaataagaaaccacactggttgtccaccgtatctttactgttctgcgtcgagattcttgtgattcttacgtggaacaaattaagcgtgctacgagttagacctctgtgttctggctgtaaatggcaaggaatgaagttctaatcgtggttcagcagtcaatcaattactgtgtttctgat

SEQ ID NO: 1509 - DNA, 848 bp, Panicum virgatum
ggctgcgtccccctcccgctcgcgcctgcggcccgatcctcccacagctcaaagcagaacgcccagcaaagcaaaagcggcgatgtcgaggccgagccggagcgacgcgcacctgtccccggcggacgaggcggcgcgggaggccgaggtgcgggagtacttcgacgacgcggcgcccaagcgccacaccaagccctcccgcagcgaccactccgccgtgtacgccgacgcgctcgtcccggacagctcccacccggagctcgacaagttccaagagctcgaagcccacaccgagagactggtctacgagggcggcaaggtaggggaggagttcgtggagacggagtactacaaggatctcggcggcgtcggcaagcagcaccacacgacgggaacgggcttcatcaggatggacagagacaagggcgcctcgttcaagctgtccgaagaccccgacgcagcggagcgccacgcttcttgcaaggggaaccctgctaccaacgagtggatcccgtcggctgacacggtgtacccggcgtcagacaagccgagcagaagcgacagctgagcagtatccccggccatgggagaggattcggacatgtgcttccaccagcaaaataagaaaccacattgctattcacagattaatgatgccccctgtaacttatgattctgcatcgaaatgcctgtaatcttgaatttctaaagagatcgcgcttcgcaatagatttctttgttctggctgtgttggcaggaaataaagttttaaccatggttcagaggtgaagtaaataaaggctctaggagcaatcaatatgaagatgcacttctaatcaatttctcgt

SEQ ID NO: 1510 - DNA, 840 bp, Pennisetum glaucum
aaagaagaacgccgcgcctgccgggaggaagaaagaaaggctcggagcgatgtcgtcgaggccgaaccggagcgacgtgcacctgtccccggaggacgaggcggcgcgggaggccgaggtgcgggggtacttcgacgacgcggcgcccaagcgccacaccaagccctcccgcagcgagcactccgcggtgtacgccgacgcgatcgtcccggacagcacccacccggagctcgacaagttccaagacctcgaagcccacaccgagagactggtgtacgagggcggcaaggtcggggaggagttcgtggagacggagtactacaaggatctcggcggcgtcggcaagcagcaccacacgaccggaacaggcttcatcaggatggacagagacaagggcgcctcgttcaaactgtccgaaaaccccgacgcagcggagcgccacgcttcttgcaaggggaaccctgccaccaacgagtggatcccatcggctgacacggtgtatccggcgtcggacaagccgagcagaagcgacagctgagcatagccccggccatgagatggaattcagacaaagtgcttccaccagcaaaataagaaaccacgctattattcaaggatttagtgatgccctgtatctttgctatcctgcatcaaaatgtctgtaatcttaaatttcagaaaagctcgtgatttttgtgttcggcaggaataaagttttaatcatggttcagtagtcaatacatttctcggctgagatcactgtaaattcgcagtcaaaactaaacagaaaagagaaaacgagatcataagttcagagaaatcactgaaaagcatcaacat

SEQ ID NO: 1511 - DNA, 861 bp, Setaria italica
aactgcccaaagacaaagagcaaagcctagcgagtagcgacgcgacagcgaggaggaaggaaggatgtcgaggccgaaccggagcgacgcgcacctgtcgccggaggacgaggcggcgcgggaggccgaggtgcgggggtacttcgacgacgcggcgcccaagcgccacaccaagccctcccgcagcgagcactccccggtgtacgccgacgcgatcgtcccggacagctcccacccggagctcgacaagttccaagacctcgaagcccacaccgagaggttggtgtacgagggcggcaaggtcggggaggagttcgtggagacggagtactacaaggatctcggcggcgtcggcaagcagcaccacacgaccggaacaggcttcatcgggatggacagagacaagggcgcctctttcaaactgtccgaagaccccgatgcagcggagcgccatgcttcttgcaaggggaaccctgccaccaacgaatggatcccgtcggctgacaccaagccgagcagaagcgacagctgagcaatgcaatatcctcggcccgcggagaattcagacaagtgatgccaccaggaaaataagaagccacactgtgttattacaggattagtgatgtctgtatctttgctattctgcatcaaaatgcctgtaatcttgaatttcaaataagctcgcgattcgcattggatttctgtgttccgcctctgattggcaggaaataaagttttaatcatggttcagtagtcaatcaatttctcggctgcaaatccttctaaataaataagtgagaattcgatgccatttcggattcgcttgtagtcaaactaaacagaaaagaggtaatacgatcg

SEQ ID NO: 1512 - DNA, 1401 bp, Zea mays
cttttaaagcgcgcacggacacgggacactccgtctctctgaccttatccccttgcggcaaaaccttgcgcgcaacaatggccgcctccctcccgaccaccgccgcgcgcctcgcggccccggccttcgcctaccggtcgcccaacgctccctccgccaccgccctcccgcgtgccgccgccttccctgcaatcgccgtcgcggcggcgcccctgcgcccgcgccgcgcgccgaggccggtggcggcccgggccgggggcgaggagagggagacgatactgctccccgggtgcgactacaaccactggctgatcgtcatggagttccccaaggaccccgcgcccacccgcgagcagatgatcgacacctacctcaacacactcgccaccgtcctcggcagcatggaggaagccaagaagaacatgtacgccttcagcacgaccacctacaccgggttccagtgcaccgtggacgaggagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtccaagtacgagagcaggcggtacgagaggcggagagatgggccaccggcggccagcaggaaaccgaggcagcaggcaccagctcagactcagaccgagtccgcgtcttcgtgacgagctctgcaggcattttgtccacgtacctacctacctagaagtagaacaagagaggaggacgcctaaaattctgtcgccttgggcaccgcgtactggactggacaggcgggtcgggatccatcatccatcgtcagccagaaaaattgtcgctgtccaagcagcctgggcagcttgtgtgtgtgtgtgctgataagcctgatatcttgagctagctgtggcagaaactgaaaaccctactcttccccccgactccttagtgagctgtgtgatgccgactggtgtagagctgtatcgctgattgcgtgaaaccgaaatgctgtggctttatttagactgaagttggcacttcgagccatcggatcactccaagcactttgttcgttcatcgcgtatttggctgtgctaggctcgtttcatgtctaatgttattttttttaatttaaccaactaaccttggttatgttgtaaaacgttatggtgtaacagagttagccggtaactaaacatactcagtccacttcagtggcggaagacaaaataataatttggtatagctaaaacaagaaaaaaaatagagaaaatgatgtcgtgcaagctctaaactcgaacttagaacatgtttattgtaaccattatgcacttactacta

SEQ ID NO: 1513 - DNA, 1369 bp, Zea mays
gtctctctgaccttatccccttgcggcaaaaccttgcgcgcaacaatggccgcctccctcccgaccaccgccgcgcgcctcgcggccccggccttcgcctaccggtcgcccaacgctccctccgccaccgccctcccgcgtgccgccgccttccctgcaatcgccgtcgcggcggcgcccctgcgcccgcgccgcgcgccgaggccggtggcggcccgggccgggggcgaggagagggagacgatactgctccccgggtgcgactacaaccactggctgatcgtcatggagttccccaaggaccccgcgcccacccgcgagcagatgatcgacacctacctcaacacactcgccaccgtcctcggcagcatggaggaagccaagaagaacatgtacgccttcagcacgaccacctacaccgggttccagtgcaccgtggacgaggagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtccaagtacgagagcaggcggtacgagaggcggagagatgggccaccggcggccagcaggaaaccgaggcagcaggcaccagctcagactcagaccgagtccgcgtcttcgtgacgagctctgcaggcattttgtccacgtacctacctacctagaagtagaacaagagaggaggacgcctaaaattctgtcgccttgggcaccgcgtactggactggacaggcgggtcgggatccatcatccatcgtcagccagaaaaattgtcgctgtccaagcagcctgggcagcttgtgtgtgtgtgtgctgataagcctgatatcttgagctagctgtggcagaaactgaaaaccctactcttccccccgactccttagtgagctgtgtgatgccgactggtgtagagctgtatcgctgattgcgtgaaaccgaaatgctgtggctttatttagactgaagttggcacttcgagccatcggatcactccaagcactttgttcgttcatcgcgtatttggctgtgctaggctcgtttcatgtctaatgttattttttttaatttaaccaactaaccttggttatgttgtaaaacgttatggtgtaacagagttagccggtaactaaacatactcagtccacttcagtggcggaagacaaaataataatttggtatagctaaaacaagaaaaaaaatagagaaaatgatgtcgtgcaagctctaaactcgaacttagaacatgtttattgtaaccattatgcacttactacta

SEQ ID NO: 1514 - DNA, 1090 bp, Pennisetum glaucum
gcttcctccctccctcccaccgccgccgccgcgcgcctcgcggcccaggccttcgcgttcccgtcgccgaggccttcctccgcctccgcggcactcccgcgcgcctccgccttccccgcggtcgccgtcgcggcggcgcccctgcgggcccggcgcgcgcagcagcagcagctgaggcctccggccgcggcggggggcgagcagagggagacgatactgctccccgggtgcgactacaaccactggctgatcgtcatggagttccccaaggaccccgcgcccacccgcgagcagatgatcgacacctacctcaacaccctcgccaccgtcctcggaagtatggaggaagcaaagaagaacatgtatgcattcagtacaactacctacacagggttccagtgcaccgttgatgaagagacatcagagaagttcaagggtttgcctggtgttctgtgggtgcttcctgattcctacattgatgtcaaaaacaaggactatggaggtgacaaatacataaatggtgagatagttccctgcacatacccaacctaccagccaaaggagcggagaacatcaaagtatgagagtagacgttacgagaggcgaagagatggtcccccagccaacaggagaccgaggcaacaggccccccagactgagtcagcatcttcatgagcattgcaggcatttatccacattctagtgaaacaaaagaacatgctctttggcaccatctccagacgagcaggcaaatccatcctcagcccaaaatttcatgcagagctgtgcaagtgacccgcacagcttggatttggatcatgtggatgggtgctgatgttttgagcagactatgacatctctgtgtgacacgctactgaaaaccctgattcatctattctccaaactcctagggaactatcctcacgatattttgtatgatgttgactggcctagttgtattgtggaattctgtgaaatgtgctccaatttctcttttgagctttgcttgaacggttggcattttgccatagcattatccttgcaatattctgctgctagagtttgcatattgggtcattgaaggaaatga

SEQ ID NO: 1515 - DNA, 1140 bp, Panicum virgatum
  misc_feature (291)..(291): n is a, c, g, or t
  misc_feature (315)..(315): n is a, c, g, or t
  misc_feature (337)..(337): n is a, c, g, or t
gccgcctccctcccgcccaccgccgccgccgcgcgcctcgtggcccaggccttcgccttcccttcgcccaggccttcacccgccaccgcctccgcggcgctcccgcgcgcctccgccgccgccgtcttccccgcaatcgccgtcgcggcggcgcccccgcggccccggcgcgcgcggaggccggcgccgcccgcggcgggggccgggggcgagcagagggagacgatactgctccccgggtgcgactacaaccactggctgatcgtcatggagttccccaaggaccccgcncccacccgcgagcagatgatcganacctacctcaacaccctcgccnccgtcctcggaagcatggaggaagccaagaagaacatgtatgcattcagcacgaccacctacacagggttccagtgcactgttgatgaagagacatcagagaagttcaagggtttgcctggtgttctttgggtgcttcccgattcctacattgatgtcaaaaacaaggactatggaggtgacaagtacatcaacggtgagataattccctgcacgtacccaacctaccaaccaaaggagcggagaacatcaaagtatgagagcagacggtatgagaggcgaagagatggtcccccagccaacaggaaaccaaggcaacaggcccctcagactgagtcagcatcttcatgaggcatttatccacattgtactactgaaacaaaagagcacgcttaattctgtctgctttcgcgcaatgaaggacaagcatgcatatccatcctcagcccaaaatatcaggcagcgttgtgcaggtgacctgcacagcttggatttggatcacgtggattggtgctgatattttgagcagactatgacatctgagtttgacacggagtgaacctgatttttctaaaatgttgctattctcccaactcctagtgaactatcctagtgatattttgcatgatgttgactggcctagttgtattgcggatcttgttaatttgatgtgtttcttgctcactcaattgtgctgtggactatttgattgtgagatatgaattgtgaatcttgaagtgctctctcagtccagacagtttggctgaatatggtttggataactcaagattagaggcattggcc

SEQ ID NO: 1516 - DNA, 1223 bp, Hordeum vulgare
ctcaccttatccgcaactcgcaaaacctcactccccccacacgtacgctcgcttcaatggctgccctgccgaccgccgccgccgccgggcgcgtagcggccagcgccttcactttccccgccaagccctccgcttcctccttctcagccgcttctctcccccgcgccgccgcagcggcggcagcctttccggcgatcgccctcgcaccggcagggggcctccagcgtcggcggaggccgacggcggccggcgcggcgcctgggagcgagcagagggagaccatactgctccccgggtgtgactacaaccactggctgatcgtcatggagttcccaaaggaccccgcgcccacgcgcgagcagatgatcgatacctacctcaacaccctcgccaccgttctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacatcgatgtaaaaaacaaagactacggaggtgataaatacataaatggtgagatcattccgtgcacatacccaacctaccaaccaaaggagcggaggacctcaaagtatgaaagcagacggtatgagaggcgaagagatggcccccctgccagcaggagaccgaaacaacaggccggtcagcctgagtcagcatcttcatgaggcgtttactcgcgtactgaaacaacagactgctcaattctatcatcaggctccgccaccaagtattgggagagctcctaggcacaaaacttcatccagagcccaagatatgatgtagcacttgagcgagcgacctccgcagctggatttggagttttgaaccatgagaataacttgagtggatttgccatctaaatgtaacaatagactgaaatcctggtcgataaaaaatgttactcaagtatcttgtgatattttctgtaatgtttagtagtattcctgatcgtgggagttcgttcacttttagcttgattgaactgaagttagcttctagccatggtaccgatagtcggattttgcttggaatttaggatcttctgtcgagtttgattgaaagcccttgctatgtggaatacgacgaatgtgtgtacttgttattgtagttcgtgagaaaccttgaaatttgtgtcattattatca

SEQ ID NO: 1517 - DNA, 1222 bp, Hordeum vulgare
gaaccttatccgcaactcgcaaaacctcactccccccacacgtacgctcgcttcaatggctgccctgccgaccgccgccgccgccgggcgcgtagcggccagcgccttcactttccccgccaagccctccgcttcctccttctcagccgcttctctcccccgcgccgccgcagcggcggcagcctttccggcgatcgccctcgcaccggcagggggcctccagcgtcggcggaggccgacggcggccggcgcggcgcctgggagcgagcagagggagaccatactgctccccgggtgtgactacaaccactggctgatcgtcatggagttcccaaaggaccccgcgcccacgcgcgagcagatgatcgatacctacctcaacaccctcgccaccgttctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacatcgatgtaaaaaacaaagactacggaggtgataaatacataaatggtgagatcattccgtgcacatacccaacctaccaaccaaaggagcggaggacctcaaagtatgaaagcagacggtatgagaggcgaagagatggcccccctgccagcaggagaccgaaacaacaggccggtcagcctgagtcagcatcttcatgaggcgtttactcgcgtactgaaacaacagactgctcaattctatcatcaggctccgccaccaagtattgggagagctcctaggcacaaaacttcatccagagcccaagatatgatgtagcacttgagcgagcgacctccgcagctggatttggagttttgaaccatgagaataacttgagtggatttgccatctaaatgtaacaatagactgaaatcctggtcgataaaaaatgttactcaagtatcttgtgatattttctgtaatgtttagtagtattcctgatcgtgggagttcgttcacttttagcttgattgaactgaagttagcttctagccatggtaccgatagtcggattttgcttggaatttaggatcttctgtcgagtttgattgaaagcccttgctatgtggaatacgacgaatgtgtgtacttgttattgtagttcgtgagaaaccttgaaatttgtgtcattattatca

SEQ ID NO: 1518 - DNA, 1170 bp, Triticum aestivum
cgcaacccgcaaaaacctcactccctccacacgcacgctcgcttcaatggctgccctgccgaccgccgccgccgccgggcgcgtagcggccagcgccttcactttccccgccaagccctccgcttcctccttagccgcgtttctcccccgtgccgcagccgccgcggcggcctttccagcgatcgccctcgcaccggcgggggccctccagcgtcggcggaggccgacggcggccggcgcagcgcccgggagcgagcagagggagacgatactgctccccgggtgtgactacaaccactggctgatcgtcatggagttccccaaggaccccgcgcccacgcgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacattgacgtgaaaaacaaagactatggaggtgataaatacataaatggtgagatcattccatgcacatacccaacctatcaaccaaaggagcggaggacctcaaagtatgaaagcagacggtatgagaggcgaagagatggccctcctgccagcaggaaaccgaaacaacaggccactcagcctgagtcagcgtcttcatgagttttgcaggtgtttactcgcatgctgaaacaacagagagtgctcaattctatcatttggctccgccaccatgtattgggaggagcttctaggcacacaatttcatccaaagcccaaaatatgatgtagcgcttgagcgagcgacctgcgcagctggatttgggtttttggaccatgaggatatcttgagtggacttggcatctaaatccaaatgtaacaatagactgaaatcctggtccatcaaaaatgttattcttcaagtatcttgtgatattttctgtaatgtttagtggtatccctgatggtgagagttcattcactttgagcttgattgaactgaagttagcttttagtcatgataacgatagtcagattgtgcttggaatttaggatgttgagtgaagtgtgattgaaagtccttatgtggaatgcgatgaat

SEQ ID NO: 1519 - DNA, 1197 bp, Triticum aestivum
cgcaacccgcaaaaacctcactccctccacacgcacgctcgcttcaatggctgccctgccgaccgccgccgccgccgggcgcgtagcggccagcgccttcactttccccgccaagccctccgcttcctccttagccgcgtttctcccccgtgccgcagccgccgcggcggcctttccagcgatcgccctcgcaccggcgggggccctccagcgtcggcggaggccgacggcggccggcgcagcgcccgggagcgagcagagggagacgatactgctccccgggtgtgactacaaccactggctgatcgtcatggagttccccaaggaccccgcgcccacgcgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacattgacgtgaaaaacaaagactatggaggtgataaatacataaatggtgagatcattccatgcacatacccaacctatcaaccaaaggagcggaggacctcaaagtatgaaagcagacggtatgagaggcgaagagatggccctcctgccagcaggaaaccgaaacaacaggccactcagcctgagtcagcgtcttcatgagttttgcaggtgtttactcgcatgctgaaacaacagagagtgctcaattctatcatttggctccgccaccatgtattgggaggagcttctaggcacacaatttcatccaaagcccaaaatatgatgtagcgcttgagcgagcgacctgcgcagctggatttgggtttttggaccatgaggatatcttgagtggacttggcatctaaatccaaatgtaacaatagactgaaatcctggtccatcaaaaatgttattcttcaagtatcttgtgatattttctgtaatgtttagtggtatccctgatggtgagagttcattcactttgagcttgattgaactgaagttagcttttagtcatgataacgatagtcagattgtgcttggaatttaggatgttgagtgaagtgtgattgaaagtccttatgtggaatgcgatgaatgtgtgcacttgtcattgtggcttgtta

SEQ ID NO: 1520 - DNA, 1164 bp, Leymus cinereus x Leymus triticoides
  misc_feature (22)..(22): n is a, c, g, or t
  misc_feature (30)..(30): n is a, c, g, or t
  misc_feature (33)..(34): n is a, c, g, or t
  misc_feature (37)..(37): n is a, c, g, or t
  misc_feature (53)..(53): n is a, c, g, or t
  misc_feature (688)..(688): n is a, c, g, or t
  misc_feature (740)..(740): n is a, c, g, or t
  misc_feature (743)..(743): n is a, c, g, or t
  misc_feature (801)..(801): n is a, c, g, or t
  misc_feature (843)..(843): n is a, c, g, or t
  misc_feature (1023)..(1023): n is a, c, g, or t
  misc_feature (1027)..(1027): n is a, c, g, or t
  misc_feature (1041)..(1042): n is a, c, g, or t
  misc_feature (1052)..(1052): n is a, c, g, or t
  misc_feature (1071)..(1071): n is a, c, g, or t
  misc_feature (1149)..(1151): n is a, c, g, or t
actcgcaaaacctcactccccncacacgcncgnncgnttcaatggctgccctnccgaccgccgccgccgccgggcgcgtagcggccagcgccttcacgttccccgccaagccctccttatcctccttctcagccgcgtctctcccccgcgccgcagccgcggcggcggcctttccagcgatcgccctcgcaccggcggggggcctccagcgtcggcggaggccgacggcggccggcgcggcgcccgggagcgagcagagggagacgatactgctccccgggtgtgactacaaccactggctgatcgtcatggagttccccaaggaccccgcgcccacgcgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacatcgatgtaaaaaacaaagactatggaggtgataaatacataaatggtgagatcattccatgcacatacccaacctaccaaccaaaggagcggaggacctcaaagtatgaaagcagacggtatgagaggcgaagagatggcccccctgccagcaggagacngaaacaacaggccacccagccagagtcagcgtcttcatgaggcgtttactcncanactgaaacaacagagagtgctcaattctatcatctggctccgccaccatgtattgggngagctcctaggcacgcaatttcatccaaagcccaaaatatgntgtagcgcttgagcgagcgacctgcgcagctggatttggagttttggaccatgaggatatcttgagtggacttggcatctaaatgtaacaatagactgaaatcctggtccataaaaaatgttactcttcaagtatcttgtgatattttctgtaatgtttagtggtattcctgatcgtganagtncgttcactttgagnntgattgaacngaagttagcttttagtcanggtaacgatagtcagattgtgcttggaatttaggatgttgagtggagtgtgattgaatgtccttgctatgtggaatcnnnatgaatgtgtgca

SEQ ID NO: 1521 - DNA, 1337 bp, Triticum aestivum
cttctcctgaaattatctcattcttctactcgactctgtctcaccttatccgcaacccgcaaaacctcgctcccccctcacgcacgctcgcttcaatggctgccctgccgaccgccgccgccgccgggcgcgtagcgggcagcgccttcacgttccccgccaagccgtccttatcctccttctcagccgcgtctctcccccgcgccgcagccgcggcggcggtctattcagcgatcgccctcgcaccggcggggagcctccagcgtcggcggaggccgacggcggccggcgcagcgcccgggagcgagcagagggagacgatactgctccccgggtgtgactacaaccactggctgatcgtcatggagttccccaaggaccccgcgcccacacgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccctgattcctacatcgatgtgaaaaacaaagactatggaggtgataaatacataaatggtgagatcattccatgcacatacccaacctatcaaccaaaggagcggaggacctcaaagtacgaaagcagacggtatgagaggcgaagagatggccctcctgccagcaggaaaccgaaacaacaggccactcagcctgagtcagcgtcttcatgagttttgcaggcgtttactcgcatactgagacaacagagagtgctcaattctatcatctggctccgccaccatgtattgggagagcttctaggcacacaatttcatccaaagcccaaaatatgatgtagcgcttgagcgagcgacctgcgcagctggatttggggttttggaccacgaggatatcttgagtggacttggcatctaaatctaaatgtaacaatagactgaaatcctggtccatcaaaaatgttattcttcaagtatctcgtgatattttctgtaatgtttagtggtatccttgatcgtgagagttcattcactttgagcttgattgaactgaagttagcttttagtcatgataacgatagtcagattgtgcttggaatttaggatgttgagtggagtgtgattgaaagtccttgttatgtggaatgcgatgaatgtgtgcacttgtcattgtagcttgttattgttccaagaaatctgtattttgttttgtcattgttaattttcaggcttgtgccatctgatcagatggtctaatcacaaataaaa

SEQ ID NO: 1522 - DNA, 1253 bp, Triticum aestivum
atcatcacaaggctaaaacccttctcctgaaattatctcattcttctactcgactctgtctcaccttatccgcaacccgcaaaacctcgctcccccctcacgcacgctcgcttcaatggctgccctgccgaccgccgccgccgccgggcgcgtagcgggcagcgccttcacgttccccgccaagccgtccttatcctccttctcagccgcgtctctcccccgcgccgcagccgcggcggcggtctattcagcgatcgccctcgcaccggcggggagcctccagcgtcggcggaggccgacggcggccggcgcagcgcccgggagcgagcagagggagacgatactgctccccgggtgtgactacaaccactggctgatcgtcatggagttccccaaggaccccgcgcccacacgcgagcagatgatcgacacctacctcaacaccctcgccaccgtcctcggcagcatggaggaagccaagaagaacatgtatgccttcagcacaaccacttacactgggttccagtgcactgtcgatgaagaaacatcagagaagttcaagggtttgcctggtgtcctgtgggtgctccccgattcctacatcgatgtgaaaaacaaagactatggaggtgataaatacataaatggtgagattattccatgcacatacccaacctatcaaccaaaggagcggaggacctcaaagtatgaaagcagacggtatgaaaggcgaagagatggccctcctgccagcaggaaatcgaaacaacaggccactcagcctgagtcagcgtcttcatgagttttgcaggcgtttactcgcatactgagacaacagagagtgctcaattctatcatctggctccgccaccatgtattgggagagcttctaggcacacaatttcatccaaagcccaaaatatgatgtagcgcttgagcgagcgacctgcgcagctggatttggggttttggaccacgaggatatcttgagtggacttggcatctaaatctaaatgtaacaatagactgaaatcctggtccatcaaaaatgttattcttcaagtatctcgtgatattttctgtaatgtttagtggtatccttgatcgtgagagttcattcactttgagcttgattgaactgaagttagcttttagtcatgataacgatagtcagattgtgcttggaatttaggatgttgagtggagtgtgattgaaagtccttgttatgtggaatgcgatgaatgtgtgcact

SEQ ID NO: 1523 - DNA, 1274 bp, Brachypodium distachyon
tccgcaactcgcaaaaacctcgcttcttcccaaacactcgcactcgagcgctgcaatggcttccctcccgacggccgccgccaccgcgcgggtcgcggccaccaggtccttcgccttccccgccaggccctctttctccgcatccaccgcggcgctcccccgcgcttcctccgccggcacggtgttcccggcgatcgccctcgcggcggcggcggcggcggcgggacgggcgatgaggctgacggcggcccgcgcggcgccggggagcgagcagagggagacgatactgctccccgggtgcgactacaaccactggctgatcgtcatggagttccccaaggaccccgcgcccacgcgggagcagatgatcgacacctacctcaacaccctcgccaccgtcctcggcagcatggaggaagcgaagaagaacatgtatgccttcagcacgaccacttacactgggttccagtgcactgtcgacgaagaaacgtccgagaagttcaagggtctgcctggtgttctatgggtgctccctgattcctacatcgatgtcaaaaacaaagactatggaggtgataaatacataaatggtgagataatcccatgcacatacccaacctaccaaccaaaggagcggaggacatcaaagtacgaaagcaggcggtatgagaggcgaagggatggacctcctgccagcaggagaccgaagcaacaagccactcagcctgagtcagcgtcttcatgagggatttactcacataccgaaacaaaagggtgtgcttaattctaccgtctcgagtcacgaccttgtattggggaacacgcaaattcttccaaagcctagtgctgtgcaatcgacttgctgagctggaattggagttttggatcatgctgatagtttgagtgaactatgacatctgaatgtcacgagagactggaatcccgatccatctgaaatgtcactcttcaagcatcttgtgatattttctgtaatatttagttgtgtccgtgtgaatttgttcgctcttagtttgattgaactgaagttagttcttagccagggtaatgttatccacgttgttttgcctcgacttggttgtttgggatcctgaatgcagtgtgagtgggactgctgaaagctcttgcaatgttagaatatcatgaataccctgtacacatttcactgtagtttgtgtgagaagtgtcttaaattctcgtcagcatcaggtgtgctgccacttgaaatgacaatagcgccctcatctcttcaggtt

SEQ ID NO: 1524 - DNA, 1582 bp, Oryza sativa
attctcttcttcttcttcccaccttatccccaaactcgtaaacctctccctctccccactctcgcgcctcctcccatggcttccttcccgaccaccgccgccgccgccgccgcgcaggcattcgccttcgccctcgcgccgaagccatcctcctccgccgccgcaccatccgcgctcttcccccgcaccgccgcggcggcggcgttcccgacgctggctgtgcgaggaagcgggaaggcgaggcagccggtggtggccgcggcggcgggggcggggacggggagcgagcagagggagacgatactgctccccgggtgcgactacaaccactggctgatcgtgatggagttccccaaggaccccgccccgacgcgggagcagatgatcgacacctacctcaacaccctcgccaccgtccttggcagcatggaggaagccaagaagaacatgtatgccttcagcacaaccacctacactggtttccagtgcactgtcgacgaggaaacatcagagaagttcaagggtttacccggcgttctgtgggtgcttcctgattcctacatcgatgtcaagaacaaagactacgggggtgataaatacataaacggagagataattccatgcacttacccaacctaccaaccaaaagagcggaggacatccaaatatgaaagcagacggtatgaaaggcgaagagatggacccccagcaagcaggagaccaaggccgcagactgctcagcctgagtcagcctcttcttcatgaggtcagttttgcaggcactcatccacgtaatggaaagaaagaacttgcttactagctaattctaccacttggcgtcgcatacgggaaagctctgacagacaaatctatcctcaacccaaaatatcatccagagctgtgcaagcgattcatgcaggctgcatttggaattttggatcatgtggatcatcatcattcttgatattttgggtggactatgacctctgaatgtgacaaaagacggaaattctgatctatctaagaatgttactgtctcaaatatctagtgatatttttcttgtgttaccctgctacctagtagttgtgttgctggtttgtgtgtggaatttcttgatccttatccatgtgagttttcttgaactgaagttgattttttggcctttgtattggcatttgttctgctcagagcctgagacttgcaatttgggatgaccattgaatcgaagtgagattgaaaagctgttgctgtgtggatgtgatgagtgaattgtcatacttcaatataatatggttatgccttcttcattgctgtctttattagtacttaaatattcttcagttgaaatggtagcccacatgatctccaaggctgtgatgagatggcaaattatagtgacgtgtagatgacatgtaaccgaaatgaatgtggttttcgtccaagagagagatagcggaagctttaaacatgtaaaatgtcctagtttgtagtccagagctctccgtttatctcaaaagttcaaagctgcaaatagatttttatttacaagtttcaaataaaagaaacaaaaaaattgctaaa

SEQ ID NO: 1525 - DNA, 894 bp, Zea mays
tcacccggctggagcccaacctcagctagcctggggaccgctgcacgaacagtagtcctccctcctcctataaagtaaccacccgtccaccagctagctgaggtcgtcggccatggcggagcgggagcagcaagagcaggtggctagcgacgacgcggcggagtggaagcaggtggcggagctgagggccgtcacccaggcccaggacccttcctgcaaggatgaggacgactacacgctccggcgcttcctccgcgcgcgggaccacaacatcggcaaggcgtcggcgatgctgctcaagtacctcaagtggaagcccgcggccaagccccacggcgccatcgccgcggcggaggtggcgcgggaggcggcgcaggggaagctctacctgcagggccacgaccgggagggccgccccctcatctacggcttcggcgcgcgccaccacccggcgcgcagggacctcgacgagttcaagcgctacgtcgtccacgtcctcgacgccaccgtcgcgcgcctgccccctcctcctccgggagatgttcgccaggagaagttcgccgccgtcgccgacctcgccggctggggctacgccaactgcgacatccgaggctacctggcggcgctcgacatcatgcagagctactacccggagcgcctcgcccgcgtcttcctcgtccacgtgccctacgtcttcatggccgcctggaagatcgtctaccccttcatcgacgacaacaccaagaagaagttcgtcttcgtgccggacaaggacctggacaggacgctccgcgaggccatcgacgactcccagctgccggagatctatggtggcaagctcaagctcaagctcgtcacgccgcctgcaaataaattaccaagccactagctagg

SEQ ID NO: 1526 - DNA, 899 bp, Zea mays
tcacccggctggagctcagcctcagctagcctggggaccgctgcacgaacagtagtcctccctcctcctataaaagtagggtaaccacccgtccaccagcagctgaggtcgtcggccatggcggagcgggagcagcaagagcaggtggctagcgacgacgcggcggagtggaagcaggtggcggagctgagggccgtcacccaggcccaggacccttcctgcaaggatgaggacgactacacgctccggcgcttcctccgcgcgcgggaccacaacatcggcaaggcgtcggcgatgctgctcaagtacctcaagtggaagcccgcggccaagccccacggcgccatcgcagcggcggaggtggcgcgggaggcggcgcaggggaagctctacctgcagggccacgaccgggagggccgccccctcatctacggcttcggcgcgcgccaccacccggcgcgcagggacctcgacgagttcaagcgctacgtcgtccacgtcctcgacgccaccgtcgcgcgcctgccccctccccctccgggagatggtcgccaggagaagttcgccgccgtcgccgacctcgccggctggggctacgccaactgcgacatccgaggctacctggcggcgctcgacatcatgcagagctactacccggagcgcctcgcccgcgtcttcctcgtccacgtgccctacgtcttcatggccgcctggaagatcgtctaccccttcatcgacgacaacaccaagaagaagttcgtcttcgtgccggacaaggacctggacaggacgctccgcgaggccatcgacgactcccagctgccggagatctatggtggcaagctcaagctcaagctcgtcacgccgcctgcaaataaattaccaagccactagctagg

SEQ ID NO: 1527 - DNA, 1413 bp, Pennisetum glaucum
cgccgggccacaacagctacagcagtacaggtaggcaggccggcagctcgttcccctttcgttttcgttcacaagaggtcggagaggccatagcttctccgtggagcggcagagcacagaacggaggagtcagctgcagctgcatccaccaccaccaccacccctcgtcttctcctcctataaaactaaacctccccttgagtctctcaaccaaaccaaaccaaaccaagaagagaagagaagagaagagaagagaagacgacgaaccaacaaccatccacccatccatggcggcggccagcaacggccaccacaaggacggcgacgccgcggagtgggagcaggtcgccgagctccgggccgtcaccgaggcgcaggaccctgcctgcaaggaggaggacgactacacgctgcgccgtttcctccgcgcccgcgaccaccacatcggcagggcgtcggcgatgctgctcaagtacctcaagtggaagccggcggcgaagcccggcgggtccgtcccggcggcggaggtggcgcgcgagctgtcccaggggaagctgtgcctgcagggccacgaccggcagggccgccccatgatctacggcttcggcgcccgccaccacccgtccaaccgcgacctcgacgagttcaagcgcttcgtcgtccacgtcctcgacgccaccgtcgacaggctgccccccggccaggagaagttcgccgccgtcgccgacctcaagggctggggctactccaactgcgacatccgcgcctacctcgccgcgctcgacatcatgcagagctactacccggagcggctggggcgggtgttcctcatccacgtgccctacgtcttcatggccgcctggaagatcgtctaccccttcatcgacgacaacaccaggaagaagttcgtcttcgtccccgacaaggacctcgacaggacgctacgggaggccatcgacgacgcgcagctgccggagatgtacggtggcaagctcaagctcgcgccgccggcgcacaaatgatcgatgtcgatggttttagagctatatatatatggtgagtcgatcacctagcatcatatctgagacgtcggtagatccatcatctatcgtatcgacgaccgtacgcacgcacggctatatatatatagacgacgacacagcacgggcgctagctagctctcgagtgtcaaacactagcatattattaggcaaatcgatcgagtactacaacaaagctcggagagacgcaaggtttctatgtatatgtgtctagctcagctagctaccgtgcatgcatctcgatctccatgtactgcatttatactagctactagcctactatttgctgataacgcacactgtggacgatgcatatgcatggactgaatatgacaactgccaatatatcgtc

SEQ ID NO: 1528 - DNA, 925 bp, Arabidopsis lyrata
acctatcggtcggttcccatactctctttcaattgcttctgagagatatttaagtttaagaaaaatatcttaagcttctcaagcttcttcaatggcgaaccttcccaccgttctcgtaaccggcgctagtggacgaacaggtcagattgtgtataagaagctgaaggaggggtcagacaagtttatagcaaagggtttagttagaactgctgaaggaaaagagaaaattggaggagaagctgatgttttcattggggatataacagatgctgatagtattaatcctgcgtttcaagggatcgatgcgcttgtgattctcacgagtgctgtgcctaaaatgaaacctggttttgatcccactaaaggtggaagacctgagttcattttcgaagatggacaatatcctgaacaagttgattttattggccaaaagaatcaaattgatgcagccaaagtggctggtgttaagcatattgtcgtggtaggatcaatgggtggaaccaatccggatcatcctttgaacaaactgggaaatgggaatatactggtttggaagagaaaggctgaacagtaccttgctgattctggaactccttacacaataatcagagctggaggacttctagataaggaaggcggtgtaagagagctgatagttggtaaagacgatgagctacttcagacagacacaaaaaccgtccccagggctgatgttgcggaagtctgcatccaggcattgctgttcgaggaagccaagaacaaagctttcgatctcggctcaaagccagagggaaccagttctccgactaaagacttcaaggctctcttctctcaagtcacgtctcgtttctaaatccttatctttgctgcgaataagaacatttgggatgtaatttatcaaaccttctaaaataaaatctctggg

SEQ ID NO: 1529 - DNA, 909 bp, Raphanus sativus
gagtgagagtcttgagaaaattatagagagtttcttcttcaatggcgaaccttcccaccgttctcgttaccggcgctagtggcagaacaggccagattgtgtacaagaagctgaaggagaggtcagacaagtttgtggcgaaggggttagtgagaactcctgaagggaaagagaagattggaggagaagctgatgttttcattggtgatataacggatgctgatatcattacccctgctgttcaagggatcgatgcgcttgtgattctcactagcgctgtccccaaaatgaaacctggttttgaccccactaaaggtggaagacctgagttcatcttcgatgatggacagtaccctgaacaggttgattggattggccagaagaaccaaatagatgctgccaaggttgctggtgtgaagcatattgtcttggttgggtccatgggtggaacaaatccggatcatcctctgaacaaactgggaaatgggaacatactggtttggaagaggaaagctgaacagtatcttgctgattctggaactccttacacaataatcagagcgggaggacttctagacaaagaaggaggtgcacgagagctcctagttggtaaagatgacgagcttcttcaaacagacactaaaaccgtccccagggctgatgttgctgaagtctgcattcaggcattgctgttcgaggaagcaaagaataaagcttttgatctgggctcaaagccagagggaacgagttctcctactaaagactttaaggctctcttctctcaagtcaccgctcgtttttaaaagcttttatcttctttgaatcatttgggatgtaatgtaccaaaccagttaaaataaaatatccgggcacactatgagtagaatcaataagataagggttgatctt

SEQ ID NO: 1530 - DNA, 1039 bp, Raphanus sativus
  misc_feature (875)..(875): n is a, c, g, or t
  misc_feature (877)..(878): n is a, c, g, or t
  misc_feature (884)..(884): n is a, c, g, or t
  misc_feature (926)..(926): n is a, c, g, or t
gggacacatgtcatgcacaccaaaaaactgtctaaaatctgacgatcattaatgcgctcgcttctccgtctcaccaaacgctctttaatgggcttcggagtaagtcaatttggttgagtgagaaaattatagagagcatcgagagagtttcttcttcaatggcgaaccttcccaccgttctcgttaccggcgctagtggcagaacaggccagattgtgtacaagaagctgaaggagaggtcagacaagtttgtggcgaagggtttagtgagaactcctgaagggaaagagaagatcggaggagaagctgatgttttcattggtgatataagggatgctgatagcattacccctgctgttcaagggatcgatgcgcttgtgattctcactagcgctgtccccaagatgaaacctggttttgaccccactaaaggtggaagacctgagttcatcttcgatgatggacagtaccctgaacaggttgattggattggccagaagaaccaaatagatgctgccaaggttgctggtgttaagcatattgtcttggttgggtccatgggtggaacaaatccggatcatcctttgaacaaactgggaaatgggaacatactggtttggaagaggaaagctgaacagtaccttgctgattctggaactccttacacaataatcagagcgggaggacttctagacaaagaaggaggtgcacgagagctcctagttggtaaagacgatgagcttcttcaaacagacactaaaaccgtccccagggctgatgttgctgaagtctgcattcaggcattgctgttcgaagaagctaagaataaagcttttgatcttggctcaaaaccagagggaaccagttctcccacnanngacttnaaggctctcttctctcaagtcaccgctcgtttttaaaatctnttatcttctcgttgctactgaatcatttgggatgtaatgtaccaaaccagttaaaataaaatatccgggtacactatgagtagaatcaataaaatgagggtcgttcttcgaaa

SEQ ID NO: 1531 - DNA, 873 bp, Thellungiella halophila
tgagttttgcaagcttcttccatggcgaatcttcccaccgttctcgtgaccggagccagtggcagaacaggccagattgtgtacaagaagctgaaggagaggtcagacaagtttgtggcaaaggggttagtcagaactcccgaaggaaaagagaaaattggaggagaagctgatgttttcattggggatataacagatgctgatagcattaaacctgcagttcaagggatcgatgcgcttgtaattctcaccagcgctgtgcccaagatgaaacctggttttgatcccacaaaaggtggaagacccgagttcatgttcgatgaaggacaataccctgaacaggttgattggtttggccagaagaaccaaatagatgctgccaaggttgctggtgttaagcatattgtcgtggttggctccatgggtggaacaaatccggatcatcctttgaacaaacttggaaatgggaacatactggtttggaagagaaaagctgaacaataccttgctgattctggaactccttacacaataatcagagctggaggacttctagataaggaaggcggcgtaagagagctgttagttggcaaagatgatgagcttcttcaaacagacacaaaaaccgtccctagggctgatgttgcagaagtctgcattcaggcattgctgttcgaggaagctaagctcaaagctttcgatctcggctcaaaagcagaaggaaccagtgctcccaccaaagactttaaggctctcttctctcaagtcacctctcgtttttagtctctatcgttgttgcgaaataattcatcatctgggatgtaatgtaatgtactaaaactttattgaaataaaatccccgtgtttgtgatg

SEQ ID NO: 1532 - DNA, 1013 bp, Raphanus sativus
aaacgctctttaatgggcttcggagtaagtcaatttggttgagtgagagtcttgagaaaattatagagagcatcgagagagtttcttcttcaatggcgaaccttcccaccgttctcgttaccggcgctagtggcagaacaggccagattgtgtacaagaagctgaaggagaggtcagacaagtttgtggcgaagggtttagtgagaactcctgaagggaaagacaagattggaggagaagctgatgttttcattggtgatataagggatgctgatagcattacccctgctgttcaagggatcgatgcgcttgtgattctcactagcgctgtccccaaaatgaaacctggttttgatcccaccaaaggtggaagacctgagttcatgttcgatgatggtcaataccctgaacaggttgattggattggccagaagaaccaaattgatgctgccaaggttgctggtgttaagcatattgtcttggttgggtccatgggtggaacaaatccggatcatcctctgaacaaactgggaaatgggaacattctggtttggaagaggaaagctgaacagtaccttgctgattctggaactccttacacaataatcagagctgggggacttctagacaaagaaggaggtgcacgagagctcctagttggtaaagatgacgagcttcttcaaacagacactaaaaccgtccccagggctgatgttgctgaagtctgcattcaggcattgctgttcgaggaagcaaagaataaagcttttgatctgggctcaaagccagagggaacgagttctcctactaaagactttaaggctctcttctctcaagtcaccgctcgtttttaaaatcttttatcttctctgaatccatttgggatgtgtaatgtaccaaaccagttaaaataaaatatccgggtacactatgagtagaatcaataaaaataagggttgttcttctaaatttgaaaagagctgggccaaaattataagatttaaaataaggga

SEQ ID NO: 1533 - DNA, 868 bp, Brassica juncea
gagcatcgagagtttcttcaatggcgaatcttcccaccgttctcgttaccggcgctagtggcagaacaggtcagattgtgtacaagaagctgaaggagagttcagacaagtttgtggcgaaggggttagtgagaactcctgaagggaaagagaagattggaggagaagctgatgttttcattggtgacataagggatgctgatagcattacccctgcgattcaagggattgatgcgctcgtgattctcactagcgctgtccccaagatgaaacctgggtttgatcccactaaaggtggaagacctgagttcattttcgatgatggacaataccctgaacaggttgattggattggccagaagaaccaaatagatgctgccaaggttgctggtgttaagcatattgtcttggttgggtccatgggtggaacaaatcccgatcatcctctcaacaaacttggaaatgggaacatactggtttggaagaggaaagctgaacagtaccttgctgattctggaactccttacacaataatcagagctggaggacttctagacaaagaaggaggtgcacgagagctcctagttggtaaagacgatgagcttcttcaaacagacaccaaaaccgtccccagggctgatgttgctgaagtctgcattcaggcattgctgttggaggaagctaagaacaaagcttttgatctcggctcaaaaccagagggaaccagttctcccaccaatgacttcaaggctctcttctctcaagtcaccgctcgtttttagatctcttatctcttgcaactgaataatttgagatgttataatgtaccaaactagtaaaaaataaaatctccgggttcaataaaaaa

SEQ ID NO: 1534 - DNA, 911 bp, Raphanus sativus
tgagaaaattatagagagcatcgagagagtttcttcttcaatggcgaaccttcccaccgttctcgttaccggcgctagtggcagaacaggccagattgtgtacaagaagctgaaggagaggtcagacaagtttgtggcgaagggtttagtgagaactcctgaagggaaagacaagatcggaggagaagctgatgttttcattggtgatataacggatgctgatagcattacccctgctgttcaagggatcgatgcgcttgtgattctcactagcgctgtccccaaaatgaaacctggttttgaccccaccaaaggtggaagacctgagttcatgttcgatgatggacagtaccctgaacaggttgattggattggccagaagaaccaaatagatgctgccaaggttgctggtgtgaagcatattgtcttggttgggtccatgggtggaacaaatccggatcatcctctgaacaaactgggaaatgggaacattctggtttggaagaggaaatctgaacagtaccttgctgattctggaactccttacacaataatcagagctggaggacttctagacaaagaaggaggtgcacgagagctcctcgttggtaaagatgacgagcttcttcaaacagacactaaaaccgtccccagggctgatgttgctgaagtctgcattcaggcattgctgttcgaggaatcaaagaataaagcttttgatctgggctcaaagccagagggaaccagttctcccactaaagactttaaggctctcttctctcaagtcaccgctcgtttttaaaatcttttatcgctactgaatccatttgggatgtaatgtaccaaaccagttaaaataaaatatccgggtacactatgagtagaatcaataaaaataagagctgttcttc

SEQ ID NO: 1535 - DNA, 908 bp, Brassica oleracea
gatcggaaaattctagagcatcgagagtttcttcaatggcgaatctccccaccgttctcgttaccggcgctagtggcaaaacaggtcagattgtgtacaagaagctgaaggagaggtcagacaagtttgtggccaaggggttagtgagaactcctcaagggaaagagaagattggaggagaagatgatgtgttcattggtgatataagggatgctgatagcattacccctgcgattcaagggatcgatgcgcttgtgattctcactagcgctgtgcccaagatgaaacctgggtttgatcccactaaaggtggaagacctgagttcattttcgatgatggacaataccctgaacaggttgattggattggccagaagaaccaaatagatgctgccaaggctgctggtgttaagcatattgtcttggttgggtccatgggtggaacaaatcctgatcatcctctcaacaaactgggaaatgggaacatactgatttggaagaggaaagctgaacagtaccttgctgattctggtactccttacacaataatcagagctggaggacttctagacaaagaaggaggtgcacgagagctcctagttggcaaagacgatgagcttcttcaaacagacaccaaaaccgtccccagggctgatgttgctgaagtctgcattcaggcattgctgttcgaggaagctaagaataaagcatttgatctcggttcaaaaccagagggaaccagttctcccaccaatgacttcaaggctctcttctctcaagtcaccgctcgtttttagatcttttatctctattgcaactgaataatttgtgttgtaatgtaccaaaccttttaaaataaaatctccgggttcaataaaaaagagtctataaaattagtcacattcttg

SEQ ID NO: 1536 - DNA, 954 bp, Brassica rapa
  misc_feature (30)..(30): n is a, c, g, or t
gaaactctctttaatggcttcgaagagtgnttctctcgtagtcttcggaaaaattctagagcatcgagagtttcttcaatggcgaatctccccaccgttctcgttaccggcgctagtggcagaacaggtcagattgtgtacaagaagctgaaggagaggtcagacaagtttgtggcgaaggggttagtgagaactcctgaagggaaagagaagattggaggagaagatgatgtgttcattggtgatataagggatgctgagagcatcacccctgcgattcaagggatcgatgcgcttgtgattctcactagcgctgtgcccaagatgaaacctgggtttgatcccactaaaggtggaagacctgagttcattttcgatgatggacaataccctgaacaggttgattggattgggcagaagaaccaaatagatgctgccaaggctgctggtgttaagcatattgtcttggttgggtccatgggtggaacaaatcctgatcatcctctcaacaaactcggaaatgggaatatactgatttggaagaggaaagctgaacagtaccttgctgattctggaactccttacacaataatcagagctggaggacttctagacaaagaaggaggtgcacgagagctcctagttggtaaagacgatgagcttcttcaaacagacaccaaaaccgtccccagggctgatgttgctgaagtctgcattcaggcattgctgttcgaggaagctaagaacaaagcatttgatctcggctcaaaaccagagggaaccagttctcccaccaatgacttcaaggctctcttctctcaagtcaccgctcgtttttagatctcttatctctattgcaactgaataatttgggatattataatgtaccaaactagtaaaaaataaaatctccgggtttaataaaaaaaaagtctataaattaaaaaaaaaaaa

SEQ ID NO: 1537 - DNA, 915 bp, Brassica napus
gggggttcgaagcgttttcttttgtagtaatcggaaaattctagagcatcgagagtttcttcaatggcgaatctccccaccgttctcgttaccggcgctagtggcaaaacaggtcagattgtgtacaagaagctgaaggagaggtcagacaagtttgtggcgaaggggttagtgagaactcctcaagggaaagaggagattggaggagaagatgatgtgttcattggtgatataagggatgctgatagcattacccctgcgattcaagggatcgatgcgcttgtgattctcactagcgctgtgcccaagatgaaacctgggtttgatcccactaaaggtggaagacctgagttcattttcgatgatggacaataccctgaacaggttgattggattggccagaagaaccaaatagatgctgccaaggctgctggtgttaagcatattgtcttggttgggtccatgggtggaacaaatcctgatcatcctctcaacaaactgggaaatgggaacatactgatttggaagaggaaagctgaacagtaccttgctgattctggtactccttacacaataatcagagctggaggacttctagacaaagaaggaggtgcacgagagctcctagttggcaaagacgatgagcttcttcaaacagacaccaaaaccgtccccagggctgatgttgctgaagtctgcattcaggcattgctgttcgaggaagctaagaataaagcatttgatctcggttcaaaaccagagggaaccagttctcccaccaatgacttcaaggctctcttctctcaagtcatcgctcgtttttagatcttctatctctattgcaactgaataatttgtgttgtaatgtaccaaaccttttaaaataaaatctccgggttcaataaaaaagagtct

SEQ ID NO: 1538 - DNA, 835 bp, Brassica juncea
agtacgcgggcgctagtggcagaacaggtcagattgtgtacaagaagctgaaggagaggtcagacaagtttgtggcgaaggggttagtgagaactcccgaagggaaagagaagattggaggagaagatgatgtgttcattggtgatataagggatgctgagagcatcacccctgcgattcaagggatcgatgcgcttgtgattctcactagcgctgtgcccaagatgaaacctgggtttgatcccactaaaggtggaagacccgagttcattttcgatgatggacaataccctgaacaggttgattggattgggcagaagaaccaaatagatgctgccaaggctgctggtgtgaagcatattgtcttggttgggtccatgggtggaacaaatcctgatcatcctctcaacaaactgggaaatggcaacatactgatttggaagaggaaagctgaacagtaccttgctgattctggaactccttacacaataatcagagctggaggacttctagacaaagaaggaggtgcacgagagctcctagttggtaaagacgatgagcttcttcaaacagacaccaaaaccgtccccagggctgatgttgccgaagtctgcattcaggcattgctgttcgaagaagctaagaataaagcttttgatctcggctcaaaaccagagggaaccagttctcccactaaagacttcaaggctctcttctctcaagtcaccgctcgtttttaaaatcctttttatcttcttgttgctactgaatcatttgggatgttaatgtaccgaacctgttcaaataaaatatccgggtacactataagttagag

SEQ ID NO: 1539 - DNA, 983 bp, Cleome gynandra
cgtatcgaagaattctgaattcgcagaaaaatttgtgagcttagaatcgtcaacaatggcggatcatcccaccattctcgtcactggagctagtggcagaacaggtcatattgtttataacaagttgaaggagagatcaaatcagtttgttgctaggggcttagttagaactccagaaggaaaggagaaaatcggaggaaaagatgatgtttttgtcggtgatataagggatgcaaatagtattaaccctgcaattcaagggattgattccctcataattctcaccagtgctgtgcccaaaatgaaacctggttttgatccttccaaaggtggaagacctgagttcaccttcgacgatggacaatatcctgaacaagttgattggattggtcagaagaatcaaatcgatgcagccaaagctgctggtgttaagcatattgtattggttggatccatgggaggaaccaatcctgatcatccgttgaataaactggggaatgggaatatactgatttggaagcgtaaggctgaacaataccttgctgattctggaattccatacacaattataagggctggaggactcctagacaaagaaggcggggttcgagagctcataataggtaaagatgacgagcttcttcagaccgacacaaaaacaatcccgagggcagatgttgctgaagtctgcattcaggcattgatgttggaggaggcgaaatacaaagcttttgatttagcctcaaagccggagggaaatggtactccgaccaaagacttcaaggctctcttctcccaagcgatcaataggttttaatctttccatatcaatatgatcaaataaataaatgtcggtctttcgaatttccattacaatatctaatgtacatttctcctcttgtgatgcatgaatttctcatgtgttgtatcatgttttggtacaatattgaacgttgtatcacacattaaaaatatattttaaa

SEQ ID NO: 1540 - DNA, 877 bp, Raphanus sativus
  misc_feature (635)..(635): n is a, c, g, or t
ccgtctcaccaaacgctctttaatgggcttcggagtaagtcaatttggttgagtgagagtcttgagaaaattatagagagtttcttcttcaatggcgaaccttcccaccgttctcgttaccggcgctagtggcagaacaggccagattgtgtacaagaagctgaaggagaggtcagacaagtttgtggcgaagggtttagtgagaactcccgaagggaaagacaagatcggaggagaagctgatgttttcattggtgatataagggatgctgatagcattacccctgctgttcaagggatcgatgcgctcgtgattctcactagcgctgtccccaaaatgaaacctggttttgatcccaccaaaggtggaagacctgagttcatgttcgatgatggtcaataccctgaacaggttgattggattggccagaagaaccaaatagatgctgccaaggttgctggtgttaagcatattgtcttggttgggtccatgggtggaacaaatccggatcatcctctgaacaaacttggaaatgggaacattctggtttggaagaggaaagctgaacagtaccttgctgattctggaactccttacacaataatcagagctggaggacttctagacaaagaangaggtgcacgagagctcctagttggtaaagacgatgagcttcttcaaacagacactaaaaccgtccccagggctgatgttgctgaagtctgcattcacgcattgctgttcgaggaagcaagaataaagcttttgatctgggctcaagccagagggaacgagttctcctactaaagactttaagctctcttctctcagtcaccgctcgttttaaatctttatctctctaatcatttgggatgt

SEQ ID NO: 1541 - DNA, 780 bp, Brassica juncea
tcgaaggggttggtgagaactcctgaagggaaagagaagatcggtggagaagctgatgttttcattggtgatataagggatgttgatagcattactcctgctattcaagggattgatgctttcgtgattcttactagcgctgtacccaagatgaaacctggttttgatcccactaaaggtggaagacctgagttcattttcgatgatggacaataccctgaacaggttgattggattggccagaagaaccaaatagatgctgccaaggttgctggtgttaagcatattgtcttggttgggtccatgggtggaacaaatcctgatcatcctctcaacaaacttggaaatgggaacatactggtttggaagaggaaagctgaacagtaccttgctgattctggaactccttacacaataatcagagctggaggacttctagacaaagaaggaggtgcacgagagctcctagttggtaaagacgatgagcttcttcaaacagacaccaaaaccgtccccagggctgatgttgctgaagtctgcattcaggcattgctgttggaggaagctaagaacaaagcttttgatctcggctcaaaaccagagggaaccagttctcccaccaatgacttcaaggctctcttctctcaagtcaccgctcgtttttagatctcttatctcttgcaactgaataatttgagatgttataatgtaccaaactagtaaaaaataaaatctccgggttaaataaaaaaaaagtctataaaattagtcacattactt

SEQ ID NO: 1542 - DNA, 1217 bp, Thellungiella halophila
  misc_feature (4)..(4): n is a, c, g, or t
  misc_feature (1216)..(1216): n is a, c, g, or t
gggngaaacgcgataaggtgcgtctctctcactctctcgtgatcgtctgattttaccaaacttcagtcaatggcgatgacgacgacgacgacgacactcttccatccactacttcctactagcagctacaaatccggagctgtgacttcttccattgtctcatttcctcgttcccaatttccgtcttcttcgtcgtctctccaatttcactcgcttgtctcggattcgacatcgatttttggtcggaggaagtttaccgggaatctcagaagagtttccgttatcgtttccgccgcgggaactactgaacctctcaccgtcctcgttaccggtgccggtggaagaacagggcaaattgtgtacaagaaactgaaggagaggtcggatcagtttgtggcaaagggtttagtgaggacaaaggaaagcaaagagaagatcggtggagaggacgaagtgttcattggagatatccgagaccctgcagccattgcttctgctgttcaaggaatcgatgctttggtcattcttacgagcgctgtaccacaaatgaaacctggctttgatcctagcaaaggagggagacctgagttcttctttgaagaaggagcttatccagaacaggttgattggattggtcagaagaatcagatagatgctgctaaagctgcaggagttaagcagattgttttggtcgggtcgatgggaggaacaaacattaatcaccctttgaatagtattggcaatgccaacattctggtttggaagaggaaagccgagcagtacttggctgattccgggattccgtacaccatcatcagggcgggcggtctgcaagacaaggaaggtggcatccgagaactactcgtgggaaaagatgacgagcttctcgagacagacacaagaacaatcgcaagggctgatgttgcagaagtctgcgttcaggcgttgcagcttgaggaggcaaaattcaaagcccttgacctggcctcaaagcccgagggaacaggcaccccaacaaaggatttcaaggcacttttcgctcaagtaaccactaagttctgatcttccgtttagtgctttttcccatctttgtcaatgtagcagagtcataggattagacgctgagagggatgagtaattaatgtttagatacacatgtctaaatcggctctttctatttctcaaggggtcttcccctatatttaagtaacatcanc

SEQ ID NO: 1543 - DNA, 1007 bp, Senecio madagascariensis
ggcttctctgacacgtgtcctatcacaatcttctaccaataacaccatttcatacaacctaaccacaactagcattactagaagagctagaagattctctgttttatcaatgtcgggcagcaccgtccttgtcaccggagccagtggcagaactggtcaaatagtttataagaagttgaaggagagatcaagtgaatatattgcaagaggttttgttagaagtgaagagagcaaggagaaaatcggtggaggagatgacgttttcattggcgatattagaaatatcgaaactcttgttcctgctattcaaggaatagatgctcttgtaattctcacgagtgctgtcccgaaaatgaagcccggttttgatccaactaaaggtggaaggcctgaattctattatgaagaaggatcataccccgaacaagttgactgggaagggcagaaaaatcaaatagatactgctaaagctgctggcgtgaagcaaattgttgtggttggctccatgggtggaacaaatcctaaccaccctttaaacagcttgggaaacggaaatatactgatctggaagagaaaagctgaacagtatctagcggactctgggattccatacacaattatacgggctggaggtttgcaagacaaggatggtggtgtccgtgaactgctaattggaaaagatgacgagcttcttcagactgaaaccaaaaccgttgccagagcggatgtagctgaagtctgtattcaggcactgcaatttgaggaagcgaaattcaaggcatttgatcttgcctccaaacccgagggaactgggaccccaacaaaagatttcaagaccatattttcccaaatcactactaaattttaaggtaaacccaagtaagttgagtatatgatcgaattgccagatttttctgtcattataaataaggatgagatggtataatttcagatatcttaagattgagctcatgctatattccattgttattatgcggtattattgt

SEQ ID NO: 1544 - DNA, 941 bp, Triticum aestivum
agactagtcgccggcgccatatggaggactacggcggcgtggcgagcctggtggcgtccggggtggtgttctggtcgacggcgttcctgctgctgcgggcgctgctccccaagcgctcctacgatttctgcaaccgcgcggtctccaccatgcacgccgtcaccggcgtcgccctcggctgcctctccgtgcaggactgggcctcccccgtctcccccgtcgcctcaccctcctcgccgcgccagatgagggcgctggcggtgacgctgtcgtacatgatctacgacggggcgtgctgccacctgagcggcgacgcgcggctggacaacgccctgcaccacctcatcagcatcgtcggcctcgccgccggcctcgcctaccagaggtgtgggacggagctggtggcgtgcctgctcgtcacggagatctccagcccgctgctgcacctcagggagatgctcaaggagctcggcgtcaaggacacggacctcaacctcctcgtcgacatcctgttcgcggtgaccttctcggtggcaaggatggtttgcgggacgtacgtcacctaccgcactgtgacggctgacaaccccatcctcatcaagacgatggcgacgagcttgctgctggtgagcgcctactggttcttgaggatcctcaggatggtcaggcacaagattgggaagaagaggctggcgtccaaagccgccggcaagggatctatgtgatgccacaagtggtgtctcgccgcaattattgttgaaaatgcacatcatgtactagtagtacgtactatctagcacattaatcgtgtggtgggtaaaggatgatgtcccaagcatgagatgcatgtattctggcaattttcattttattaatgtgcatgaactgttgatgtcacaagcatgagctgtttcgctgattgactgacagtagaaaaactc

SEQ ID NO: 1545 - DNA, 959 bp, Triticum aestivum
ctagtttataccccggatccccttactttgcgcgcgctagtagtagtacgccgcctgccgccatctcccggcctcgtccgttagactagtcgccggcgccatatggaggactacggcggcgtggcgagcctggtggcgtccggggtggtgttctggtcgacggcgttcctgctgctgcgggcgctgctccccaagcgctcctacgacttctgcaaccgcgcggtctccaccatgcacgccgtcaccggcgtcgccctcggctgcctctccgtgcaggactgggcctcccccgtctcccccgtcgcctcaccctcctcgccgcgccagatgagggcgctggcggtgacgctgtcgtacatgatctacgacggggcttgctgccacctgagcggcgacgcgcggctggacaacgccctgcaccacctcatcagcatcgtcggcctcgccgccggcctcgcctaccagaggtgtgggacggagctggtggcgtgcctgctcgtcacggagatctccagcccgctgctgcacctcagggagatgctcaaggagctcggcgtaaaggacacagacctcaacctcctcgtcgacatcctgttcgcggtgaccttctcggtggcaaggatggtttgtgggacgtacgtcacctaccgcactgtgacggctgacaaccccatcctcatcaagacgatggcgacgagcttgctgctggtgagcgcctactggttcttgaggatcctcaggatggtcaggcacaagattgggaagaagaggctggcgtccaaagccgccggcaagggatctatgtgatgccacaagtggtgtctcgccgcaattattgttgaaaatgcacatcatgtactagtagtacgtactatctagcacattaatcgtgtggtgggtaaaggatgatgtcccaagcatgagatgcatgtattctggcaattttcattttattaatg

SEQ ID NO: 1546 - DNA, 877 bp, Brachypodium distachyon
tcggaatggatacggcgacgatggaggagtactacggcgtggcgagctgggtggtgtccggggtggcgttgtggtcgacggcgttcctggcgctgcgggcgctgctgcccaagcgctcctacgacttctgcaaccgcgccgtctccaccatgcacgccgtcgccggcgtcggactcggctgcctctccgtgcaggactgggcttcccccgtctccccagtagcatccccctcctcaccgcgccagatgagggcgttggcggtgacgctgtcgtacatgatctacgacgcggcgtgctgccacctcagcggcgacgcccggctggacaacgccctgcaccacctcatcagcatcgtcggcctcgccgccggcctcctctaccggaggtgtgggacggagctggtggcgtgcctgctggtcacggagatctccggcccgctgctgcacctccgggagatgctcaaggagctcggcatcaaggacaccgacctcaacctccttgtcgatattctgttcgcggtgaccttctcggtggcacgaatggttggtggcacctacgtcacgtaccgcaccgtcacggcagacaacccgatcctcatcaagacgatggcaacgagcttgctgctggtaagcgcctactggttcttgaggatcctcaggatggtcaggcacaagctcgggaagaagaggccggcgaaactggccgccaaggccaagtgacgcgcgtggcaagaattaatcgatgaggacctcttagcttctgcagggatgctactgtagcaatgccactaatttcttggtttggcttaagaccaccttcctcagacaattaatggatgtgtgtactgtagcaaattaatcttattggtgtgtgtacc

SEQ ID NO: 1547 - DNA, 821 bp, Triticum aestivum
  misc_feature (15)..(15): n is a, c, g, or t
aagcgctcctacganttctgcaaccgcgcggtctccaccatgcacgccgtcaccggcgtcgccctcggctgcctctccgtgcaggactgggcctcccccgtctcccccgtcgcctcaccctcctcgccgcgccagatgagggcgctggcggtgacgctgtcgtacatgatctacgacggggcgtgctgccacctgagcggcgacgcgcggctggacaacgccctgcaccacctcatcagcatcgtcggcctcgccgccggcctcgcctaccagaggtgtgggacggagctggtggcgtgcctgatcgtcacggagatctccagcccgctgctgcacctcagggagatgctcaaggagatcggcgtcaaggacacggacctcaacctcctcgtcgacatcctgttcgcggtgaccttctcggtggcacggatggtttgcgggacgtacgtcacctaccgcactgtcacggctgacaatcccatcctcatcaaggcgatggcgacgagcttgctgctggtaagcgcctactggttcctgaggatcctcaggatggttaggcacaagattgggaagaagaggctggcgtccaaagccgccagcaagtgatgatgcgataacctgtgtttgcgcaatcatcgttaaaaatgcagatcatgtacgcgtagcacattaattcttaagtaattgtctgatgggcaaaggatgtcccaagcaagagatgcatgtattctattctagtagcaatttcagtttcataattaatgtgcatgaactgtttcactcccatgcttacaattctactatgagtgatcattcatgct

SEQ ID NO: 1548 - DNA, 1291 bp, Cenchrus ciliaris
  misc_feature (623)..(623): n is a, c, g, or t
ctccattcgcgcaaagcccaccccaccccacgaaatccctccccaaacgatgtgcccgacgacgcccgatcgagccaataaggccgccgccggctgcggcgacaggagctggcgggaggaggcggtggccgccggctcgctccgccaggtagacctcgaccggggcgccaacggctgggcctcgccgccgggggacctcttccacctgcgcgcgcggggatacttctccggcggcggcggcaagcgcggcaaggcgccgtccgcccccgagtggctgctccgccccgccggcgtcgactggctccgctcccacgcgcggctcgaccacgtgctcgcccgcgacgacaaccgcgtcgccgccgccttccgccgcgcgcgcctcaggaaggaccccaccgcgcacttcctcctcgccgtcaatctccaggtgcccggccggccggacgcgtacagcgcggtgttctacttcgcggcggaggcgcccatcccaccggactcgctgctcggccgcttcgtccacggcgacgacgcctaccgcaacgcgcgattcaagatcgccaaccgcatcgtcaagggcccctggctcgtccgcgccaccgtcggcaactacgccgcgtgcctcntcggccgcgccctcacctgccgctaccacaagggcgacgactacctcgagatcgacgtcgacatcggcagctccgcgatcgccagcgccatcttgcacctcgcgctcggtgccgtcacctcggtcaccatcgacatgggcttcctcgtcgagtcacagtccgaggaggagctgccggagaggctcttcggcgccgtgcgcatcgcgcagatggagatgagcgcggccaagtacgtggagctgccgcccgatgaggccatgcctgagacagccggcagggctggggcagggttcagggtcagctcggccaaggttgtcaatcacagccgccaacaagaacatgccggcggcaaggtcggcaggtcgatgagttgccaggaacgagacaacggaggaaaataggcgccaaggatgctagtgtgctgcttaaactattccatcagtgggagagagacggctagagccggagccggaggacagagaaatgccggcatgggtaaacacgagagggtgcataaaaggggggaatgaaagctggtgccacgaccacgaacgggggtcccgtccccttgataaaagtcttggagttcatttggttgtgatgagaaacctagtaagcctgatggatgcgtgcggaattaatagtaatcttcggtgcgtttggtaaca

SEQ ID NO: 1549 - DNA, 1422 bp, Saccharum officinarum
cgctcctccattcgcgcaaaggacgccaagcccacccaacgaaatctctccccaaacttacccctcgccggcgcccggcgatgtgcccgacgaagcccgatcgccctggccaggccgccgccgccgccggctccggcgggaagagctggcgggaggaggccgtggccgcgggctcgctgcgtctggtcgacctggaccgcggcgccaacggctgggcctcgccgccgggggacctcttccacctgcgcgcgcgcggctacttcaactgcggcggcgggaagcgcggcaaggcgccgtccgccgcggactggctgctccgccccgccggcgtcgactggctccgctcccacgcccgcctcgaccacgtgctcgcccgcgacgacaaccgcgtcgccgccgccttccgccgcgcgcgcctcaggaaggaccccaccgcgcacttcctcctcgccgtcaatctccaggtgccggggcggccggacgcgtacagcgccgtgttctacttcgcggcggaggcgcccatcccgccggactcgctgctggggcgcttcatccacggcgacgacgcgtaccgtaacgcgcgcttcaagatcgccaaccgcatcgtcaagggcccctggctcgtccgcgccaccgtcggcaactacgcggcctgcctgctcggccgcgcgctcacgtgccgctaccacaagggcgacgactacctcgagatcgacgtcgacatcggcagctccgcgatcgccagcgccatcctccatctcgcgctcggcgcagtcacgtcggtgaccatcgacatggggttcctcgtcgagtcacagtccgaggaggagctgcctgagaggctgttcggcgccgtgcgcatcgcgcagatggagatgggtgcggcaaagtatgtggagctgcctcctgacgaggccatgcctgagacggctggcagggctggtgcggggttcagggtaagctctgcgaaggtggtcaatcatagccgccaacaagaccatgccggcggcaaggtcggcaggtcgatgagttgcctggaccgagagagcggaggaggaaaataggcgcaaagtacgctggtgcactgcagaaagaaaccatccatcggtgggagagctatggcgagaaccggaagacaaaggccgggcaaccccaacacataaaacgctgaagctggtgtcatgaccacgacctcgaccacgaatggcccccttcatcattcataaagtcctgacttcatttggttgtgatgatgagaacttaaaccctgatggatgcgaaatcaattaatagtagcatgttaatctatctatggctgagttgcatgacataattatgatgatgcccggcttgtcttcatgcaaccagccagccacatatatgatatctcggctcggcctctctctgcttgttgccccccac

SEQ ID NO: 1550 - DNA, 1483 bp, Brachypodium distachyon
ggcacagcttctctctccaccgcgagatagcccagaccaacgcgctccctcaattcgcgcaaggacaccagacccccgacccggcccccagcccccagccccagccggcggcgatgccaccgaccacgccccagcgccggaatcaggacgaggcgccgccgcgcgattggcgggaggaggccgtgtccgccggctcgctgcggcaggtggacctggacagtggcaccaacggctgggccccgccgccgggggacctgttccacctgcgcgcccgcggctacttctcctcctccggcggagggggcaggcgggccaaggcgccgtcctccccggagtggctcctccgccccgccggcgtcgactggctccgctcccacgcgcggctcgaccacgtgctcgcccgcgacgacaaccgcgtcgccgccgccttccgccgcgcgcgtctccggaaggatcccaacgcccacttcctcctcgccgtcaacctccaggtccccggccggccggacgcgtacagctccgtgttctacttcgcggcggaggcgcccatcgcgccggactcgctgctcgggcgcttcgtctacggcgacgacgcctaccgcaactcccgcttcaagatcgtgaaccgcatcgtcaaggggccctggcttgtccgcgccaccgtcggcaactacggggcctgcctcctcggccgcgcgctcacctgccgctaccacaaaggcgacgactacctcgagatcgacatcgacatcggcagctcggcgatcgccagcgccatcctgcatctggcactgggcgccgtcacgtccgtgaccatcgacatgggtttccttgtcgagtcacagtccgaggaggagctgcctgagaagctcttcggcgctgtgcgcatcgcgcagatggagatgagttcggctaagtacgtggagacggcggctgatgaggcggcgcctgagacggccggcaaggccggggctgggttcagggttggctcagccaaggttgcgaacgatagccgccatcaggaacgcgctagtggcaaggtcagcaggtcaatgagctgccaggaacgcctgggtggaggaaaacagaagtgaaaaacagcgaccgtgacatataaatcttcagtcagagaatgaatcttgggttggaaaaatatgccgagaaccggaggaggaacaggcccgggatacataaaagagaaagcctggctagctgctgttgccacaaatgctcgtcccttcataatgtgatcagagctcagacctgatcgatgccaatactagtagattagtagcttaacatgagttgttattccaaaaagaaagtagttaacgtgagtgctgttttaacgacgataccccccggcttccctctgaaatcttacacgagtgaagtccatgatgaatgccagaaatctcaaatctgtatctgcttcgtccccctgtgaatgaatcctttacggccagagcagtactacggcgtg

SEQ ID NO: 1551 - DNA, 1593 bp, Panicum virgatum
tgcatcatccccactgttttatagggagctcctccgaaagcgagctcctccattcgcggcttcgcgcaaagcccaccccacaaaatctctctccccaaactgcccctcgccggcgcccggcggcgatgtgcccgaccgagcccgatcgcgccaataaggccgccgccggctccggcgaccggagctggcgggaggaggccgcggctgccggctcgctgcgccaggtcgacctcgaccgcggcaccaacggctgggcctcgccgccgggggacctcttccacctgcgcgcgcggggctacttctccggcggcggcggcaagcgcggcaaggcgccgtccgccgcggagtggctgctccgccccgccggcgtcgactggctccgctcccacgcgcggctcgaccacgtgctcgcccgcgacgacaaccccgtcgccgccgccttccgacgcgcgcgcctcaggaaggaccccaccgcgcacttcctcctcgccgttaatctccaggtgccgggccggccggacgcgtacagcgcggtgttctacttcgcggcggaggcgcccatcccgccggactcgctgctcggccgcttcgtccacggcgacgacgcctaccgcaacgcgcgcttcaagatcgccaaccgcatcgtcaagggcccctggatcgtccgcgccaccgtcggcaactacgccgcgtgcctcctcggccgcgcgctcacctgccgctaccacaagggcgacgactacctcgagatcgacgtcgacatcggcagctcggccatcgccagcgccatcctgcacctcgcgcttggcgccgtcacggcggttaccatcgacatggggttcctcgtcgagtcccagtccgaggaggagctgcctgagaggctattcggtgccgtgcgcatcgcgcagatggagatgagcgcggcaaagtacgttgagctgccacccgatgaggcgatgcctgagacggccggcagggctggggcggggttcagggtcagctcggccaaggtagtcaatcatagccgccaacaagaacacgccggcggcaaggccggcaggtcgatgagtctcccagagcgagagaggggaggaaaataggcgcaaaggatgctggtgcggtgccgaaaccatccatcagctggaggaagatgggctagagccggaggaggacgagtgccgggcagagggtaacacaactacacgaggcataaaacgggaggaaaattaaagctggtgccacgaccacgaatatggatggatggatcccttcataaagtcgattcgagttcatttggttgtgatgagaaacctaagccaagccctgatggatgatgctgcgaaatcaaagttagtactagtataaatattaatcctctgtgcgtttcctaatataacataatcatggcgcccggctttgttcttgggccactgccagccacatctctggtctctctgctgtctgtctgtctctgcttggtgttggtggaaatatctggcctgatgttgcctgctcggccgtgaccgtgaaggccctcctccgtccccccttgttcaggaagctgtcgcgattcagttgctcagtttctgtatc

SEQ ID NO: 1552 - DNA, 1452 bp, Setaria italica
ttgtggcaaccatgaataatatatcatacgagctcccccgctcctccattcgcgctaagcccacccaacaaaatctctccccaaactgccccctcgccggcgccccccggcggcgatgtgcccgacgacgcccgatcgcgccaataagaccgccgccgccggctccggcgacaggagctggcgggaggaggccgcggccgccggctcgctgcgccaggtcgacctcgaccggggagccaacggctgggcgtcgccgccggggcacctgcgctcccggggatacttctccggcggcggcggaaagcgcggcaaggctccgtccgccgccgagtggctgctccgccccgccggcgtcgactggctccgctcccacgcgcggctcgaccacgtgctcgcccgcgacgacaaccgcgtcgccgccgctttccgccgcgcgcgcctcaggaaggaccccaccgcgcacttcctcctcgccgtcaatctccaggtgccgggccggccggacgcgtacagcgcggtgttctacttcgcggcggaggcgcccatcccgccggactcgctgctcggtcgcttcgtccacggcgacgacgcctaccgcaacgcgcgcttcaagatcgccaaccgtatcgtcaagggcccatggctcgtccgcgccaccgtcggcaactacgccgcgtgcctcctcggccgcgcgctcacctgccgctaccacaagggcgacgactacctcgagatcgacgttgacatcggcagctccgcgatcgccagcgccatcctgcacctcgcgctcggcgccgtcacctcggtcaccatcgacatgggcttcctcgtcgagtcccagtccgaggaggagctgcccgagaggctcttcggcgccgtgcgcatcgcgcagatggagatgagcgcggcaaagtacgtggagctgccgcccgatgaggccatgcctgagacagccggcagggctggggcagggttcagggtcagctcggccaaggtggtcaatcacagccgccagcaagaacatgccggcggcaaggtcggcaggtcgatgagttgcccggggcgagacagcggaggaaaataggcgcggaggatgcgagagtgcgctgccaaaaaccatccatccatcagtcggagaaagacggcgagagccggagccggaggacagagaaatgccggcagggtaaagacagggcataaaagtcgagttcatttggttgtgatgagaacctacgtaagcctgatggatgcgtgcggaattaatagtatattaatcttgggtgcgtttcgtaacataaccatgatgccccggcttgtctttagctgcagccagccacacgtccctgatctctgcctctctgcttgttggaaaatatctggcctgatctaagtgatcttgcctgctcggccgtgaaggccatcaaaccccttgttctaagaacatgccgcgat

(The sequence listing continues in the following parts.)

What is claimed is:

1. A method of increasing harvest index, leaf blade area, plot coverage, and/or rosette area of a plant, comprising:
   (a) over-expressing within the plant an exogenous polynucleotide comprising a nucleic acid sequence encoding the polypeptide selected from the group consisting of SEQ ID NOs: 656, 3402, 3403, 3404 and 3405, wherein said exogenous polynucleotide is operably linked to a heterologous constitutive promoter, and
   (b) selecting the plant resulting from step (a), said plant overexpressing said exogenous polynucleotide, under nitrogen-limiting conditions which comprise between 0.75-3 millimolar (m M) nitrogen, for an increased harvest index, leaf blade area, plot coverage, and/or rosette area as compared to a non-transformed plant which is grown under the same growth conditions,
   (c) isolating the plant or a regenerable portion of said plant selected according to step (b) having said increased harvest index, leaf blade area, plot coverage, and/or rosette area under said nitrogen-limiting conditions so as to obtain an isolated plant or a regenerable portion of said selected plant, and
   (d) planting said isolated plant obtained in step (c) or regenerating a plant from said regenerable portion obtained in step (c) to thereby obtain a plant characterized by said increased harvest index, leaf blade area, plot coverage, and/or rosette area under said nitrogen-limiting conditions as compared to said non-transformed plant which is grown under the same growth conditions, thereby increasing the harvest index, leaf blade area, plot coverage, and/or rosette area of the plant.

2. The method of claim 1, wherein said exogenous polynucleotide comprises the nucleic acid sequence selected from the group consisting of SEQ ID NOs: 443, 187, 1935, 1936, 1937, 1938, or a codon optimized sequence thereof.

3. The method of claim 1, wherein said exogenous polynucleotide comprises the nucleic acid sequence selected from the group consisting of SEQ ID NOs: 443, 187, 1935-1938.

4. A method of increasing harvest index, leaf blade area, plot coverage, and/or rosette area of a plant, comprising:
   (a) over-expressing within the plant an exogenous polynucleotide comprising a nucleic acid sequence encoding the polypeptide sequence set forth by SEQ ID NO: 656 or an orthologue polypeptide having at least 98% sequence identity to SEQ ID NO: 656, wherein said exogenous polynucleotide is operably linked to a heterologous constitutive promoter, and
   (b) selecting the plant resulting from step (a), said plant overexpressing said exogenous polynucleotide, under nitrogen-limiting conditions which comprise between 0.75-3 millimolar (m M) nitrogen, for an increased harvest index, leaf blade area, plot coverage, and/or rosette area as compared to a non-transformed plant which is grown under the same growth conditions,
   (c) isolating the plant or a regenerable portion of said plant selected according to step (b) having said increased harvest index, leaf blade area, plot coverage, and/or rosette area under said nitrogen-limiting conditions so as to obtain an isolated plant or a regenerable portion of said selected plant, and (d) planting said isolated plant obtained in step (c) or regenerating a plant from said regenerable portion obtained in step (c) to thereby obtain a plant characterized by said increased harvest index, leaf blade area, plot coverage, and/or rosette area under said nitrogen-limiting conditions as compared to said non-transformed plant which is grown under the same growth conditions, thereby increasing the harvest index, leaf blade area, plot coverage, and/or rosette area of the plant.

5. A method at generating a plant having increased tolerance to nitrogen limiting conditions, comprising:

(a) over-expressing within a plant an exogenous polynucleotide comprising a nucleic acid sequence encoding the polypeptide sequence set forth by SEQ ID NO: 656, or an analogue polypeptide having at least 96% sequence identity to the polypeptide sequence set forth by SEQ ID NO:656 wherein said exogenous polynucleotide is operably linked to a heterologous constitutive promoter, wherein said orthologue polypeptide is capable of increasing harvest index, leaf blade area, plot coverage, and/or rosette area of a plant under nitrogen limiting conditions which comprise between 0.75-3 mM nitrogen, and (b) selecting plant resulting from step (a), said plant overexpressing said exogenous polynucleotide, under said nitrogen-limiting conditions which comprise between 0.75-3 mM nitrogen, for an increased harvest index, leaf blade area, plot coverage, and/or rosette area as compared to a non-transformed plant which is grown under the same growth conditions, (c) isolating the plant or regenerable portion of said plant selected according to step (b) having said increased harvest index, leaf blade area, plot coverage, and/or rosette area under said nitrogen-limiting conditions so as to obtain an isolated plant or a regenerable portion of said selected plant, and (d) planting said isolated plant obtained in step (c) or regenerating a plant from said regenerable portion obtained in step (c) to thereby obtain a plant characterized by said increased harvest index, leaf blade area, plot coverage, and/or rosette area under said nitrogen-limiting conditions as compared to said non-transformed plant which is grown under the same growth conditions, thereby generating the plant having the increased tolerance to nitrogen limiting conditions.

6. The method of claim 1, wherein said polypeptide sequence is set forth by SEQ ID NO: 656.

7. The method of claim 4, wherein said polypeptide sequence is set forth by SEQ ID NO: 656.

8. The method of claim 1, wherein said selecting in step (b) is for said increased harvest index under said nitrogen-limiting conditions.

9. The method of claim 1, wherein said selecting in step (b) is for said increased leaf blade area under said nitrogen-limiting conditions.

10. The method of claim 1, wherein said selecting in step (b) is for said increased plot coverage under said nitrogen-limiting conditions.

11. The method of claim 1, wherein said selecting in step (b) is for said increased rosette area under said nitrogen-limiting conditions.

12. The method of claim 4, wherein said selecting in step (b) is for said increased harvest index under said nitrogen-limiting conditions.

13. The method of claim 4, wherein said selecting in step (b) is for said increased leaf blade area under said nitrogen-limiting conditions.

14. The method of claim 4, wherein said selecting in step (b) is for said increased plot coverage under said nitrogen-limiting conditions.

15. The method of claim 4, wherein said selecting in step (b) is for said increased rosette area under said nitrogen-limiting conditions.

16. The method of claim 1, wherein said constitutive promoter is selected from the group consisting of a 35S promoter or an At6669 promoter.

17. The method of claim 16, wherein the sequence of said 35S promoter is set forth by SEQ ID NO: 3827, 3833 or 3834.

18. The method of claim 16, wherein the sequence of said At6669 promoter is set forth by SEQ ID NO: 3829 or 3826.

19. The method of claim 4, wherein said constitutive promoter is selected from the group consisting of a 35S promoter or an At6669 promoter.

20. The method of claim 19, wherein the sequence of said 35S promoter is set forth by SEQ ID NO: 3827, 3833 or 3834.

21. The method of claim 19, wherein the sequence of said At6669 promoter is set forth by SEQ ID NO: 3829 or 3826.

* * * * *